United States Patent 7,868,149 (PLANT GENOME SEQUENCE AND USES THEREOF) - sequence listing, part 14

SEQ ID NO: 6739 - DNA, 30586 bp, Oryza sativa
  unsure (1)..(30586): unsure at all n locations
cgccttgattgatatatcnnnnnnnnnnnnnnnnnnnnnnnnnnnnnnnnnnnnnnnnnnnnnnnnnnnnnnnnnnnnnntgcaaatataggggcatactccagatcaggaaagaaatactttcccgaaacccaagtctttctaatgcaatattacaagtatcagcataagcaaaggcctactgcggtggcttttgtatttgatatgagttacaaaagtcttggtatggcttgaaatcgttttgccatgctaaaaattgcttcttcaagcatttatatactttttcctcagcaggctgtatgtctatagctggagactcaaatttcatcctcactgggctgaaatcaaacaaattggatgcagcttgctcaggtccagaatgaggaattccagctcttccacaaacaaatgtcataaagttttcatccataggtggtgctgtaggagcatgcaaacatgaagggtcatctagcttctgtgtttgtttatccttctttctagcagcctcatcaagagtgggcctatcagtctgaggctcataaacaaaatatggtttatcatctttcacctcttgtgaagcagaccatccattacagttatctgtattagcaattgatatttcaggaacaaaggcttcaataacttctctgcaccgatggcttactgagctggaatcttcccgagaagggctgtctatacccttgttgctatcttccatcgcgagcagaacaggtatggggagtactggaccaacaagagaatttccagattttgctttgctcgtcagattccaactaatgcttgaagattttgccaacaggtaaggccgaagtttattactatttgggaaacatgcaggaacttccagatattcatatatgcgctttttattggtgcttgcaagcatgtccttgtatttggagaaggcaacaagaaggatatctgaagatagtctgctcaatatgctttgacatgcaatttcgaaaatgttcatgggcgcactagcattgcataggaaatctgaaactgactgagaacaagacgcagagttatcctttgcaaatactgatacatcttcactaataataatatggcgggaacgtttgttgacatcagaatcatgattctccaatgagctgcgcagattgcccttcagaaatttagataggtaatgcaacttcagaaactcatatctttcagaaaaattttctccgtgagtgtcaagagaaatggatgagctagaacccacagacttatgttgtgattcatcacaaatggcatcatcatgtaaatctccagaggcacggaacctttgcatctctaacttccccgatgatgttaaacggatcaaagcaaagccagtgaatgatgactccaacattgtgttcggaagcacgtggtaaccaatgatgtagttcctaattagttgagatgcagagccatgtcctggaacgacccccttgaacacctcttccataagtccaatgctgcagctgcagtgctgacctatcaaagaaatccgtgatggaagatcccaagcatataggggagcattttctgtagcgtcttgctccttagggccacaaaagaatagattaannnnnnnnnnnnnnnnnnnnccaaccagaatggcaaagcctgaatttgatgcccactcatgctccttagaaggcctcagttcagataatcgaaacatagcaatatgatttgggttatcaagcccatgctgccaagccaacacgggtatcaaaggccgtctgatatcaaagaccatcaggtgacgctctgtcaccaccgatataagaaaatcatcaaacggagccttgcagaatgcaaggtaacattgagtcttgacaaaaggatcagtttcaaacaacccttccatcccaactcttgctaaaaccttgtattcaccatgatccccaaatctcatatcaaccaaaaggatggccgccgtgctcgcaacgatcactgtccacggttgcgccccgtactcgcagcttagccagtcccccaggtcatccttgctgccaaaaccaaccttcatcttgcctccacgccgtgtatccagatcgaaccagcacagctgcccattttccagcagcactacacactccgactgcaaatgcttgctccagcacgcgtgcacaacagcagcgtcgaacgcctgcttggccgcgggcacgagcgcgggggagccagaaccccgcgactcaaccttgaaccaattcaccgagtacaacgtcgcagcaagaagaaacccctcgatagagctgtcgcgtgaccgcgacggccacgaggaccaggacgccgtggtggcaagctgctggatgcggtgcctggggtgcatgaacccatcgctctgcacggagtgggagagcggcgtggtggggtcggcgacggggtcgagggtaacgtaggagacctgctccgcgttctcgccggaagggaagaagacgacgagggaccgcgaggaggagggggcgcggaggacggcgagcaggttggagggcgccgggaagggcggggacggcgcggtgagcagcgcccccgagagggggtcgaggtcggcgaaggggaggaaggaggtggagcggacgaagtggcggaggaggtggcgaagcccgcgccggaaggggtgcggcggctggaagggggaagggagggcgaggagcgtggcgttcggcgggagcggggagaagaggaggggcccgtatgatgcggcggcggcgaagaacgtggcgagggacggcggcgcgaagacggaggagacgggaaagaggaagcgccagtcgtccgagaggttcattgccggcggcgccggcgaacacggccgcgcgcgcgcagcgcttcgaagggatgcaggcgagtgagtccgggaggtcttctgtggggagttggggagaaaacggcggcgacggcggcgcgggaggaagatggggaaggttttgggcggtgcctcggtcgatcgccgccaactctacaatatcgttaataaataaaaaaaaaaaagtaaagtccatcaccggtccctaagcttgtaccgttgtgtcatcctggtccctaaactcgcaaatcaaccgttcagttcctcaaacttattcgattatgttattctggtccctaaacttgcaaatcactcgtttaggtcctacaatttgttcagttgtctcatcccggtccctaaacaggacggtctaaaaactttatatcgaaaaataattcaaaactttttcatgtgaactctagtgaagataaactttatatcaaaattgtagccctcgacgtgacctacaactttgtagttgaaaagtttttgaattaaaactgtttagggtcccaaaatattgttgcatgtttatagattttgaaattttaattttaatattacattttgggacaaaaaatgacttaaaataaaaaaaattcaactacaaagttgtagatcgcgtcgagggctacaagtttgatataaagtttgtcttcattagagttcacatgaaaaagttatgaattatttttaaatataaagtctttagaccgtcctatttgatctagatgatattcaaatccaagttaaggaccggggtaacacaactgaataagttggtggacctaaacgaccgatctgcaagtttagggacccggatgacacaatcgaacaagtttgaggacctgaacggtcgatttgcgagtttagagaccgggataacacagcggtacaagtttagggaccagtgatcactggactttactcaaaaaaaaaaaactctacaatagcgatgaaaagttgaaaatggttagaaaaatcacgagatttcgtgaaccggttcgaaaattgatcctgaggggattttcgaatggttttccataaatttgaattcgaaaaggaaaattcgaatgaaatttgattgaaatatgtaaaaaaaaattagttcagttttcttgtgaaatatgtaaaaaattagttcagtttttttgttgcggttgaatttcgatgtagtgatacttgtgaaccctcacgctaatgaaaagtttgtggttttaagacgccagaaacaattttggtttgtacacgacactttatatgtaatgtttttatctttgtactataaaaagtgcccgtgcgttgcaacgaaaaaaactaatgttatgataataattatggatattttatagtttcatgggaattatatgggatactcctagacataaacaatgaattaaatctatacctaattctgattctatatcatgaaaaatgaataattacattatttgttgactccatttagctagaaataatttttttgacccccttcgcaagcgacaacggcagggcccttccccaccgtgagcggcggcggtggcggcgccctccccaatgcaagcgacggcggcggcggcggcgccctctcttaacatgagcggcagcagtgccctccctcaacatgagcggcggcggtggcggcgccatctcccactgtgtgcgacggcggtggcacgtcctctcgcggctttcataggtggcacaggcagcgtcggcagcttcccataggcggatctggtggccacggcggtgtcggcaccctctcccactgtgtgcgatggcggcggcacgtcctcccgtggctttcatgggtggatcaggcggcgtcggcggcttccacgggtagatcaggcgatgacgaagattaagataagatttgtgtgttttttattattttttctgttcctttctctttctttggattgtctgattggattttgtatctatatttgaatttgtgttttatccatcttacgtgatgtattactcgcgcgtgtgggaacggaggccatcgttcgactggactcattgacgaaaaattgatgtgaagaatggaaagttacagattttttaagtagttataagatatattggttcaattccagtgttgataggttaattagtcacggttcattagtagagtcattagcgtctagattaccaaaagtaattagtgttttcttgattagccttttccttagtatgtttcgagtccgaaccaagttagagggaaaaattgctaaacatctcccgcgtgattttttttcttggcatttgacgtttttttagccacatgatctttgcgccaagatttgtgcagcaattgccgtggatgaggtcgacagggagttaaggtgtgttattcttgtcgtgtgaataaaatacgtgaagtatgtaattttcatatgtctaattaagaaatatctctatgttaatttacatgtcaaattaagtactaatcgatacaacaaatttaacatatcttaaacatctaaataaaaattgatttctttaaccattgaaaaattaagacatttgaaactaaaataaaaaataaaaaaaataaaattacagccctatataactaaaattgcatttgtaaatttaattgatttgacatataagtgcactgtaatttttgataaaaataatgtgtaagtaaatatgtacttattattttctttaaaatataaaattatattttaaaattacagtcctatataactaaaattacatttgtaaatttagttgatttgacatgtaagtgtactgtaattttgataaaaataatgtgtaagttaatatgtatttgttatttttcttttgtagtccgttggatataaataaagggtaaaaaaaattgggtgattttttttattagaaatcacccgacaaatagatacatgctggtaaaagaaatactttgaattccacgtataattgcagaccatctgttatatggtctctgtataacctgcatacgtagcaaatggtgggccgtgcaactggcttcgtgggctgtgtcttgggccatgatcgttgctgccacaaaccgatccaattaattttacaaaatggctttgttagttttactcggaaatcctgatccgactacgaagcgtttgaaaatggggaatcggatgaacctgatgaatgatgaaggggggcgacggacgaaatcagtggcaaaaacatcttaaatttttataatactaaaaaaaataccggtgcgttgcaacgggtaaatacattttttatgatacaacaacaactattaagagctaagtcattggaatcactatacactataattaaaaaattaatgaatttttttcttggttttaaaccgaaagcacaatattttttctttgttagtcctaacccagtccactaaaacctttgttagtcctaatccagtccgctacctccctccattcgccccgcctttcttcggtcgtcaagctccaaaaggtaatcccgggcttgtacaatgccaaattcagttgaattattctcgatctcccaaaattaaattggttgaggattttttgatccaccaaatctccttttttccttgtttttccccaaaatcgaagcgaatcaaagcttgttgacctgccatgatcaacgacttttaaatagggattaaattcagtaaattaaagtccaggatatggaaaatgatgatggaggaatgtgaaatcgatttttgcaatcagttagagtagaaaacatacgggaggtagatcgaacgtggcagtggcgctagggttcggcccagaccagacgagatcgaaaaaagacaaaaaaaaaccggacttactgcgtgcgaagaaaaaaaaccatttcgcgtgcaaaaaaagcaaaaaaaataaaccgctcagaccaaggaaagcggaagcttggcggctcaggcggggcacgctaagcgcgtgcggatcggatcagagatcaggaaaaagacaaaaaaaaaaaagaaaaagaaaaaaaagggacttcccgcatacgcggagaaaaaaccttttcgcgtgaaaataaagggtgacaaaaaaataaactgcactgaccaagaaaaccgcacgattggcggctgaggcggggcgtgctatgcgcatgcaaataagagcagagaacggaaaaaaaagacaaaaaaaaaaggacttaccctgcgcgggaaaaatcccgttccgcgtgaagaaaaaacggcgacaaaaataataaccggacgaaccaaactaaaaccggatactctttttttttattcgatcatcataggcaaaaaccgaggtaggtaaagtagacttattccttccccttaagttgacagcccatattatcagtttggccagctttctacagcccaattagatttgcacacataaaggaatttttttttatttttaattttttttattaaaagttttacaaaaataattttccattttgaaaattgacggaagtagtcgcctaccgccctctgggagggcgatttttaaaaatcgccatcccagagggcggcgaaaatgacgtggcagacggccgttcgctctcgggcgacggccgtcaacgaaatttgcaagcggcccccttgccgccctctgctagggcgattttgtactgtgcggggggccgcctgcaaatgggcggcgagggggcatggaattttgcaggcggcccccttgccgccctgggggagggcgattttttcctccccctataaagcccagtcccccctctctgaaatttcattatattcactaaaaatccaaaaaaaaacgaaagagagagaggggagggcagcagaaggggagcggcgaagccctgctggttcgctcacttcatcacatgtttgctcccatacatcttttgcatttgtactaatatgttatgtttgagtatatatgttgcgtttttgttttagttccatatattttagcatatctgtagcacacagcacatatgtgtagatccagagcatagaatataatagtatgaattgagacatagacaatagtgttaattgtaagatatagtttagtttgatctagagaatgtaacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggcatcgataggcctgcggagagaacattacagtcaatttatagttggttgttgagaggatttagaatagaccaagaagtctacacaatgtcagtatcagttgtagtgagtcgtgcaacagaaggttatttttgggaactaatgccgatggacatcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcaatgcaaaatgagaaaaatcaaccaagggaggagcaggccatgggcatggcggatgagggggagagagtcggtataattgttgatgaaatggagagggaagattcggataatgaggaagcagacgacgacgcatcatccgatgaggaaggtgatgtaatggccactgattgggcaaatgaggacttctctggacttgttatatcagagggtgatcatgtaccctgggagtataaggagaacgaggtaattgacggtgcaaggtatgctcataaggatgagatgaaggaggcagtgaagcattgggcagtttccttgcagagagagtttagggtggtcaagtcaacaaattatgtgtatgaagtgaggtgcatgaaggaagattgtccgtggcgtgtccatgcatataagggtaaatgtaatgattattggaaagttagcattgtgaccgagcacaagtgctacttacaaggggtggagaagtatcatcgaaacatcacttcagcttttgtggcaagtgagatgtacagcagcgttgttggtaacattggctttgaaccaaaatcaattattaggcacatcgagaacaaattcaagtacaccataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattggatgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattacagtggtgcgtatgaggcccaacgtttgccttatacatgatcgtcatgcgggtatgttgcgggctattgactacctgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcagagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcaaaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacatagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacatgcagttgtatgaagccgaagcttcatcacctttcttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttacattccagatccatctaagttaagggtgaaaaagggtcgacgccaaactagacgcatcagaaatgatatggatgagtcagaagcaggtgggaggactttacgctgcagcaagtgtgatctgcgtggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctatcgatttaggaaataaaatgctgttgtgatgtgatgagtgttcggactaaatacttctatcgtgtaatttcaattgaatgttgttgtaatgagtacctccgactattgttgtactagtagtattgcgaactattcggtgttgtatcataatgttaccgtgatgagtgttcggactaagtactcatatcgtgtaactgcagttattgttgtaatcagaaatattccgtatggtgacacttttgtttgtttgtactcttgtttaatatgtgttagtaattcgcttatgaacatttattagttatgttgaactaattatttatatgtttctgatcaatctatttgatgcaggcatgacgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctctggtagaccgctggagacctgagacgcacatgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgatcaacagagtgttttgtactaacatttcattcttaattgtaggcggaccttctgcaccctgacgctgatgataactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagaagaggccgtcgctgcgagagcaccgctaggactttcgtcgttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactactgtgactaccttcgctggtaccttcctcgcactcgtgcgcgtgtgaccttcactccagacgccccagagccgcacgttgccgctgtgacggacgcgtatcccacgcaccgtgactgagactacttcgtgggggtacgtcgaatttgtattagttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggtacctgtttcgcacggtactgctcagcccagaggtttcttaagttttgtttctgtttttgtacgaaaacatcaccccgtcgtaacttgatgttccatcctcgcaggacctcgtttgccttcgagcgcccctagcttcggagcagtgcgacctacagcaccggtttcgcacggtacagttcagcccagagattagttcatttttgtttcagcttttgcacgaatatgtcaccatgttttaacggcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtacttaatttttattaatactattaaatacctgtatgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccagaccgactcacgtactcccaggggcacattagggcgcagggtaggagggacaggggtaagaggcctcgtcagtagtgttctacctcttcagttcttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcagcagctcgagttgtcactatcaactttcggcgctgcctgttgacataaagtgaatcacgcccacgcgtgatcgtcttgtcacatctaatgaataatgtatctcattgagttcacatatattgcagtgaaaatgacgctatataattgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggcggaaggatgagcatgaacgtcgaattgctgctgaggctttagaatggcacgtaaatcccctaggactccccacgtggcgtgagcgtccggagtgtcgttgtggtgaccgctgtcaggtcataaggtccgtaaggcaccgaactcgaggacaaaggtgtttcgtgtgtccaaacattgtcgacgatgatttcgtggtaattacaactattcttttcatcactcctcagtactatcattaactcaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccctaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgttccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggcagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttctgtcaattttcaaaatggaaaattatttttgtaaaacttttaataaaaaaaattaaaaataaaaaaaaatccacataaagcaagaaaagaatcctcgtcttcacatagctcgattcaattttcatattcagtccgagcgagcgaacggcggctgagtcgaaaccgttacgacaatggaaatcggacgaggattctttatatatatatatatatatatatgaaaatgcttctatacacccaggtgtacatactcctagtttcatccaccatccgttcgcaactagcagagatcgagtctgctagcggatccacataccgcgacccattttgatttttgcgaggaaaaaaatcatcgtaatatttttatcccgcacatatcgggagcatactgaatgctcacataaatatctcgttctcacgtagtgctaaaccgaacagaaaatcaacagaccgatccgatataagggcaatttggaggtgacggcgaggcgatacatcggcaagggtggctggcttgggccacggcggcgagtagcagacaacgacggcgatgcgcgcgatccaccggcaaggccgcaaggatggctcaggccacggcggcgagtagcggacaacgacacagcagaaatccatcatcgtcaagcccatgcagctcgtccgcctgccggagtgccggcggcgtgattccatcgacatgatcggcttttgcaccaccattatttggatattcccaggtgattgattctggtatgtccatcccgttttctctcgttttgtatttcttgcagattgatcaaggattctctctttctttttcttgcagatcgatcgaggtataagccagcatgaaggtcgccagctgcctcgtgatccatcggcgactcgatcgtcatcaatggcggcgatttgatcgtgatcgatggccacggccatgttgcgtcgacaatgcaggcgcgcagcccatcggcaaagccggaggcgacgaccaatctattggctcactgaaatcatacgggaacggaaaaaagcggcgctggagacatcagacagcacagcaccaagccaccaaccgaagatcatggcatccaacgaatgtatacatcagattatagtaatcacagtatatatgtgcacatcagctcatgtatcgatctggttgcctgcatatacatctctcttcttaattatactccattgaatctcttcctgattatatactactacaagatcaactaatttcatattatttgtcagtattacatactactgtgaaaagcgcatatatatgcaacagttaggaattaataaacccaacgagtatagtcgagtatggctagttttggaaatacatgccgcttttctgaatctttgaaaaaagcatgtattttatactactgatacttttgcatcatcaaatcatgaatgcagccagtagcccagtagtctgtactgctacagtgtaaaatcaaaatgttagactttgcactaggatcacctaggttagatctagtcgggtggttctatttgggtttgatgaacgacattgtcgatgaaagggagagggtttagataccgaccggttgaggagttcgaggaggaagaggcgccggacatcgtcgttgtcgtcgcggcttgacgtagatgcggcgccggtgaggtcgacggcgatgacggctgcggcagtggtggtcgtagacgtcccggcgatgaggcgtggcgcggcggtggcgtttcccgtcactggctgccccccctctcgatcggattagggttttgtggggtggagttggcggcggcggtgaacttcgtacccagtgccgtgccggcctccacccctcttttatatggcgcagtgtgacaggggcccaccagccattgggctgggcgcccccgatcagggcgcggtcaaggcccccttgagccgttgggctcaaggggagggagatctatctaacattctcccccttgatctcactttttcttttagctttttctattccatcacagatttgtaaatagagcatgtttcatcgtcacggtcaatcaccgatggattcgacagccactatacacaactctattcagaaacagatactttacttttgggccctgtagtccaggattcataaggcttcccttaaacccatgccggctacatgttccttgaacacgttgggtggtaggcctttcgtgagcgcatccgcgagcatcctttctgttttaatgtgctcgagactgattgtttgatcccggactttgtccttcacaacatagtactttatgtcaatgtgtttggcagcaccacttgactgattgttgtgagcgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagatagcatgaggccttttgttccctgcaaataacgcaagactttctttaccaatttccagtgctctaggcctggattactctgaaatctgccaagtaacccggtaacgaatgccaagtcaggtcgtgtgcagacttgcgcgtactgtaggcttcctacagctgacgcatatggctttgttttcatttcattgagctcatactgatttctgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctctttaaacccaaatttctttattgtcccatcaaacttcaagtaccactgtctcgaagcttgctttaatccataaatggatctctttagacgacatcccatattttcgtttcctttcatgacaaaacctttcggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggctgttgcagctcctcctctggtgtggcaaccatttctgttgaatcctgtataacaggttcttcactctcattcattggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcagctgactgttttggggtccaacttcccaatatttgggttaaatactttggcctctgcaggactcccccacacacggaggtgagttagcgagggtactctccctgtccatagctcatacggtgttttgggcaccgatttgcttggaactctgttgagaatatgaatggcggtttttaacgcctccatccataaaccgagtggtagtgtggagtagctcatcatgctgcgcaccatatccataagcgtacggttgcgcctttcagctaccccattctgttgaggttcgcccggtgttgaatactgggctactattccattctctagcaagaaccttgcaaaaggtccagggacttgcccataaggcgtatgtcgaccatagtactctcccccacggtcagatcttactactttaatctttatatcaagctgattttcaacttcagctttgaatatcttaaatttatccattgcttctgatcgctctttaattggataaatataaccatagcgggagtaatcatctgtgaatgttatgaacgagtcatagccatccacgctttttacaggaaatggaccacaaatatctgtatgaatgatctctaaaattcctgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgatagtgccataatttcgatgagacatcgggagttcgctttcttttcttgttttcttttgtcaatgaggacacaacattcacattctcagaaagagataacaaataaagctcgtctcgcaacacggcaagaccaatacatgcattattatgccatagttcacatttgccacttccaaagcggcaatcatatccatcaaaatccaactttgatacacttattaagtttctttgcaaagaaggaacataaaagacatctcgaagtaaaagtatgaagccattcgcgagctctagaggaagatctccaacagcttcaactttttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaacttggaagccatgttgctcattctaagtatgtggtctctaacaccacctccatggtacctttctgtcacaagctgcttgatcagctgtgtagcataagtctttgaagagtcagtaaactgactctttattctttcaaggtactctgagacagcgtcacactctgggatcgagcccaatatggtaggctcaatcgtattctttaccacagccaaacatttcttgttggctaagaaccatttcttttgttcaatgtcatacgacatgacgagaggagcattgtccctctgtctcttttgccagtcagcatctgactcattttcacctctgacaagttcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacatcaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaattacatctatttgcagcggaaaactataaaaatcatatgaacagtagcaaaatctctgtaattctctctctgtgaaaattctcccgttggttcaaatttaaacagaggtaaaacatgcaaaaaactattcaaaattctattgaaatttgcatgaaaattgacaaaataaaatggaaaatttctactgttctcttttattcattttcggcccccgagggacctaatttgaacttttgccggcggcccacggcccttttggcacgggcgggcgccccctttccccaagccgcaacctgggcctgggccaggaaaaccgccccccgcgcgcgccttcttgggccgatttcggcccggccggcgtcgaccgtccgatcagctagggtttcgatcggacggccgggcgccgagatcggaggatcaaaacccccctctcccggccggccgccgaaaaaccctagattctcttctcttctctctctcacgcgaccgcgtggacggcgtcgccatcgccggcgaccttcgcgcccgccgcgccatggccagcgccttttctcttcttctccgctccccccaccgtctctaacccccaccgtgtgagagagagatggcgacgacggagatggcggcgccgccgcgggccccctcgccggtacgcgcgtgcaggtgcgcgcgcggccgtcgagtggctcctaggcggcgcctctttgcccctccccccctccgttgccggcgtcggcgacggccggcgacgaggtaagattagggttagggttttcggctcttttgatccgtgcggatcttgtgcttttctttctttggatttcttttcccgaaccgatctaagccctagggttgctctgataccattgttagactttgcactaggatcacctaggttagatctagtcgggtggttctatttgggtttgatgaacgacattgtcgatgaaagggagagggtttagataccgaccggttgaggagttcgaggaggaagaggcgccggacatcgtcgttgtcgtcgcggcttgacgtagatgcggcgccggtgaggtcgacggcgatgacggctgcggcagtggtggtcgtagacgtcccggcgatgaggcgtggcgcggcggtggcgtttcccgtcactggctgcccccctctcgatcggattagggttttgtggggtggagttggcggcggcggtgaacttcgtacccagtgccgtgccggcctccacccctcttttatatggcgcagtgtgacgggggcccaccagccattgggctgggcgcccccgatcagggcgcggtcaaggcccccttgagccgttgggctcaaggggagggagatctatctaacacaaaatagataacaaagtatataccgctagtaacttaaaaaatatgttaaaaaaggcatataccgatactaactataaaaaacagtatataccgatactaacttaaaaaaaaaagataccgacactagcttaaaaagtagcatatactactactaactgaaaatgtagtatatacatgatcagtatatactactatactactaacaaaaaaaaacagtacatactactactaacaaaaaaaggtatattctccttcaatgagtatacttaaaaaatgagatatatacatctctgatgattattgtagtatatatagtacttattaactaaaaaatagcagataatacttatattaactaaaaaaggtatatacttccaaacaaaaaaaatagtatatatcaaacaaaaaaagtatatactgaccaaattaaaaaatagtatgtgcagtatatatcaaaaacttagtatgtctactgaccaaacaaaaaaacagtatatactcattcagtacggacgtaatatatgctggaaagaaaattaaaaatttgaaagcaaatgcataccaacgttatcgtttgagtgagcaccaaatccggtgtcagctgtgcacatgcatacggtggtttcaaattaataatttcactttaatttggatgctaatggatcatccattaataagggggagtacatacatctaggtgtacagaagagtcgtcatgtatatatatatatatgtgtgtatatatatatatatgtgtatatatatgtgtgtatatatatatgtacatgtatatatgtacatgtgtatatatatatatatatatgtatatgtatatgtacatgtgtatatatatatacatgtgtgtgtatatatatatacatgtgtgtgtgtgtgtgtatatatatatatatatatatatatatatatatatatatatatatatatatatatatatatatatataatgcccgtgtgttgcaccgggtaatatcacggtggataaagttcaactaaacgatttacgtagtctagtacataattttgtttggacaatattaactcgatctacgagtaggatattcaattctcgcattgcaagcatgtgtcttactttcaaaatcatatatggactccgcgtagagatttactcaaagtctcttggtggccacgcgtgctttctcactatgtcaaaactcgcgttgcaatcatgtgctctcgttttcaaaatcatgtgtaatttttaatccttatgtcaaatctttaattttttacaatcggttttttatgtcaaacaaatattaattgtgggaatatattgatttttctatatattgtatttgcgagagttgatggcacatgtgtatcataaaaatcgatgtctttttgaggtattatgttttatttctaaatttcatttatgtcaaatatcaataaatataccggggcataaatggaaaccgaacagacatggaggaaaaatagaaaaattaaattgaaagctgaaccgactggaggtgggaaaaaaaaagaaagcagaagtttctcgtttcttcagggctgtttggcacagctccagctccacccctcctggagctggagctcagccaaacagttttagctccaccaaaactgggagtggagttgggtggagctctctcacaaaatgaactagagttgtggagctgggtttaggtagctctacaactccactccagacccaactcctagagctaaatttagaaattggagctctctctctcctcagcctatctttctcccccagtcccccgtgcttatcctttttacttcacactttctccatccttagcagctcccctcctcccacatactctagggccatgtttggcaaatgggacagagaaatgatttcccactcaccataagacatctttaaatcctaaccattcattctcccccttccatttaatcctaatcattcattcatttcccaatcccaatcccaccccttatttcctattatccaaacacaccctaggccctagctgctgatgctggacatggaagtgaaggggtcagaggaggatctggaccccctctccggcgacctccctccccaagcggcagtgtccggatcgcgagccatcggcggagggccccatcgtctctctgccccccgctcgcacggatctaccgccggcgacgacgggaggggcggagcctccaagctgccgttgctgctcgcgtggatccgccgtcgacggggatgggagtggcggatccgacgaattcttcccctcccgcatggatcctgtcgtctcttcggccccctctcgtgcggatcaactgtcgacggcgatgggaggggcggatccggcgacctcttcccctcccgcacatatccccgtcttctctccacccgtctctcgcgcggatccgtaggcggcggcgacgggaggggtggttccggcgacctcttcccctctcgcacggatcccatcgtctcttcgcgccggcgacgacaggaggggcggaagcggcagcctccccactgctgtcagttccggccactgccgcacaggtactttattttctctaagacaatatatcatgttttttatgtgaaatcttgggttcattttgcataggagcaatcctgcagggggttgataatgtgccgatgcttcagctacatatagtttggtgctattttgtgcttcgtgatgtatcacgctgtattttttgtacgcgctgcttaggtggtgtttgatccagggacttaactttagtccctgtctttagacactaatttagagtattaaatatagactacttacaaaactaattacataaataaaagctaattcacgagacaatttttttaagcctaattaatctataattagagaatgtttactgtagcatcacatagtctaatcatggattagttaggctcaatagattcgtctcgcgaattagtccaagattatggatgagttttattaatagtctacgtttaatatttataattaatattcaaacatccgatgtgatagggacttaaaagttttagtcccatctgaacagggccttactctcactaccctataggaaaattggatatggaactgcaagtgaggctttggcctgcaagctgcagtttatttttgtccgcagagattattttaatgaagagccattcttgcggattttacttgaggttgaatcatttctaatcaaattatgctaggaataacctatgtgcagctgtgcgtaaagtgtcgccatgtcccattctatttcagcactaccagagcagtattgaaatgaccagaagggagttccttaatgggtactggaaactttatctactccgtgctctcacacttgaaccatgctatgatggtccaacaaatggtggtgaggtaatttttcaactgatttcccaggttattgcataagttcatccgaacgggccaaagttcacaatatttatgtggttaatgcaataacattttattaaatgaaaaggatagatgaagtcactgacgcatggcttattagtcttattataattagcgtatgtttgtgcttatctggctggagtggtaaaagataggtcattcaaagataggaattgcaaaatggaccgaagtgctctctctgtgtttttttttcttataccatctcaaataccctatttagagattcagtggtggtagcatgaaaaacatagattttccaagtatagatgatcgtagtacgctttggagttcttgaaccttctgtgcatgttttatctgacaatatcagtacttttatgtgattctattggccatattacttcaaaacttgatgttggctgtgatttgagaatgttgctaaacgtgcatttcctcagttgtatgttagttttaatttcttttctaattttgtcatgaagatatgagctcggtaggcacttcaatgtcttttcatgattaatgttctgcattcatgtgaatgtctgaatcgaaggacctgtctagaacatccatgttgctatgtgccactgaacaactgaaaaatatgcctggttctaactggctatctgttctgcatcgacaggaaaaagaattagatacatattggtagatgcgtcgacacaactgcattgcccttcacaggtgaaacgaatctagacaatcttaccactatatgttaattaattagatggtactgttagttcattcataagctgccttagaagtatttacaattgaaattctattaggatatttttattattaatggaagtgcttctgttagtaattgttcaaggaccttggggtagttatattcaatattaatcccataaatctgatgaaattgaaattgcatccagggaagagcctgggatccacattgattggaggtggctaaatgccctagaggaagagccttacgatctatattttcttttgtgcttctattatttctattgcctgtgattgtatttgtgtattttggcctgcgacagaaatatgtaaaaacacgttagtgggcgtgctagctaaaaatagcggaaagaaaagtgggatagaatctaactcggatagagtcgagatagaatctgacttctgccgtgggctggctaaactggagtaggaaacggtgtgagcggcgaaccaacctgactcctgcgattttttttttgtatgtgatcttttttttttggcgtgaacctggactcatgccttttttttctttgtgtatatgtgatatttatttttgggtgaaggcttgtagattgaaactacctagaattctggaagcagtctgggcttgtgggcttgtggatgtctggaaggtttgtgggcttgtagattgacctgtaatcctttttgttggatgaaactggagcatgggcttgtcaatggacctagaattctggaagcggtttgggcttgtggacatgtggatgtatctgatcggataaaaaaaaattaccgcgatgacggacgaaaacgcggaccgaaaagaagctgacgactggaaaaatccgaatatatatatatatatatatatatatataacgactcttctgtactcccaggtgtacatactccctcttccatattggatcatctaataggatccaattaggacctgcttagccggtgggaaattttttttgaaattcctatttttcagccgaacagggaataagccaagtaaaaaaaattaacttgaaaaatttccatgcatgtcggcttgggattggttgcacgcctgcatctacgaatttgaaatgtagtatttgtgcaccttgctgtagcatggaaattcgtgacttatatactgttttattttacattagctatatacttattttttaggaacccatatatactatatctctgtttgaaagagtatatactttttatttgaggatccagtatatactaaaagctggtttgagaagtatatactacttaatttaagactattcgtatataccgttatctctagagtctattagtatatgtaaaggtagtaccagtaaatactttttttaagttagtaacagtacatactttttctatttattagtagtagcagtacatactgtcttttatcgtagtgtggtagtatactgttatttggtcagtacatactatttttgttggtttagtagcattatatactgttttcagtttagtagcggtatatactattatttggttagcgttaagtacatactatttttgttagtttagtagcagtatatactgtttttcagtttagtatagcagtatatactgtttcttttagttagtagtaaagtagtaatacatactaagtaacagtacatactttttgtgtatcgagaagtggtattatcaaataaatgggcatatatatgctcaccgattcattctttgtataagcgtacaagattaattcttaagaaaagtgagtagtatattgcccaattctgagtgtcgtgcaacaggtagatctgccggagccccggtgtagaagatgaataatcgcactgaccgcagcggccgcgcacccctttgcgatcgaggccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntntcgcgc

SEQ ID NO: 6740 - DNA, 1172 bp, Oryza sativa
  unsure (1)..(1172): unsure at all n locations
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttgatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaacttgtcagaggtgaaaatgagtcagatnnnnnnnnnnnnnnnnnnnnnnnnnnnnnnnnnnnnnnnnnnnnnnnnnnnnnnnnnnnnnnnnnnnnnnnnnnnnnnnnnnnnnaagacacagcccacgaagccagttgcacggcccaccatttgctacgtatgcaggttatacagagaccatataacagatggtctgcaattatacgtggaattcaaagtatttcttttaccagcatgtatctatttgtcgggtgatttctaataaaaaaaatcacccaattttttttaccctttatttatatccaacggactacaaaagaaaaataacaaatacatattaacttacacattatttttatcaaaattacagtacacttacatgtcaaatcaactaaatttacaaatgtaattttagttatataggactgtaattttaaaatataattttatattttaaagaaaataataagtacatatttacttacacattatttttatcaaaaattacagtgcacttatatgtcaaatcaattaaaattaca

SEQ ID NO: 6741 - DNA, 680 bp, Oryza sativa
  unsure (1)..(680): unsure at all n locations
gcgtggcattatatatcctatnnnnnnnnnnnnnnnnnnnnnnnnnnnnnnnnnnnnnnnnnnnnnnnnnnnnnnnnntttgtgacttaaaagcccatgttgaaaaagaaactacgttgaaaatatctcaaaatcaatctcaaaattaagcttgaaaattcaaattttggctttttctttggcttattaggccatctgatgggagccttacagaaactggaatatccagaaaatcatacaaatattaaaaaaataacaaaattacaaagccaacaggttatcttcagagtaatgtgagtatagtgcacaaaaaaacagtttaacatgaatattggatcaagactcttcagacagcaccctagattctgtttggtaaatcaagaataatataaaatcacctcctgtctcgttcttacaccacaggatggcaaagtggaaacacaaactaaaacaatgtttctgagatgtgtcgcccataaatatgatgccgatttcagtacataaaagctcctaattccaagaaaatatactacagatcgatccgcccttgaccctaggtcaaaatggcaaccttagtatggttatagtaccatctcaaatcctaaacaagatgttgtggtacatgcaagcaactgtattgattaaagacaagtatcgctataactcaagattggtacctt

SEQ ID NO: 6742 - DNA, 915 bp, Oryza sativa
  unsure (1)..(915): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcctatgcaagatggaaataaaaaattcagtagttgtcctatattatgcaagataaatgaaataattgtaagaactaatacaaattcgacgtacccccacgaagtagtctcagtcacggtgcgtgggatacgcgtccgtcacagcggcaacgtgcggctctggggcgtctggagtgaaggtcacacgcgcacgagtgcgaggaaggtaccagcgaaggtagtcacagtagttctcctccgtgtgtgggaagagctcgttgatcacctcctctgtagctaacacccagtcgtcaacgtactgctgtacacgtggagcccaaagtgcgcctgctagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6743 - DNA, 982 bp, Oryza sativa
  unsure (1)..(982): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcatctgactcattttcacctctgacaagttcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacatcaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaattacatctatttgcagcggaaaactataaaaatcatatgaacagtagcaaaatctctgtaattctctctctgtgaaaattctcccgttggttcaaatttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6744 - DNA, 738 bp, Oryza sativa
  unsure (1)..(738): unsure at all n locations
nnnnnnnnnnnnnnnnnnnnnnnnnnnnnnnnnnnnnnnnnnnnnnnnnnnnnnnnnnataaatggaaaccgaacagacatggaggaaaaatagaaaaattaaattgaaagctgaaccgacgtgaggtgcatgaaggaagattgtccgtggcgtgtccatgcatataagggtaaatgtaatgattattggaaagttagcattgtgaccgagcacaagtgctacttacaaggggtggagaagtatcatcgaaacatcacttcagcttttgtggcaagtgagatgtacagcatcgttgttggtaacattggctttgaaccaaaatcaattattaggcacatcgagaacaaattcaagtacaccataagctatgcaaaggcctggagagccaaacaaaagattattgagatgaggtatggcacattcgaagcttcttatgataatttgcctggtttgttagccaccattgcccagaggaataataatacttactatgacctacatacatttacatcggttgatgatcgaacaaagagtgtgctgcaaagagcctttctctcattggatgcttgcatcaatgcttttgtgcattgtcgacctgatctatgcatagatggaacttttatgacaggtaaataccgaggtcagatattgacagcaattgggtgtgatgggaacaaccaaggtctacctatggcttttgcatttgtagagagtgaggccactgaaagctggtcttg

SEQ ID NO: 6745 - DNA, 919 bp, Oryza sativa
  unsure (1)..(919): unsure at all n locations
agctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcctttgcaaatactgatacatcttcactaataataatatggcgggaacgtttgttgacatcagaatcatgattctccaatgagctgcgcagattgcccttcagaaatttagataggtaatgcaacttcagaaactcatatctttcagaaaaattttctccgtgagtgtcaagagaaatggatgagctagaacccacagacttatgttgtgattcatcacaaatggcatcatcatgtaaatctccagaggcacggaacctttgcatctctaacttccccgatgatgttaaacggatcaaagcaaagccagtgaatgatgactccaacattgtgttcggaagcacgtggtaaccaatgatgtagttcctaattagttgagatgcagagccatgtcctggaacgacccccttgaacacctcttccataagtccaatgctgcagctgcagtgctgacctatcaaagaaatccgtgatggaagatcccaagcatataggggagcattttctgtagcgtcttgctccttagggccacaaaagaatagattaaattcagtgctccatagcgaaccaaccagaatggcaatatctgaatttgatgcccactcatgctccttataaggtcttagttcagataatcgaaacatagcaatatgatttgggttatgaagcccattctgccaagccaactccggtatcaaaggccgtctgatatcaaagaccatgaggtgacgctn

SEQ ID NO: 6746 - DNA, 2100 bp, Oryza sativa
  unsure (1)..(2100): unsure at all n locations
ncaatgttctttttggggaaccccgtatttctgtgtttatcgtttcacccctttgaaggacataaccgcttcgcctatcaaaacggccgagcgcagtatgtaagtggtttagaaaggaaaggtgctcacaacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaatcctttttgttggatgaaactggagcatgggcttgtcaatggacctagaattctgtaagcggtttgggcttgtggacatgtggatgtatctgatcggataaaaaaaaattaccgcgatgacggacgaaaacgcggaccgaaaagaagctgtcgcctggaaaaatccgaatatatatatatatatatatatatatataacgactcttctgtannnnnnnnnnnnnnnnnnnnnnnnnnnnnnnnnnnnnnnnnnnnnnnnnnnnnnnnnnnctgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatggtcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtgcatagcttgaatatgtatactatgtttcaaaannnaangcgcgcg

SEQ ID NO: 6747 - DNA, 751 bp, Oryza sativa
  unsure (1)..(751): unsure at all n locations
gcgtgcattaggatcaccctnnnnnnnnnnnnnnnnnnnnnnnnnnnnnnnnnnnnnnnnnnnnattcatgaatcggggagtcaatccaaagaacgataagggagcagataagatttcggaagcacccaaatcctatacctatgtttatactccccagatctacccggggaagccgccgacaccagctgggtcacccataacagcccccggaggacatgcgagtccccattggacatgatgagagagggtgccgacatcgacgtggccaccagaatcgactatgggaagctgacgacgctgcctgtgccacctatgaaagccgggagaggacgtgccaccgacgtcgaacacagtgggagatggcgccgccaccgtcggcgctcatgttgagggagggcactgatgacactcatgttaagagatggcgcccgcgtcgccggcgtcgcttgcattggtgagggggccttcaccgcacatgatcacggtggagaagggccctgtcagtgtcacttgccaagggggtcaaaaaaattatttctagctcaatggagtcaccaagtaatgcaattattgattttttatgatatataatcctaatcaggtatagatggaattcattgtttatgcctaggagtatgccatataattgccatgaaactatgaaatatccatgattattatcataacatcacgtttggtcgttgcaacgcacggtcactttctatcgtacaaagataagggcattacgtn

SEQ ID NO: 6748 - DNA, 1016 bp, Oryza sativa
  unsure (1)..(1016): unsure at all n locations
gcgttcaagttgaacanctgctcgcnnacgctcctntagacttgaggaatgcggtaccccgtcgacggcggatccacgcgagcagcacctgcagcttggaggctccgccccttctgttgttgccagcggtagatccgtgcgagcggggggcacagagtcgatggggccctccgccgatggctcgcgatccggacactgactattgatgagggcggtcgtccgagagggggcccagatcctgctttgacctcttaacttccatgcccagcataacaagctccggcctagggtgtgtttggctaatatgaaatatggggtgggactggggtcgtgaaatgaatgaatgattacgattactatggagtggggagattgagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtaagaacctgcagcgcatcaaaaggcaaaattggtttcataacgttgaaagatatcgagtttagaaatattttcacccaaacatcctgatgaaatgggcatctaccttgtcatccatgcatattggcacaaacagaagttcactatggtgcattttgcagaagtagtgaagtaagcaatggccaagaagtagatgcctcacctctagctgccctctccctgcagcagcatgcagcacggtggatccacggaagtcgagatactccgacacgtcggagcggcgctcgatgagctccctcaggatcttcacgctgccgcccctcgcggcggcgtgggaccgcctgctcattatctccagcccgaacaccgaggagcgggncaccgcaccgncgngcgcgccttccccggcgttggggcaattcgtcgagcaccttggcgacattgcgtggtcccagaacaacctggacaccctggcggttcccgcccttgg

SEQ ID NO: 6749 - DNA, 1019 bp, Oryza sativa
  unsure (1)..(1019): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaagagaagccctgggtgaagaggcgaaacgagaggaagcggaaacagaaggagaagcagaaccagaagcaggggatcagtaagtaaagagagacaatgctcctacactaaactacattactgcttcctgtgattttgcttgtgtgaatctctaggcctttgtatagccatcaaacacagacgttctgacctgcctgcatggttaccatttctgatctgcagaaacggagagctgattgtaaagcgcagcataccagagatcgtcaagtgaacagccggctgtaattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6750 - DNA, 742 bp, Oryza sativa
  unsure (1)..(742): unsure at all n locations
gaggtgaggcggtggcacatggggtagcacatagccgttttgaaataaaagcaagaagggtattcatgacgcagtaggttagagggtgacgagtaaagcaagtagtgtgagaggaagggtaagaagtagcaattggagattggggtgggggaagaagttaacgtggagaagagagtaaggagaaagtaaggctgtggaaaggacgagaagggcgaagtagggaggagatttagagtagcagtatggttggcgcgttcgggacggatgagagtaagagagggtaagccgctccgattanaagcgggggtggggngagagangcgggaaccggggcggggggggngtgggggggggnnnnggnnaagnnnnngnntccccccccccccccccccccccgcgacgagcgtcggcgacggcggcggctggctggctggctgcctcactcctctcatcgaagatcgatttctctcctcctcaacccgctacctcgcctcgcttggatcgaagaaggtacccttctctcattctcctctcggcggctaccgaaccgggcagcccgccctgggtgggattggttcctttatttggcgatgaactactacacgcacctccttccacgtggcaccaagccttctcctccaagtcacctcgctcgnnnnnnnnnnnnnnnnnnnnnnnnnnnnnnnnnnnnnnnnnnnnnnnnnnnnnnnnnnnnncattgctatcaaannnnannccgcgg

SEQ ID NO: 6751 - DNA, 1089 bp, Oryza sativa
  unsure (1)..(1089): unsure at all n locations
ccggcactgtgaaactcctnnnnnnnnnnnnnnnnnnnnnnnnnnnnnnnnnnnnnnnnnnnnnnnnnnnnnnnnccatgtgtcttttagggacttaagcacatctgttaaagcagtgtgcgcatggcgtatgcccaatactttggaaatttctttattcacagcattcaagcttctttatagctattttgctatatcactcatcatattttacaaagcagttggtatatcacccggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacggcctaaagtcctggtttgataatattgtaaagtagatttaggaaaccgataccgtattggttaaggtttctatcttgtaatcctgccccccaccctatataaggtgggcaggagtccctctagggggcatgatgacacaaactagatcgtcagatctataatacacccggcggattcaaatccccaaacaggagtagggtattccttctcattgagagggcctgaacctgtctaaatcttttgtctccgcatccatccacttttaggtctgtgcgctacccccttttattattgccgaattcatgttggnnnnnnnnnnnnnnnnnnnnnnnnnnnnnnnnnnnnnnnnnnnnnnnnnnnngagtcagaggatgtactgtcagnaacagcgtc

SEQ ID NO: 6752 - DNA, 1254 bp, Oryza sativa
  unsure (1)..(1254): unsure at all n locations
ttgggccgccccaccgcgcacaccttcgccgaccacttcctcgccaggtacggctactccgtcggcgacgccgtgcacgccgtggcgcaccacctcgccgacctcacgctgctcgaccgccggagcctgaggatccctccgtccgtcgtggcggcgtcgccggtgtacctcgcgcggtacgcggccaccaccctggcagatgccgggctgccgccgccgctgccgtgggaggacgacgggctgaaggcggtgacgggatacagcgtcgtgtacctggcacgctgcatggaggagatgtacgacgtgcatgagatggcgtcattgtggccgggttacgacgagatgaagagcagattcgccattgactacctgttgcttccttgcagacttgtggtgcccttagtcttaatgtgatcatcgtaaggggtttaattaattcatagtatataggggatcgacgattagctaggagagtcaagagaatcaggtagcagaaaaaagaaggggttgatctggaaggggaaaaaattgccggcatttcgatgctacaagcagaagtccgttgcaaacgtgtgaggtttcatcaacgatgttgttgattgtggtaaacctctttgtaaccattaatttgatcttagtaaatttctcttggccgacgaacgccttgttcgcccgtaaaaaaggtggtgcatgtaattgtagcttagcatctgtacgtaagttttttttaattgaaatgtgaaatgagatgtttggaaacgtcgtaagttcaatttctcgatgacgtgtatttgcttacttctaaaattttatttcggaaaaaaatgcttttcattgtctacaaataataccatttaaatttaaacataataattacatctttctagctttgtttacactccgttttagccttttaggcctccttttagaacagatagttttcatataagtaaattttagggattaaacgggctttttagctactttattggattattgtcacagattatttactctaggtctcttaaatatgttttctatagatcacttgttcgaagccatttataaagtttacttttaaaacattaattcattcataaatcaaatatataatcggcagtaacaataatccaacgagtaatctgttaaacttatctttttgcaagaattttgtaaatttgatgtgttccaacataggggtaccgaattcctcnngtgtnnngnngaagcggcctcatggatcaaatnncacgt

SEQ ID NO: 6753 - DNA, 17600 bp, Oryza sativa
  unsure (1)..(17600): unsure at all n locations
aacgcgggtntttgttgattnnnnnnnnnnnnnnnnnnnnnnnnnnnnnnnnnnnnnnnnnnnnnnnnnnnnnnnnnnnnnnnnnnnntgatactttccttcattcagcaattgcaggtttcagaaccccaggcttccgacggcttgaccgccaaatggagcttatgagacacctgatacgtggaagaacatcaaatatccaaaagattatcaacctgaagaatgatgcaggcctcacagtccttcacatgcttcttctcccaagtcctcgtcggcggccacaacacgtacaccacacagcggcgcgagaccggaataggaggtttcaatggaggtggtgggcggcgtgtcgtcgctgagcgcgtcttcgccggcgccggcgcgggcgcggctgcggcagctgtcgcccggcgaggcgagcggcggggggagcttcctgctgatgaggacggcgccgaggagcaggctgcaggcggcggcgaggccggcgagccgggcggcgctggtggtggaggccagggggagggggtggtcggaccggcggtcccagcagcagcgcatgccgcagctgcccaagatcgaggacgacggcaaccccgcgcttcgtcatcttcatccgcaccgccaatgtccgtgctgccctgattcttgttcttcttcttcttcttcttctccattcctgatcccaatgcttcgcgtgcgtgtgatcaagatttgtgtgggtttttttttctggtttctgcaggtgtacttctggtacccgctcaacatcgtcaccggcggcacgacggcgaagatcatgctcgcggcgaaggacaacttcctcggaaagtacatctacaaggacacgctcgccaggaaccttgccgctgtcatctacaaagtaattaacagcacaatctgtttgcttacacaaattgtcacacaatcgtgtttgaagagttgtagaaaagagaagatttaaatgtgcgtgtttcatgatttgatttctgaaggatgaggatgacataatagacacagcaaaagagcagtacagggtgctgaagaccgacaatgagtttcgatatggctacaaagttgtggtaattttctcagtcctcatcttctgtgggtgattgtaggttgttgcactcgaaaaaattgagaattgcaatttacctgtctcatttgggtgagcaggagaatgggaacctgaggtctgcgctgacgacaagtaatgtgatcgaagtacgtttcgctagcgccttttatctcctctccctgtcgaattctctgcaagttatgtaggagtagcaatttctcatgaacattagagctgaaatctctgaaaatgtacatttcagacttgtatcttgctttatcctaggctgacattttctagagcacaaccttcaaattattttggcctagtactagatagtagctcagaaaatgttgtcctggaaaagaacttctatgcagttaagtgaggatggtaggcatttcttatagtaaatgtacaaatgaccatgttttcagtaagcatgtcttgagcaaaggtagcaagtcactaacagtaaaatgttttgattatcccagctcccaaagaaagaagagctcaaaactgtggttgacaaggtgaaggacttcttcggcgacgtaacctctggcgccaaagagtcgtttgcgcagattacaggatctgtcagcgcagaggcagaagcgccagtggaggaagagaagccctgggtgaagaggcgaaacgagaggaagcggaaacagaaggagaagcagaaccagaagcaggggatcagtaagtaaagagagacaatgctcctacactaaactacattactgcttcctgtgattttgcttgtgtgaatctctaggcctttgtatagccatcaaacacagacgttctgacctgcctgcatggttaccatttctgatctgcagaaacggagagctgattgtaaagcgcagcataccagagatcgtcaagtgaacagccggctgtaattttccagtgtgctcatttccctgtcccagattagctctgtgtagttcctcaatacttcgagtttttttgcaacaaacaatgtgtagcttgcctgtgactctgagtaacttgctttgttcttccttactaaatctgcagctagagtctcctgggatattagaaatcggtattttatggacttatggaacggcgaaaattactgttgtatattgacctcgtttctgatgagttacagtggctgtacagtgtgtgcgcgcgattgcgtatgaccgaatgctgtttatctgttttctgaaatgttgcatctgaaaacaggctcagaacaaaaggaattacgcttggttctattttgcagttctcttttgagactagcatgtcaggctatttcaagcatatagagacccataagatcaaacagtgcggaaccccaaaaagacatcgccacaagacttgaaatgaacgaacagattcatctcagaaagacatgcactcttctcgttctacaaatctaaagcacacttactgaaattgcacacggaggttctctttaaaacctttttgctgtccgcaataaaatcaaaccgagataaagatcatgttctcatgagcctaggagtacaagtagaacagcaatttcagtacggtttatgtccatggggagctttgcagggatctagaaggatcacacctccaacgtccaacgtagaccattgaatttacaagtcaatgactcgtgacagtttctggatgcggttcagcaagaagtccccttgcttgatggtcgcttggtagaaggcattcctagcgtcaggtcggtttgtctccagaacaccagcaaccttatcgatcttgcagtgaagcttcccagctgcaatgaaccgcgacaattccctggaacaaatgaaagggagatattatctccacagcacaggaacagaaaagaatgttttgtcctacacaggaatcacaaacataaaactaatgcggatgggtgacaggacttactggtctatgaaatcaacagtcacaccaaatgctgcggccatcgcttccattgtcacactcttgtatgactccaaaaactgtgaatagacaacggtccgcacttccctcatatagtagcggaaatgaggctgaagatagcgatccaacttaatctgctccgtcatgccagctgaaaagaagtttagaccatatattcatatagcccagccgtacagactgtaacagtaaaactatagacagcttatcaagatactttacacttacagaatgcaacaaaaaatgacttgtactggcaattgtaaagggagttcagaaactcagatagatgaggtactttgccaatcactgccaaaatttctggtgcatctaccacctgccatatttcttgttagtgagtcaattaagaaaaagaaaagagagtgtaagaagtgaaattaccttttgttttagagatacacgatccaatgtgattatgcttgtgatgactgtatagaagacaaaagtatcatatggaaacaactcgtaagttgtgaaagttgagatggaatctaaaaataagctggcagctttcttgaagtttctcgttgccatgaagtataggccttcatatactttcaatcggttctttctctcccagtcgcctccttcctcaaacaggcttcaatcaacacaataaatagtcagatgtcattgctccagtatagatggcagaatggatcttcacaaaggcacaatcaaagctatagcttacttctgtgccttgtcaatggattttgagatgagatcaaagtccatgtggaaaaggcctatttgcaaagtgtagaacacaagatccattttctggccaacagctacagttttcccttcagtaactttaagctgctccagtgctttttcctgcaatattgatttcaaagaatgcaaatagctaaatctcaagcacacacttaatgtaaagtatagaagcacacaagtttataccttctctccaaccctcatgaagtacaaggatttcgccagatgggcctcacgcacttcgctctcacccaaattctcttcagcatcagcaattcttcatacatgaaacataattacttagttacttccagaggaaccaaatgattcttatcaaacttctagtaactgaaatattagatacagatgcgaagagcaagatcagaaagtagaaacaatgaaacatgcaaatcaccaaaaggacatatcttgactggaacctcaacttctcaaggaaactatttctaacaaatttcaacatgccgttcttccttcacattagtttacactggtattttgtctcgagaagttgcgtattgtgatccttagcaatctcaattacttctctacatgctaaattacacattgcagagaaaatgtacaaaatcatgaatatgtacatgaatctaaaacaaaaatgtggaaaaagtttattattatgtagtatagatttgcatagaggtgaattaattggccctaaacataattcataaattacaactaccgaatcaaatgcaagctatctaccagttttagcatctacatctcgcaacacagagtaagctaggttagctaaggcaaacggaccatatcaacacctgagttatcgcaaaacttatcgcatacgcaacacagcaaggggcggcctaatttttggggggctaaaaatctactactacttaaaaaataagaggtgcttccatcgtccgtcacaaataaataaaaacagcgaaaaaaacaggaaaaaaaaagatgtccgattccctggcaaaaaaacacccgatcccttaaaaagggaaaaaaaaagtccgagagacaaaccgtttaatgaataaaaaaagcgaaaaaaaaagagtccgattccctggagaaaaaaaatctgatttccctggaagagatccgatctgtattggattggagaaaagaaaaaaaacacttctctaggtgcttctgtcgtccgtcaaaaaacgggagaaaaaaaccgagcgaaaaaaaaaaagaaaagtccgataaaaaaacctggcgaaaaaaaaccgggcgaaaaaaaaacaaatatgtccgacaaaaaaaaaggaaaaaaaaggaaaaaataccgaaacgaatccgactacatcgacgcggtaaaaagagtttaaaaaaataaaaagaaaactgtcctattccaaagaaaaatgaattatatgtatcgtggagcaaaaaaaaaaaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaataaaaagaaaactgtcctattccaaagaaaaaggaattatatatatcgtggtaaaaaaatcgaccgggcgaaaaaagaaaaaaatagtccgatccgaaaaaaacaggagaaaaaaaaatgggcgaaaaaaaatttgtccgataaaagaaaaggaaaaagctgaaaagaatctgactccatcgacgcggtaaaaaaaggcgaaaaaaaactttccgataaagaaaaaggaattatatgtgacgcggtaaaaaaaataaaaaaaccatgcgaaaaaaaagataaaagtccgataaaaaaacggggcgaaaaaaaaacaaatctgtcctatccaaaaaaagccaaaaaggggaaaaatcaaaacgaatccgactccgtcgacgtggtgaaaacagggcgaaaaaattccaaagtaaagggagaaaaaaaatcaaaacgaatccgactccgtcgacgcggtaaaaaaagggcgaaaaaaatccaaagtaaaaggaattatatgtgacgcggtaaaaaaaatcgatcgggcgaaataaaccgggcaaaaaaaaatctgtccgatccaaaaaaaggggaaaaaatcaaaacgattccgactccgttgacgcgataaaaaagggcgaaaaaattgtctgtttctaaagaaaaaggaattatacgtgatgcggtaaaaaaaatcgaatcctattatatctagaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgttttttagtccatttatatatcttctttatctctaatctaatctaatctaactataaaaagagaagtttctacagtatattaaaaaaggaaaaaatgcgcgagaaaataaaaccggtttaaaaaaacacgtgagggaaaaatgtcagaaaaaagcacaaaagaaaacgcgctagaaaataaagcctcgtattttttattttctgattgctatcgacaggggtatgcatgaaaaatgtatattatcattatgttttttcacccgttgcaacgcacgggcatatttgctagtaaaataaaatcagaagagaggaagaatccactcacttctcgtcgagcttgcggacctcctcgtcgatccgcgcgcgcatctcggcgagcagcgcgtcgtccggctccaggacgcccgcggcggccagcgactcgaacagcggcgccatgccatcggacttgacggcgtcgagggcgtcggagcggagggcgaccttggcgaggtcgtcgaggtcggggtgggagaggaggaagagcttgtgggccagcaccaggtggcgctcctgcttcgcctcctcgccgccggcgtccatgtcgttctcgtcggagttgggggttcgcggttaggtcggctcgagacgaggcgaggcgaggttggggcttgggtactgggttgggtgggtgagtgatgccgagtctgttgctgttgccgaactgatgaaagaggagtgcggcccgctacggcctaacagcccatgggccggattcagatacggtccccatgggccggattcagagccggtctcagcaggcaacagagctaacttaaccaaagaggtggatttgtctccggttttatttatgtatgtatgtcatccgaaaattcattaaagattttaaagataaattaacatgtaggagtaatatattactcaacagacatgtaagttcaaattcaacatatacaaaacaaaaaacaacaattttaacacacgaactttccgccttgttgaagatttgggggtgctacctgaagatttgaatggatggtcatcactatcatgaacaaccgagattcaatgagaattcgccctagctttttgtctttgacataaaaaaaagtttttcgtattattcacaatcaaattacttagttctaattctacttatatgtgtcaaatttaagcttgcatatttgtggagtgatattatttattcgatctatctcgtccttttctttttttcaaactttttgatgagtttttgggtggcatgcagcagaaggaattgtccttcagggacaaatagacttccccgctaaaccaagcacattactgattacatattcaagataactagaagaatgaagagaaaatttggttaaaagctaagtattcagaaacggggcaagtcataacccagcagtatgtacagatattcaaaatgaacaacaacaaaaagcatcactagatcaatcaccttcacaactcaaaaaccagtgagcgagatttcgtagacagttaattgaagttatctgagtctgacaagcaaaatcttaatctcctatgcaaagcagcaggcaaaaaccacaaaccaaaggtagcagaaacaaactactcctatcaatgcacagtgctactaccacctatgataagtatcatcctgcatgcatcatcacacatcatcaaggtagcagaaacaaactactcctatcaatgcacagtgctactaccacctacgataagtatcatcctgcatgcatcatcacacatcatcttcgacttgctagacaaaaatcaagtggaaacgaactactccttccgaatcatagctatagcttctggcctttcctgatctggactcaaactctgaataagattgatacgtgcgggggggacttgtccgggttagaccgggggaggtcgtcctcgtccgggaaggttgggggggacgtcgacgccgggggtaagtccatgtcctgggagtaggtcagcccgtcctcgtcgtcggtgtcaactagtgcgccatgaggaggattgccagtgccctcgtcagcagccacggcagtggtactgctgctgccgacggcagtggcagtggcgtcgaccttgacctcgtcgccggtgttgctgtcgtcagacccggcattggcagtgggatcaacctcgttggcggggtcgttgttgtcggacgcggtggcattgttgctgccggtggggtcgacatcatcgtcaatgtggctgtcagtgtcagtgtcggtgtcgaccggcggaacagcagggaaggcgccgggcttgaacagaaccaggatgacggtcgtgttgtcgcccgatggcaagccaaactgaacaagctcctcacagatgacacgcgcttctgcaccctcctgcatagcgatattaattggtcacagcaagtcagcaatatttggccacagcaaaaggaacaacagttttaacaacgaaacaatcgagcatgcaagatatttttttgacgtaaacatgcaagatattagtcacagcaatattgatcaaggcaaaaggaacagcagttttaacaacaaaagaatcgaacaatcacaaagcagatgacagtgtacttattagcacttgtttttttcttttttaaaaaatcggatgctttatattgcctgagtgaagtcatttcctagaatttgacacaaaatatttttgctattacagtaggagatctcttgtcctgccaagaagacaaactgagcaaaagaaaaggactcaccaaaagacggtcatgtgtgtgatcaaccacattttgatttgtcatgttgcacctgcatggaaaaaacatagtacagtaggtatgcaactataaatgaaactatatatgcatcagcaggagaaagaaaacagcatcacaaagagtactagtgacatcaaaatgatcaaataataattattgtcagttattttttgttcaaaatttaccagaggccttcagttgctatcacaagaaactccatgtcatcagttatgtccatctgacacagaaagggggattttccatcagaccccacacagcagtacaaacttcaaattcaaccaaatactaaacaaacatagttgcacttacagtcaggatgtccggattacatgtcagcatttgatcttcaggaggtaaacgttcgttcttcttgcaagcgaagtcccctgaaatgtaagtgggtacaacacatcagcaaatcacaacataatatgtttttttttcggtgctattatctgcaataaacgaaaaacagatccaggcaagactataccaattgatcttgagattgatactcttcccttaaaatcagtgaagccccattgtttcttggttacccacctccccattattttacgataactatacccaacagctactcctcctgcattctgaactctctctctttcagactcactgtctggtttatgatcgacggataatgcactggccttttgacacaacagaaacaagcacaaatgttaggcacgaaaataagtgagcatgcaaattaggtaccaacaagaaattcgataaggaaatagtcactatacctgaccatttcttgagagtacacaacgagaatcaccagcatgcccaacaatcaattggtcacctctgatgacaaccacacatgctgtgctcccttcatatgatggcgcagtatatgttgcctggaaaaagaagaaagaaactaaaggacataatagagaattccaacatagtagagatacaggttaaccaagaaatagctcacaaaagcaaccagacaaagaaaagcatttctgaaagccaaaccagtgtatatgaaagagataaccatagaagagatgccgcaaacaatacctcagtttagggtagtgccatactatgacaagaaccaaggtgcaataagaacttaataacctgtcaggcgtccaactcaccaaaccaggcaactgataagtaactaactggacctttttttacaggcgcaattagttgaggttagggttaaacatatctcttccaactccaaagtacatctcaagaaagaacaatagtctcgatatcacacacattcttccatttcctttttcatagatacaataagcactgtccaacaaatacagttttgagtaacttcttcaacatatggatattataagatgtttaggggttaaaggatcactacctgcgggaaaggcgaaaggttagcacagacaccagccttgataaaatacatccatccattattacgaggaataactaactccctccaagcatcggacagttgcaggtcctcatccatgctgcagaaattacacaggaacaatgatattccaaatttgcaagtgcagcatcattcagtgcaacaaaatgatatagactaggcgaaaataacctgtaaaacgcactcctcatcgcattacttagattgctgtcgtagtcttcatgattgcaaagctcaatatgaaatcgttttgcacaatatgatgctacttcagctcctgagatagaaaataaacaactcagaatggtggctcaagattactcctatgtgcatatagaagcttataaagcaaaacaatgtgatgaacacagcagatcagcacttcataggtatcataagaaaaatagcaccacacataaattaaccaacatgttcatcagtggctatccttttaattatcatgactgttaatattaactcacaaccatgcagtgttttatccctcgtaaaataatatttctgtttaagcagttcatgttatcctagaaagcacaccgcacaaaggtgattagtactaattagcaaacttggttcattatccagaactgtagcctaatatttatttgagaattcacaggtgaaagtttcagcataaacagtaaagttttcaaaacatgcacgcagataaacacatgacatacaaagacaaacaaagcatgatgtaaacagttatgccgacgatttggaggatttgaaaccaaaaaaaaaaaaaaaagagagagaatgaagatcaaacctccatggccatcataaacgccaaagaatgacgtcatggtatcatcaagatttagaatagctgcatgctagagaatatagagggcatatgtcagtcacagtattttacacaattacttacagatcagtaagaaatttttgcagaactatccttttttttgtcatacaaaaggctgcaagtttactcacagcatcttccattttctcaccccatccttgcatagacgacacaacatacttaattctgtcattctctttttcatcagtgaactttgattctacaggaaggctgttacccatagcagacctttgttttgctgaaaattaataacatgaatacaaatatacaataactttattgacaaatatggagaaagagtaaagtgaatacaattacaaaacactacagatcaattaaatacataagagctttggtaaaaacacgaaaaggagtcaactagacataacatgatatgacactatttatcagggcccctaaatgcatttttgagacatataacatgagagtatcaatcttcagttgcaatgctgcagtattttgcacattaatcttatatcttatacaagaatcaagcaaagaataattaaaataaaatattactgtgaacaaaatgcatacaaggttttgtaagaacgccatataagctttactgacacaaatcataacaccaaattccaaagtgaaatgaagaggaaacaaacagaaaaggcgtattgtacaaggacaatcaatttcctcccggtatggccacctcttcggtgtattaaaacttcaataattcgaaacagagtatgaagtgaacagaagaagaaaaacagagacagcagcgtgcacttatagtagaattcagcaagaagaatacaacatgacagcgtcactgagaagtaaaatataggtaacaaacatgaagaaattgtacaatcttgcagaaccaaaaccgttgggcttagaaggatcccaaatctaagattcaagagatgaaagcttctttgatatgcaaagaatcagaagatttctcatcaaaaagggaaaaaaaaacaagcagtttaaccaagctacacatgcagaaatcattgtatgaacagaacatggagttctttccaaacagaaactaaaccaagataacacgtcagagagaacatggagttctttccaaacagaaactaaaccaagagaacacgtcagagagacacatagagaagaagcatcctgcatcaggaacagcgaaaagaacaagaaggccgaaggcggcatctggttaataaattttcagaaactgaactcccgcaacacaccaaaattaactgaacaaactggaaaatacaagcagacaagagaaacgaattgacgtggtctaattttttgcgcacgcactggtagagactttgagacacacacagcaagatcaatacaccatgaagcttcggtgctcatcagcctcctcctccaactcagaaaaccacactccacctcaaacttcaaaaccatcgaagcaacaaaagcacggtacgggaagcctacaagagagggaaaaaaagatcaaacagctgtgatccttgccccaagtttcggatgacgaaacgcctcaagattcaaagagaggtcaagacgcggttgctgctcgatcaaatgccacaacagcgaaagacatgatcgaaccagaaaaaaccgcgacgcccccaaacacccaagcacgcagaaaccacaccaccaggaggagagggagaacaccaccagaagagcgagatcgaaggaaagggagaagaatctcacggcgctttgggaggacgtagggtttagggatggaggaggaggagaatctcacaactcacctcgcacctttcgccgctactgctcttgagatgagtacgttgcgagagagacagagagagagagagagagaggagagagatgcggaaaagtggttgtgcagcgaagcgcaaggagaagaaagcatcgcgcttaaatacctgaaccggacgcatctcggctgtcggatcgtctctcgcggctgatccaacgctcgaggagtgcaccgcccgtgtctggtggtccccacggagcacgcgccctcctcctctcgccctgcatgacccacattgcatttgcaactatagctgtggtgtccgttatgcacatcccacagctgacatgtggggcccacagtctcgcttctgtctcttcttctcgacgcataggcctctctctccgcgccaccgacgcgagctgccgcttcctgacagccgcgccgccacccacgccaccaacctcacatagtgcagaagccggagtggctttgttcctacgtgacaatcaaatcaatatttttttaaaaaaatcagtgggacccaactattagagagggaggggtgtgagagggaagctgatcaaattatcacaaaactatatattcgttgatcaaattatcatacattgatcgaatttatatttctaatccagtacattgatcatcaagttcgcgaatgtatgatggtatcaaagcttacaaggcagagacctgctgctgctgctgctggcctggccttggtatgaattgtgatccaccgattccagtgctcgtgatttctgaagatctcggaatagagctgcaaactggtcatgttggcctgcaaagagacaaacaagccaatggaggagttagattgaattgtgagaggttactgaatttccagcttactgaaatgggctctctttatgagtaaaaaaggagcttactgaaatgggctctctttatgagtaaaaaaggaatgatagagtaagtacgttacaggaaactaagggcccctttgcctttgatttgtaggaaaagtgttcaaaatttgaaagatttcaaccctttggaaaaaattcctatgaaagcctttgaaacaaaggattgaatcctatactatccttcaaaattcctatggaatggctaatcctatagagattttgaaggaaagttagcaagaggtccaacctcttggaaaaatttctttgagtctatctctctcatccgattcttgcgtttttcctgtggtccaatcaaacggttattcctgtgtttttcctgtattttccaatcctctgttttacacctgcattcctgtcagaatcctacgtttttcctattcctccgtttttccattcctgcgatacaaaggggccaaacataatgtgggagttatttgctctttattttcagatagtgaaatcatctcgcagtaaaattgctcttctttcaggctaaaatcaaagtagatgaaaatgagatattgtataacgtttacgctgaacacctgtatttctttgttggttgaaaaatgaccctattaatattgtgcgctcagccaataccataattgctctctacgttgacgaacaaaatacaaactagtgatccataacagatatatccccccatagtgaccagaatacttactgatatgcattatgtatcaggatcagcttctgcaacatgaagagcccatatgcatatcaattccaaaccagttggaatgtcctgatttctttctataagaactgatgagacatacatcaggtgcagcgctatcaatttgcaagaagttgcaaacaacacatagaccttctgacatatgcttcaggatgttgtgaaacagctctgttaaaacaaaagttaatgtcaaaattgtacctaactaataaagttccttaacacaggaaatgtctgtttaggcttggagtacccagatcttattgtatcaagaatagctgtggcaacagctgatgcttccggatgcattgtcatgcacttcatacagacgccaagcatgcatacaatttacctaggacaacaaagtagcgactgagcaaatcgataccatattaccatgtgatcttttatcatatcattgcatgagtgggagcataaaagcagcagcataaaccaaaagcatacaaaggaaatctattttttgaccactccgactgcaaatctttagcttttccaagaccccatttacgagattttcctgatttaagtatttaacttgacatgatctagatggaacctcctctttcataccagtgtgaacaattcagaagtgtcctgattctaagacttccctccaaggacctgcaacaggacaggaggtcccctgtccctgaagtagctaaatttcgagcatgtactatgtcaaccagaccacagggtaaagtatagaaaaatacagatttataccttctgcctgacacttatgaagtacaaggattcagctagatgggcctcacgcacttcaatcccacccaaattctcttcagcgtcagcaatccttgatacatgaaaaaaaattactttcagaggaagcaatgattcttgtcaaacttgctagtaactgaaacattagatacagaacaaatgcggagagcagaacggaagatatatgtgaccagctaaaaggggatgtgttgatgactggaaccacaattatactatttatgctctagtgaagttatatatcttgattttccttcacattagtttacattgggtttttttccttggtgaggagggtgcataaattacttttatattggttgggaagttgtgaattgtgatccttaggaatctatattgcttttctacaagcccaattacatcttgtaacaatgaaccaaagcatgcattgatgcacatctgtgagcctggaatcaagatacacgaacactggcaatatactgaagacagaattaggcacttggtatgcaaactctctcaagaggaacctcatacaatacataccgaccccattctgaaacataattcataaattacatatatccagtcaaatgcaagtgatcgacaagttccccaaagtaacctaattacctaacctaaggttcgttgaggaaaacgtatcgtagcaaagacttgagttgtcacaaaatttatccccacatagagagtgctacagcctacagctataagaacagcaacgggcaaacctaattttctgggcaataccgcaataagagtaacatgatgccaaaattgaggggaggaagaacccactcacttcccgtcgagcttgcggacctcctcgtcgatccgcgcgcgcgtagtccggcggccagcgactcgaccgcggcgtgcaggcggggagccggccgatggatagatggagagagacggcggatttgacggcgtggaggacgtcggagcggagggcgaccatggccggcgaggtcgtcgtcggcgtcgggatgggagaggaggaagagcttgcgggccggcacgagcaaccaggtggcgctcctgcttcgcctcctcgccgccggcgtccatgtcgtgccggtcactgacgagtctctcacttttttcagaacattttttttttttgagaacaacgagtctctcactctcttgctgttgccgactgccgagccgaactgaaagaggccatgggccggtttcagccacgaaatgcttttcagttcgaaaaagttctctccacgtcccttatgtacgaggtagagtttcaatcgcgtcgcccaattctaaaaccaggtataagcagggtttcttttcggaaagcaaaaaaaattcggtaggcaccattccgaacaaaatattttgaaattttaacacattttttttactaaatttgaataaataaacaccaaattcacaaatatttggaaaaagcaaaaattcaaaattaattttaatattttataacttattttgtcaaagaaaatttaccaaatcattctcttaatgcaacgcgagaaggtttcataaagtttcaaagaaaaagtgctcccaatcacatagtagagaacaaaacttaatgaaattaatagacatgatatagccgagctatcattactgcaaattctgaaagaatgagttaattaaaaagccctcattgagttggcataaaaattcaagttcgatcctccatgtagtgcgctcctacttcttcatacctagaagacgtttgagcggctccaagggaaagccacaaccatggtatgagttcttcgtttcagggctgcttgccccttcgcctcgataaggaggtcttccagccgtagaccgcttactcttcttctgatttattaacttatctttctgctttgtcactctcgtattctgaataggaatcggcaaacaggtacaaccatcctcgaaaaatcgaacaaccctcttcaccttactcaccttagtgtcttttacctcataagcattttccataattgttggccctacctgatagatattttcaacacttcgagttgttccgccatgatatccagaaaatgttggcatcannnnnnnnnnnnnnnnnnnnnnnnnnnnnngaangtgcgatgcaatctacgagtnctataaagcaccgt

SEQ ID NO: 6754 - DNA, 1792 bp, Oryza sativa
  unsure (1)..(1792): unsure at all n locations
ccgctacanngtttgacnctctnnnnnnnnnnnnnnnnnnnnnnnnnnnnnnnnnnnnnnnnnnnnnnnnnnnnnnnnnnnnnacccagtggttgtcgccggggcggcaataccagagctccgtgtcggcgaggtcgatgacgaccacgacacagctggtcgggtccatgggaccgcagcatgagaggaggcacctccggagatggctgccttcggcggcgaggacggtgccgtcgtggtcggggggcagcccgacacggcggccggtgaaagggtcccataggaaagtgcacggcgagccgcggtgcgccatgagcaaccagccctgcgccgtggcccaccagcggtggcctctcatcatgtcgtcgacgccgccgtcgcccaccctcgttggcgttggcgttggcgccagcagcgctctcttcggcacgctgtagaggaacgtggcgtcgccgtggccgccgaacagcagcagaggagcaagcttgggatccagagcggcagatgcgtcgactgcctcctccatgatttcaacggacggctggccgatcgatctttcggtaattaatccttcgtaggagacggccggtcaatctgtgctatgctttataaacgaggagagtttgtggcagcccgatttaagtgttgtctcgtgatttctgttcgaaatcatccgagaggctttgagaactagtatatatatatattggcatataggaaagagaaacgaagaaatctgcacgcctaaatctgcagcgcccatgtaagtaaatcaggaaaaggaaacatgaattcctacacgtacggcatcaaaattcaaaccaattataatctgcaccgccggtaaatcagttttttggcacggcatagagacggatcctccacattactatgcaaccgacaaaaaccaaccgggtggggtacaaactattacaagcggaagctgacctatatgtgatgcgagtccggtggaaacacgtttccgaagaagcagtgcagcacagaacgcagcacgccatgcaggtcacacgcgtgcccgaactctcgagattctccaatctccaatcacagaggcggccgctgcgacgacggcggcgcagctgggacaactgccggactggtcgtctctcccgttggacatgctcgtgctcgtcctgggtcgagccacccgagcttcgtgtatgatcagtatcatccgtcgcatgcagatgcagtgcatcatcacacatcatctccgtcttggacatcaaaattgagtggaactgtagtgaaccggtgacctcctcctgaatcatgaatcatgcatctacgggctgtcgtcaggagccgtgccctcgtcatcagctaaacttagtcatcagctgagtgactaagtttgcatgtttccgctgacagagatcgattcagcgcggctaaggattcaagatgccgttcctatcaatcaaggcggcggcggcggcacagagagagcaagcgagcgacaagctacggcaggaaggagagaagaattctagcacccggtgttagtatgagtggaagagggaaggacatggcttaacgatgccaaggggcgccgtggcgagatgacggtcgttcggcctcggcgtgaaccaaggagtggcgccacgggcaccggggtcggagaagaggaaggcaaaagcggcgagcttgctctggtttggcggcaaaacggtcgcggcggacagaggggtgacgcgcgcgcggggaaaacggcgagcggcgccgccggtgaaccgggagcgcctttcccgttccgaacggcacatgcgcg

SEQ ID NO: 6755 - DNA, 5182 bp, Oryza sativa
  unsure (1)..(5182): unsure at all n locations
ccgccccattgattgactctcnnnnnnnnnnnnnnnnnnnnnnnnnnnnnnnnnnnnnnnnnnnnnnnnnnnnnnnnnnatcgatgaggcaatgtggacaattgaagagatgaaaagacgcggatttccaccttcagtcatcacatacaccactgttcttgaagcttattgtaagcagcgcaactttaggagggtctatgaagttcttgattcaatgggttctcagggctgtcatccaaatgttatcacttacaccatgatcatgacatcgttagcaaagtgcgaaaggtttgaagaagccttgagtgtgtctcatagaatgaagtcatctggttgtaagcctgatacactattctacaactccttgatcaaccttcttggtaaatcaggccatttgttcgaggcttcccaagtatttcgagtggaaatgccaatgaatggtgtgtcccataatctggctacctataacaccatgatttcaatcttttgctactacggtcgagatgatgatgctctcaatgtgctgaaagaaatggaagcacaatcttgtaagcctgacattcagtcatatcggccgcttcttagactttttttaagcagaagaggccaagctgataccgtccggcacttgttgagtgaacttaccagcaaacataatctaggtttagatcttgatacatacacccttctgatacatggtctttgtagagtcggtgataccgtgtgggcgtatcaactgtttgatgagatggttagtagtgaaatagcacctaggagtaaaacatgtgtgatgcttttggatgaagcacaaaggacaaacatggagacttatgttgaaagaatcgggaattacatgagttcctttggaatttctgtttaagtttttaatggatttattctcccatgtgattaatttattagtattcagcatattacatatatttttgcatgaaaaaatgatgcttgctatagtgattgggtgaagcatggacaatctgtatcttaccattaatgcataaactaaaagtcaggaagcatcttttgaccataaccataatagtagggtgttaatcagtagaattataggcaaatcaaatgcaaacgtcttcttttactttagtatttgatgcataatgcatttgtaaacatgatacaacgtcgattgaactaactatttttctggtatgttggcatgagtgcatgacagttactattgcctgagattcaaaatgcacgatcgaatatatacttctgtgtgaacaatctttttagattttaagcactaaatgtgtaaacaactaaacttgtatggattaactgcatataaacattgttgttgggtgtgtctagcaaaaaacttccacaatatatagctttgttactcttttgctagtatagtatgatgaaaactatatgtcgatgtatttattgtattggagaccatggagaaaaaaccatccacatggggatggaaagtatgtgattatattttggacgaagtctctcgcctgacaccttagaatactaccatcattttggtaacagagttgcaaggcatgttccattggcttaagaatcacagcaataataaccggttaacatgccatctctcctacataaaatgattgattcgattatctggaatagtggtctttatttactatttattgacatggagcaaatgatgcaaatggatcaagacttggatacgccttagcaagagcctggaagatttccaatcaggcgttcattattgataagtaaacaagttgctttacatcaacctctccctatttctatatgatatcagagaagagccgccaaattaatttttagctagtgtatgtgagtaccactaatggctggaaataaaattgtatttctttcgggagaaagaaactcaccaaactgacaccatgtttagatcccaattttttcttcaaactttcaactttttccatcacatcaaactttcctactcacatacacttcaaacttttctgtcacatcgtttcaatttcaaccaaacttctaattttggcgtgaactgttctatgaaactggtgctggtaatgtcctggtgtttgaattcgtgatgcctactgaatccactgttactttctccaggcaacgaatttctgcaccatctctgaatccatcttttgcatctttgtctacttgggggtactgagatacatccatccaaaagaagacataaccgtgcactcttgtactggtgtagttggagattattgtcatataggagtaggagtattagttttgtttgtccgagcttgtccaattcagaggtcatgtgcatctgaattatggcgcctttcacttgtcctgacctctgggattccgccggaccctctgtctgggtccctgtcgtcttcacgtaaactgaaccacttctactgaggacggcattactctgcctggtcggcatgtctgcccattgtcaaaaaaaaaaaagttactactagcatgtagttttgattgagtatttggtttacttttttaaaatggtttatatctccaatcctcgtcattaggcaggtcttgatactgaaataaaaggcacacgaggttaccacttgctaggtatcttcaatctgtcgttaggcacacatccggagtcctgactgatactgaaattttaaaaaaaaggtacatgaggttataacataaactttggtatcctttcgaatgataagttgataaccggttgaatcaacgctactgcatgttagcccttcatgggttttcagtttggaaattgctatgcattctacccaaatgtacaaccagcatacccctagtgtatgttaaggcacagctattgcttgtctggctcgcatggtaagaagcctgagcacggtgaatggtggatgtggcattgtcagatgtaagctgtatgatccagtcatattatagcacgattctttcagttatttgatggttttcatcaaatattattccaactagtaataagtcctttttttcaaacacagtataaatgcatgcgctcaaaatgcgcgtacactcatccatataaatgcatacaaacacaccctattcctatgagcatatccggaaaactggatcgatatattttaagattgacgaagtaaccacggacatctcgttatcgacggtacgtcacctatcactaaatgaataattagccgtaatgcagactagccttgactgcacgcacgtatgggttcgaagcatcccgtgcaaagggaggtgccgtcggtgcagccgtgcagggggagggcaaaggatcgttgcgaatgtgcaactgccgaccagtggcatgtgtgtgggggcggagtcgccggccgaaacgagcggaacttttttctggttcaacggcagttgattcattcatccctcctccagtccagtgtgttattttgggctaatagctgaatggcagaatgatccgaggtaagtaggaataaattattaaccattatatagcaaggtgagtatagcttaactgattatatttatttggtgaaatcagcccatctaatttaacacgaatgctcgcatttatggttatttatatatattttttggataggtgggatgtgcgtgtgcacccacattgtgagcgtcttagtttgcgctgtatatttttttaaaaaaataaatttcaaatagtgtttgagaaaattcatgtgtagaaagtttacaaaagttcacgcagtttgaagctcgggaaagcgcgtatatttttattccgttccggagaaaatgaacactcccggtcacatgtgtaggctctccgcgaaataaaaagtaacatgtctaggtgatgccgtgcacatgactaaggtagacgatcaacatgcacacacaacacatgggattcggatcaaatgcagtagtagtatggattgcaacttaaacagttgtagctggtacgttgcatctaaatccaacggtaagtattaggtcggtcactgaagcaaaagtaccaaaccataaaatattgttcagggtactgtagcgcgagtactgtagcagttgatttaaactgtttatcacaaaaatgaatggctgaaaatgcatccagtcctaagaattacgtctgcacccgatctcaatcccaacacatgcgggggtccatcgttgtctgcacaagatgataatctgcggtcaagggaaagctgataaacactgctccgtctctgacaccaaggttagattgatgatactcctacagattgttcgccatcatataatttcagatcaaaggcgttctctgtccactttgcagcatccaaatcaaccacaaaatttccaacctgacaaagaaggaggttcattacaccactgattccttgccatttcggttaatgacaagtgaacagtgtggaatgtggttgccagcaatgccatgagatcggtgcatgaatcttcttggctttcttctgatcttcataagatcgatcaccggcgatcgattgatctggagcaaattgtttttaaattcgtcaggaacacgcttcaatttgggggcggtttcgctgccacatcaacgtcaaaagtaactgattaggagatgggcaacgcactttgctttaattctgcaacacatgccatagaatcattcatccagtagcttcgcaataactagccagatcatatcaccgactgtgcgcgccgactggttggcacatactaatcctatatcgttctaatatataagaacttatccaaatacgttgtacaattatgttcttgattcttatattttgaaacggaggtaataagtttgtgtgaaattgcaaaatacaagtagttcgaattatgtttgattcgactgcaaatctgtattaagatgacacattgcatcaatgtacaaatctgacgatgacagattattgtcgggcacagagcgtagtactagtaataagaaccatagtttaacaatactcaggcagagctcatattgaattcactaaattcaaaaacatttgatgctgcattgtacggagtactacacagtggcagccattgaatttgaaatcaagtccattattacctcctgtggctatttttaattacacgcatattactcctgtcggccaaaatagccatgattaggggtgccgaattcacaagtctaaggagcgatcgtaccaagagcttatcatggcgtcgg

SEQ ID NO: 6756 - DNA, 5950 bp, Oryza sativa
  unsure (1)..(5950): unsure at all n locations
acggtgcnnatgagnncccagtagaagcgcctggccancgacnnnnnnnnnnnnnnnnnnnnnnnnnnnnnnnnnnngggagagcaccggcgaccagtggtggtacgcgtcgccgatcgactgggcggcggcggacggccactacgacatcgtccggcagctgctgcacctcgacccgaacctcctcatcaagctcacctcgctccgccggatccgcaggctcgaggcgctctgggacgacgacgcgcgcttcgccggcgcggcggggcaccgcgcgggcgtcgcccggagcctcctgctggagtgcgagtgcagcaagaacgggggcgccgccgccgccgccgagaacacgctgctccgggcggggtacggcgggtggctgctctactcggcggcgtcggcgggggacatggcgttcgtgcaggagctcatggagagggaccccttgctggtgttcggcgagggcgagtacggcgtcacggacatgttctacgccgccgcgaggggcgggaacgccgaggtgttcaggctgctgctggaccacgccatgtcgccgaggtgctcgacgaattgccccaacggcggggaaggcgcgcgcggcggtggcggtggccgctcctcggtgttccggctggagatgatgagcagggcggtccacgccgccgcgaggggcggcagcgtggagatgctgagggagctcatcgagcgccgctccgacgtgtcggagtatctcgacttccgtggatccaccgtgctgcatgctgctgcagggagagggcagctagaggtgaggcatctacttcttggccattgcttacttcactacttctgcaaaatgcaccatagtgaacttctgtttgtgccaatatgcatggatgacaaggtagatgcccatttcatcaggatgtttgggtgaaaatatttctaaactcgatatctttcaacgttatgaaaccaattttgccttttgatgcgctgcaggttcttacccggtaatcgatttcaacataaatattaaggaacaaattattttcattcgtcctatgtgatgattagtttgagcttggaaggatattgttcagctagaatgctgcgtgtaacccaaggagacattgagatatgtagatagttgtcattaaagaacattttttttatcttatataataagcataccacgcccagatgataaaggctcatttagttaatatcgtcatgctcaactctccagtgtattatgaaccaaagaataattataaagaccatactgatttggcctctttgacatggacttcaagttgtgcaattcatgaccagattttctttaggaattttagttagaagcaacaaaagctccaatcattgatctctctccaataattcgagttgaaaagtggatgtactccttgtcgatccagtttagatgggggtaaaatcacactttttagatatatacggttcctttctgtctcttgatgttgatattcagccaactttctttctgtttcttgatgctgatattcagccaatatttcttgccacaaatcattgtaatgttaggtgtgcaaagctccagttatatgcaaactagaatggaagtttccttctcccagtattatgcccttatgtatgtaaaacatacctcttgcaggttgtcaagtaccttatggccactttcgacattgtcgattcgactgataatcaagggaacacggcattacatgtagcggcctaccgagggcatctgcctgttgtagaggcattggttgctgcatctccatcaaccatttcagctgtcaacagagctggtgatactttccttcattcagcaattgcaggtttcagaaccccaggcttccgacggcttgaccgccaaatggagcttatgagacacctgatacgtggaagaacatcaaatatccaaaagattatcaacctgaagaatgatgcaggcctcacagtccttcacatggctgtggttggttgtgttcatccagacctcgtcgaactcctgatgacaaccccatcgatcgacctcaatgctgaagatgccaatggcatgactcnnnnnnnnnnnnnnnnnnnnnnnnnnnnctcttcaacatctgacaagctcatcaggcagatagtttccgcaggaggggtgctgaattcgactgttctgcgaactcggtcagcgatcgtttcgcagataaagatgcagggagggattgcaagcagccccggtacaactttcaagatatcagatgcagagatcttcctctactccgggatcggaaccgcggagtcccgacgccctagctcatgctctagcaatggcaagtgtgaccatgcccatcatggagatgcaaaatgcggaaatgctgaaaaccatggatcttcagagaagaggctgagctctgccagccgtgccaaggaccgtctcaagctgatgctgaaatggcctcgtcagaagatgtccagaggacacaagaaatccgacgatggcgacgccatggattccatcaagaagctgagcgagcaggccgtcgagaccccggccccgctcaggcagacattcaccaagacgacggcgctgaacacaagaggaccctcgcggtgaagacctcgactcccagctcggccaccaagaagaagctcaacagcaagctcatccacggcatcatggaggccatgccgcacctggcgtcctcgtctccggcgtccgccttcccgaggtcctccaccccgccgccgccgcagtcgggcaagatgaagggcgtctgcctggaactggacgacgagaactcgatgacgacgccggtgttcggcaagctgaaggacatcgtgctgaacaacgacgacgatgatgacgccatgggcgagccgtcgagctcggggtcgtccgtgaacgacgacgcgtcggcggagatgccggcgcggcggcacgggtgcggcaacgggaggctgatcaacatctgcttcggcgcgcagggcctcaccgtggaggactcggccagcgggcagcagaccagcaagatgttcaagcagcagtgcctcagggtgtcctgactcccgagtgactcacacgcgcacacggtataattagcctgcttttctttggttttctgactcgaattgagcttgcagttcaacggaacatatatggtttctgcatgttgaactcgtcgggcttgtgtggattttgttggctgctgcgtgtaaccgtatccttgcgtggcgtgcttggtttctggttgggcttgtgttaacgccttaacggcttacttcgatgcaaatatatttggtgaatgtatcagctagttgtggtgagttagtcgatcgttttgtttaatttaaacaaacaaacagcagttattcacgtttccggaagaatccctgcacaaaacggaatgaggaaagacaagaaatatcttgtgtattgagaatattgaacatccacaacaaacagtcgacaaacatctgacaggagacaacaaattgcgctaaaagacgcatgaattttctttttttttccctgtaaacaagaaaagcagaagctttttcctatttgcccatatgcccagcaaacaactatcgcttcctccactacatcaaaattcgaatttacagcaggaagcaattggacaaaccgaaaactagagaacgaacgaacgaaaaatctataagccgctgggcaacaccttttgccgctgggagctttagcacctggatcactaattcactatgtgcaaagaaccatttggtcctctcattgcttacccaccttgcggcctggccatggcacttcaaagatggctacatacatacacccgacaacagctcggagtaccgcaagtcgcggccattatggctgtgccgtcctccaagcacatatgatgatttgtagggcaggttaccgcgatactccaggcgcataatttacgacatccagcagcatcaaaattgagggccttgttcgagctagtttggaagcagaaggaaggagcgtctaccatatgcacagctaattcagcaactagcccacaagcactgggactagttgatctctccttcctctgcatctttagtgctggggacactgctaggatcttcttcctcttcctcctcatctgctttcatgaagagtcccagctgttccaatggattgcctgatccaggaagaaaactgggcatgccatcctgggaatgctcaggactagtctcatcaacagaactcacaatatgttctgtggttgccgttccaagcatttccaaatcctttagatgaaggttgtcattgatttccaccgttctctccatgtgcattaagttaaaccactcaaattttagcgggaaaaaaaaaagctcgacaccagtaaatgcagtttttttcactagcctcctgcagggcctggcgagctttctccctctcaaggtcccgtttacgcttggcttcagcttcagcttcagctcttcgagcttccatagctgcatttccttcagccaacagccttgctttctctgaatacatagataaggcacttctcagggaaaatgtaagaaccatcatttaagagtaaacttcaggtggatatgcctgttaccttccttctggagcttttccagctcctcctgtttgtctccaccctgagctcaccaaatgttcgttccatgtcagaagcagcgcaacaaaagtgaacaaacaaaaccactcgatgaaactaatcacaaacctggctgagaatcccctgtgccttaacaatcacatcagcataacgactcctaaggagggctgctcttaagagcttgtctggggagacttgcctgtcgggttttgaattctcccctaaagtttcatagggaaaggatcagatgatccaatcagcttaatgcactgagaccccttaatggcctcatatgtactgcttgcaaattcatgcttaccctctggggcaggctttgactcgttatcctgctcacggagctccacatcatcagcaggacctgtgattttgaaagttgtaagagcattaagccaaaagctcatccaactgccacatgaaactacaaacttgtgctgctgtgacgattaaggtgcattttgatttctaaaggtaatttttttgtagattttaacccaaaacttggtcaaactacaattacatttagtgcataaaacataccaatagatttatatttcaaagagttctcacactgatattatgcaggtgcttattgttgaatactttttcaaatcaaaataagccttaagaagacgtggggaggtagtagaacagaaagggcacaggaatcttacggatggcatcgactggacttataacatcactcttttcttgctccaccagttgttcagatctcttacttccctaaattatatagatgacaactatttcagtgcaataacacggaagaaaaggaaaagttgtttcgatgagaagaaaaaagcaaccttgacaaaatgattaagagggatagatatcacattcaaaattgagcctaaatttctcaaagtaccacagtaatagattatttaaacgaacatgtctgtttctgaccaaattagacaataagggtatattaaattaatatgagagtcagcttatacagtatgcaagggctgatgtctgattatagatgcatagcaattaaacccggccaaaaaaaaaatttcaaaatttttttttaaccccccatggcaaaaagcccaaataacctttgggttttctggggtaacaccctttttttttgggcctttaaatgtgaatgggcccgacaaaaaattttctattttgggataaaaatgtttggggggaccccttagacaaacttttttattaaaggaagggttttttaccacagggggcctagcaaaaatttctaacaagagacaaatttctcccaacatttttggcacaccaaaaaacaaaatgatggctgtgtttggttttcn

SEQ ID NO: 6757 - DNA, 2383 bp, Oryza sativa
  unsure (1)..(2383): unsure at all n locations
cccccagaagatcaaagaaagagggaatattgttgaatgcatgagcatgcatactgactagtgggcatctaatggtacagatgcacctacagtgaagtataattgtgcgtacttcttgttcagtgcctcgttagctaaactcaactaaacatctactcaaaagtaattagcttcaagcttaaacgtcacagaagttaatataatgaaatacacaagtgtttgaagtaaccagatcattcttgcaaaaacatatttgtttacaaggacatatatcatactaaagagagtatgtaagcacagaggagcacagaccgctggaagaagatccagagtcactgctggaactacttgggctaccacacttgttaggattgttgtgtgcatctttttctatcaatataggggatgcattcccgcaaatatctacatcctcctcaactggatcaccacctgcagagaaaaagaagttgtaagagtactgtgatgttgcataaaactaagcattagcaaaggaccagggaaaaaaacctttgcagggatttgtagaggagtggctaaggccagatacattagcagcctcattctcagaaggctcagattttgcctgctggctctgctctctctcttgcaaatacttgtcaacatgtttcttcaactcgaatagtaggtcatcactgacagcatggatatcaatctctatctctccatcaccaagctgatctgtgttgttgtcaatgcattgctgcaacaaatcaatgatgtgtgaaggtacctccggatcctcagacaaagatgccaaacagttcccaaatgattctttctcctcgaatgtcatttttggctttacagactctgttggtctaacagactctgttggcctcacacactctgttgacacctcactgcagtccacagggggagtcttcctcctctttgagtcagccctgtcaacctcgacgtgcgcctctgtggcaatggaagccagcttcttttcaattgtcctccatcttgattcaaacatcttgtttagttgaatggcataatcatgcactacatgcccacgaggattgtaagtcatcgcatttgaaaaggtcagccgtacatcggctgcaaattcagatggactcgtgtaggaaccagagtcaagcttattcctgatagttccaagatccatcggtttcttgatgatttgaaaataatctggaatattcagcttaacagcatcaaccggggagtcgaatatgttactacatttctgagtcatcagctttttcagaatagcatcgcattgcttaaaaatcgcatcctcagtcaacaccgtggaagcctcaggtcggggctttgtaggcaagaaacgccccttggcaccacggaccacatggttaccacgctgtcccttcttacctcgaggggcagccgaggacgagagcgcgggagctctattgacagggacagggacagcaaactccggcttcttgaggagattccggaccgaatcaagctctgtgcggaacctcttccggagatgcctcctctcggaggaggacatcttggctgggacgaaaatctcccgcttgacatcgaagccgtcgctgtttaggctgatgcacttgcgcttgggggccgaagagtcctcggagtcaacacgaacggggctgcctgccgcgccctccgactcgccaacggtctccgcgtaaccccgtggcgccgctgacgccatgccccggaacgccatttcatcgtagccccgcttaatctgcctctgctgcccaaactccatgaggaccgtcggtgtcatgtgcccgggcgccagatctgttcaccattgacaaccataagagacccaagattcagtcacgcggaagggaaacttgaacttagcggaatcaaatgccaaatttgaacttcccgtacagcttgatgtaagagaacaacagaaacacaaaacgtattcaaaaagttccctccaaaaaccctaatcccacacctagacctaattcgaattcgaaccccaccccccgccacgcacgaatccgacaccgcgacccccgaatcctccaattcgcgcccagaacctaacggcacgcgaaaccgaagaaaccccaagagaaaaacatccccgaaaattcgaaacggagacggggggtcgcgagaacctgaagaagccggatctgaagagggcgaaaccctaggccggggatccgcggcggacggcggcctcctcctcccgtgcggccgccggcgagccggatctgctccggagacgggcggatctgagggtcgcgaggtggccgccggctcgagacgcctccccgccttatcctctggggtccgaattcccatctncanngcgaggngccagcgccatcggtttccagctctt

SEQ ID NO: 6758 - DNA, 9134 bp, Oryza sativa
agtagatctcgcgggagttagagtgtgttaatgagcgaggagcatagccattaagggtaatacggcgtcagtgtcaggttcaactgcccaggcattaaaagactgatatcgaggtttggaaaaataagtgcccaatggaaacccaaactagactgttttagggttgattgaaagaactaggacagattagagggaaacgatcagtaaaaaaagggacatccctggtgaaggcgtcttaatagctagtgggggggaatgaggtgttgttcgttgaataggtctatcaaacggacgtccaggacagagacctccacccatagtacgcccaaccacagcttcttcaaaaggtagaaaacactaagagatttatatagagtaaagccgccactccgcctccgtcgccgaagagggagagagagagggagaaggaagaagggatagacttacatgccgcacgcacggacggctccctcgagctctggctcctctcccacggcgccgccggcgcttacgccctcccgcccacggttgccactccacttccgccgccaccgctggccctcgctcgccgaagaggagaggggtaagggacagagggagagggaggaggaagaaaggatagacccagtgggccccacatttttttcccgaatgacgaagaggtcccacatgtacgtttttagttctaatgctacataagcaccacgtcaacggcacaccaggtcaacactgccacatagacgccacgtcactaaaaccactctcagaaaccgctgagggagtcaagttgcactggttttaatagttgagggagtcaagatatctggttttgtggttcagggttatagattagattcgggtcactattaaggaagttaaagtggacttattccttttgtataggacgtaagtatggttgctaaggccctaaaaagcgactcttttgtggtcgtagcagcccagtatagtttaatttgagacctatgtgttctacttctaagagcaccaataagagatttgctaaattctatcccaaaattctgaatttggaatcctaaacggaatgatgtaggaagaaaattctctccaagagattaagtaaaattaattccctaaaaccaaaagtgggccccatgccaaactactaacacgagacagtttatttaccttcctcacgcgtgattgtgagttccggatcacggttgtgcgctcacggtaataagatcatgtgtctcgatgtatgtcgccgttgttcgctcgttcccaacccttgctgcccaccatccgttccctccctaaccctagcatgtcattgtctcctccctcccaattctagttgttgctcatttctcacgactttagtgtacgtcgccatgacactacgagccacaatcgcctggtgtgggcgccaagaactgaggggatcatttttgtgtgggcatgggaacaagatgacactggtgggagttagagattgggaagtgtgcgcgtgaaaaatgatggagcaaaatctaggagagagaaaaaaacacaccctaagtgtcagggttacagataaggcatacttcatatcctacgacttatgtagtacacggatatggtatactttcacgtatacgaatcgttcctatatacgctgttggaatctgttataaattatgggaattatctccacgagacaggtgatttccaaagtcctactcgaaagggatcgagtttctgttataccgtgcaagatccgatgtctccgagtctaacttgggataaaaatgacccccgatataaaagggaccccaaggaggggtgcaaggcatcatatctcatcgccaacacacccactgtagtttacgaagtcagagtacgcgaagccaagtcgccgggagatcttgtcgaatacatcgactacgatctttctacttttgttgtaatacgtggttttccatcatcaatctcatataaaaactggactagggctattaacctgacaaggggcctgaaccagtataatccttatcttttgtttgcttgatgtcgtattgcgtagatcatcgttccaatgtaccctagtacccaaatcatctggtctacaagtatcactcgtcgatactaaggtgtcttatgatgggtgagtatcttttacaaaatggtactatcattacaatcactgacacgtaggttccacttttctattgtcatccacgtcaatggctttgtttggatcctccaggctattaaatagccctccggaatcttactatttatgagtattaaacgtagattactaacaaaacccattccataacccctgaactattttgcgagacgaatctaacgaggtatattaatccatgatcaaactattttgtgagacgaatctaacgagatatattaatccatgatttattttgcgagacgaatctaacgaggtatattaaatattaatatacctcgttaaattcgtctcacaaaatagaccaggggttatgacgctataccctccgttacaaaataagactttctaacaatcaaaatttatttatctgagagtatacctatttcttcacttactcatcttaaacaattgcaatgaatgctcatttcatttctccaactaatcacattcatctcattcatctcttgtttagtttcacgtataccaaccccgtgaaaggctttacgagtacttatactttgagagaaagaggatgctaatttccaagataaaaataataacaagatgataatgtcaatgtgtcggttagcttatgcttaccgaacgatgccaggtatacacacagtaatgcccagatttttctcaccagcacacatcagatctagtgacataccaaacgaacagtaaaaaagacatcaataaactgctgcatacagcagcggtttccactcagcgtgtacttgcgcactagcgcgctcattgggcctcacaagtactacatggaaacacgcggcgtgcgtgcgtccatgagtccatccacgcgcgacgagctgtgtttgtgcttgtgcccaaacattcgagcacagagcagccaatcccttcccttcgcatgcgtgcccaaaaaagttgcacttgtcacgtggggcgatggggtgtcgcgcgcctcgccgccttggattctagccacgcagcgggggaacaaaaccacatgctgggcttagcttagctcccatatgcgcacagcagcacagctcgtgctaaccgacgacggcacacagtagcctcacatgagtcgctcgcggcccaaaagcacacccccaacacaaccacacgcactacctacctgcacccgttcgtgcacgagaaacaggggcaggaaggatggccgttagatctctacttccagcggccaagaatctcctgtgacgccgcaaagaaaacgaatgaaacaaccgaaagtaacttgttcttaacgatttaaaaactaatattaaaaaaaataaaccacgctaaaaaattattgaaataaactttaatatgaagttcaaattttgaatttcaattatggctgataagctactagaggctggagcgatgtagaatgcgaactggatgggagggtgaaaatgatgagcggggattgcgatttttttacttactttttttaacttaaaatcaataatatgtggaaccgctattcagaaaggtcatatgttagtgatcacgttaaaagaaaaagtaaataatacttcctccgtttcacaatgtaagtcattctagcatttctctcacatttatattgatgttaatgaatctggatagatatatatgtctatattcattaacatcaatataaatgtggaaaatgctaaaatgatttacattgtgaaacggaaggagtagaatcctgttgcgatgagcggtgcatcgtcgtggggagaacgtgtggctcgttgatgatcggcggtgccatgttttcagggaccgagcggcaacttttgtgctgatagcgtgcgtcctgccgggcgggcgtgcgtcgttatgtgagggcaaggccgcttatatgctgccgcaattaatcggaagaagctgaccggtgccggccctgaggacgtccacggtgcagacgtgcacacacagtacagtctccgcttgttacagtgaccgccaatcatgagctcaacactctctattcccttcctgattgctgacagctgcagctgacttccttccagctatagcagcagcagtagctgccgtcacttcgccaccacagtgttctcatctccctttcatatcccctgcttcctctccgtccatggaggaggtggcagtagcagctggcatcctcctcctctgatctcctcctcggtcacttcagtgcttacttgccggtgatgaggaggtcttctcaggggaagagctccagcggcggcggcgttggcggcgtacggaggtatgacgtgcacggtggtggtaacttgctggcctgctacgcgaaggcggcgaggccgaggccgtccaagtgggacgacgcgcagaagtggctctcccgggcgggcgacgacgactgcggcggcgaagctacccggcggaggagctcctgcgccagcgccgacgacgggctgctgctgcctcctccgccggcggcgcggaagggggccggcggctggcgatcgtggagcaacgtggaatgggagggcgcgcccgcggcgatggcgccggcgctgaaggccgcgcgcggcgactagggggtggacaccaaggtggtggacgccgtgcaggcgtacgtgccgcagcggtgcgtggtgtcgctgagggacgtcggcacggagatgacgcccggcgggagcaaggagccgtcgagggcgaacactccccgcgtcgtcgcgccggcggcgaccgcccgtgtcgtcgcgcggggcacggcttcgcctgggcaatgcgacggcgggtcgcgtgacagcgccgtcgccggcggcgtggtggatctccgggcggctcgcaagcgcgccgatcaggggcacgacgaagtcgcgggcacgatcacggccgtgtcgcccgcgacggcgtggggcgacgcggagcgcgccaagtacatggccaggtgaccgatcgcgttccctgctgctcatcaattttctttcatcttatcgatattaacatcaatataaatataagaaatactagaataacttatattgggaaagggggaagcagttctttgcttgttatccgtctaaaaccagcaaattcgactaaaaatttagttgctcatctcctctctaaatccatggttaaaatcggtttgaactacgaaatcctgctgcaaaaatgcgctaaagctgtgctctgcatgtgcagtcaacagtgcgcagcattttctttcgttagcattttcttttgtcggacagcaccacatcagtgctgaactgtcagctagaagcactgagacaatgacatcctctgaaagcctgaaaccaaaagcaagcagctaccaccactatacttgtctactcacgtttgcatcgtgtgccattgccattttcgctttgtcaggtacaggcgcgaggagatgagaatccaggcgtgggagaaccgggagcggcggaaggcggagctgcagatgcggacggcggaggagaaggccgagcggatgaggctgcgcgcgcaggcgaggacggcggggaagctggcgacggcgcaggcggaggccaaggcgcggcgcgcgcgcgccgaggccgagctggcgctgggccgcccgggaggcggtgccaagggttggctgctcacgcggagcgcgagctggagcagcggcagcggccgctcgccctcctctctctcgctccggttgccgctgctgtgccgctgagaaaaatccactgccacagtcaaaaggctcgtgatcgatctgagagtttccgctgcttgttgaaggcggtttctgatgtactactagtaccaggcacagaagaattttatctttgtaccatcaatgaagacccgtttagtttcccaaaagtttttcctaaaaacatcacatcaaatttttagacacatacatggagcattaaatatagattaaaagaaaaactaattgcacagttatggaggaaatcacgagacgaattttttgagtctaattaatccataattagccataagtgctacagtaacccacatatgctaatgacggattaattaggcttaaaagattcgtgtcgcggtttctagacgagttatgaaattagttttttcattcgtgtccgaaaatcccttccaacatccgattaaacatccgatatgacacctaaaaatttttatttcacgaactaaacagtcccgaaatataatcttgttacacgaataaatcagattgttttattgtactattcggcatcaatcacggcatgttatggtccgtgccatttttcaattcaagcatgtggtatgtagttggactctttgaccaacctgtcaggtcggccactaccagtccatttccactctcggcgtcggggccccacctgtcatggacccgaatccccccgcgccgcgtacgcgaaggtcggtgggaaaccggcagagcaaaccgcacgataagaacgcggccgacgtggaccacgtggtgcgcggacgctctgcgtgcccgacttggctttctcctcctctctcctcccgcaacccgcgcacgattcggttccccctctcctagcggccgcctcttcccccctcgaatcccgataagcagaggcggaattctccaccgcggcagcaacatgcaacccccagttcgattcggctgcgaggtgaggtcgtccgattcccaattcggtcggaatcacgcccaattttttgtctctactagggtttggtttcggtctgaggatttctagtttggtggagaatcgaggtccgatcccccaaccgggtcggaatcacgcccaatttttgtctctatagggtttggtttcggtccgaggatttctagtttggtggagaattacctctgggattttacggattcgacgtcggttgctagggtttgtgaggggagcgattcatggctgcggggagccacggggggtacaggggctacgaggtggcgagggagcgggagcacgacgtgggggtctctaggaggagcaaggagcactaccaccaccgccacccgagccgccaccgcgactcggaacgccgccgtgacggcgggcgcagcggtggccgggagctgtcgaatgggtacagccaccgccgggattcgccgcgtccaccaccgaggaggcgtccatcggaagggaggacggaggacagggagcccggcgaggtctcaggtgggagtggctcagagaggtccggtgagcgcccaatgaagaccggggagccgagggagaatggtgtcacgcgagtcagcaaggaggaggcgaagatgtccccgagtaagaagaggaagcaatctccagtaatttgggacaggaatggttcaaagcggcaggctcgagaccctgtgaggggcattagagaggtagatgctgtagttgctgagattattatgcatcagtcgcattccttgcctgtcatgagctcactgtctagcataggcgatggacactcgccaatgattttggatgtgtcagttgataaggtacaggagtatgagaagaacaggattgtggatgaggaggaagagggatacccaacaatgagaaacattctgacctcaagatgggcagatgctggcgacgaggaggaaaatgtgtttgtgcccaagaaaaagaagagcgtgtcacctgtcgactcgattgaacgagggtccacaaaaaaggttacaagccctgagtctggagaggtgctggtgtataactcagtgagaagctcctcaaggtcatctgactcgggggtattacagggtagtgcaaaccgggaccttgaagtggagaagggtgacaacatagatgttgaggaggcggctgatgatgattatcctgctggtcatttgctggattctgattttgaaggtgaggactgtaggtctgaaacccctgagtgtacacggtccccacgtaggtgcattaacatgcttcaaggttgtaggagcgttgatgagtttgaaagactcaacacaatcaatgagggtacatatggagttgtatttagggtgagggataagagaactggtgagattgttgcgctgaagaaggtcaagatggagaaggaaagggaaggtttcccactgacttctcttagggaaatgaatatcttgttatccttccaccacccttcgattgtggaagtcaaggaagtagttgttggtagtaatgacagagatattttcatggtgatggagtacatggaacatgatcttaagggtgttatggagacaatgaaacaaccgtatagtcaaagtgaggtcaaatgcttgatgcttcagctattagaaggtgtgaagtatcttcatgacaattgggtacttcataggtaatgattgttaatcactaatttttcttctcctttacacattttctggaattggttttgatgttagattctaataattatgctgttccatagggatctcaagacatctaatcttctcttgaacaaccgcggtgagttgaaaatatgtgattttggactctctcgtcaatatggcagcccgttaaagccttacacccagttggttgtgactttgtggtacaggtaagtcattagacagtctatagtttcatacaatcagtctaactcaaaatttaacttatccatggtcttattacatgctccttatgactgcagggctccagaattacttttaggtgcaaaggattattctactgctattgatatgtggtcattgggttgcattatgggagaactcttatcaaaagggccactgttcaatgggaaaagcgagatagatcaacttgataaggtatatggttttgacttttgtctattccatatctttattttgattaaggaaatcttatgatgaagtgatttccattgcagatatttagaacacttggcacgcctgatgagaatatatggcctggttattctaagttgcctggtgccaccgtcaaatttggcaaacaaacgtaagtgccaactcaattcttggttctgctgcgttaattaattggaacatgcagcttctgtatcatataaagccttaccactt

SEQ ID NO: 6759 - DNA, 4497 bp, Oryza sativa
  unsure (1)..(4497): unsure at all n locations
agtgttnangatgacgactgtcnctggaaannnacnnnnnnnnnnnnnnnnnnnnnnnnnnnnnnnctggtgggccgatgttgtcagaagctggatttgatctgctaaatagattactgacatatgaccctgagaaggtaatacacttaatagagtgatccatctgattcttgtatcttcattttgtagctgactgaacatggttttttcatacagcgtatatcagcagaagatgccttgaatcatgaatggtttcgcgaactacctctgcctagatcaaaggatttcatgccaacatttcctgctctaaatgagcaagacaggtacgagtgattttgctttttacttctaatttatcatcctaattctgaaattggcgttttatgtggtttgtaatgttgtatttgcaaaacatgcaggcgcttcaagaaacatatgaagagccctgatcctctggaagaacaacggatgaaagaacaagggaacaatggagatcgtggcctttttggctaatcttgaaccatcactataggtctgctgtggatgctaattttcagcgtggaatcaatggaagtacatgtcttccaaggtgagatatccactggaatgaagtatctgtcttcttggtgcctgcgacaactgatggcgttctttagcaggcatatgaagggggataacatgtctccttatggtccatgctagctattatatcattgcagggttactgggttagctctttctcagacttctggtcacaatctaattcacctgcattataaggtgtgcagatctaacccacctgcatgatctggcctattaacttctatctggtgcaccagttttgcttctgaaatttctgactgtaaagtaccttagtttggtactttgtaaacaatgatcaacaggacctttttttttctgtgcaatgagcacattttcttttgatcttcgcattttgtttgcaagagatggatggagcaaaagagggagggtgcattatgctttttgacgaggaaactggtacatagtaatgcaaaatgtaaggtaatatgctgaggcttattgtgtccactgatgtggtgtataaaaatgaaatgtatctttaatcttttttactgtactttgcaagatcacttcagttgctccctgaagctgcttgaaaactagctaatttatgtaactggtcattataaaaatgatcctccactttctgaaaggaaacaatacctgtcagatttttcaatatcacttgcgtgctacaatgatgtattactgactctatctacttctaatcttgtgtaatagaagaaccaatcaatttaatatcatttgcttgctacaatgatttatcagacaataactgactcttgtctacttctaatcttgtacagtataatagaagaaatcaataatctaaggacgtacgattgtattaatttatctttggaccatttgtcttgcatcatttttttgtaacaagtgacagccaggaagagttctttgtttttatttatttatttatattttcttctaatgatctacctttttaatgataggccgctagacttttatcaaccaaatcattattcatgataatggtgaaagatgtgaaatgtttttaactctgaggtgctggcttttccctcatgaaaaggcaatactcactgatctttgattcattttgctatcctgttgccgtatgttcagttcaaatcatttgcttgtgctttacagatgattatagtgaaatcagtgattcttatgatgtccattcttgcacttatcataataaatctacatgtcatattgacttatcactaaagttcttgccagaccagttaatgatgttcctttatgctagtttgaacttgctggagagttgattgggttcactgtaaacaactaagtgttctgtgacacatctgcagcttaagctgtggctataccgagacaggaagcttgatggacgtatctaattgacttatttgtggaaggcttcgagtcttcatctgtgatctgttactgttgtgaattctagtggtcagtctgctatcttatttctcaatatattggtgatcagtatgcttcttgctagtagcttcttttgtagctgtacacctgtttttttttttcaatgacagatatattcttgacatgttatattttcagtcctgcccatccacatatgggggacatgattttagtacgagttaccagcctagatgtgtggatgaatcacgattttgggcaatccataatttcttgtatctccttgtgtccatgcctgcaagtacagctgtgtgttatcctgcagaacctttcgttcttttgttattctttttcaagtagaatcatgttgaagaattgcttgcatttgataaaataatattgagtctggattctgcaactggaaactcattgtagactggtagaaacaaggaaaactgtgcttttgtaattcatttccacaaatcatttactcttactcctacctttttcctttatgttttagtaagatgcagactgaccaagaacaacgttgaggcgcaggacttgtcatggttgtccagtattttcgaaggttgattctatcaattccgcctgccttttatatatatttacaattacccacattccttgccagttgacaccatgatcctactttttatcttctgctttacaatctttcagtgctgctttgctaattttctactgtgctactatcaaattgcatgctttactggcactattttcactaattatttctcttgcgcacctgtgaaaagtttgatgcccctgtggctaataacttttttagtgtcatgggttacttgttttaaacttataagtaaatattctattgagtgaaaggcttgaaaattttgtcaccaagatgcgaaccaccattaaatactcagcacagttaaggcttggaaaataaggttacatgtttagcatgacagtgcgtgaagtagagaaaaaagcgctgtcagcaattatgctttcctaaagcaaatcgatgtttctggtattcgaacttttagggcatacaaaacagtttttatagcaggcttttgggggtaccacctaagctcagttaatatcaactctctgtagactcttagcgccagataatagggaatttcctcgcatgaggctagataaaggaaagaagaataatgataaaaatattttggtggattcatggttagagcctctgttgtctcaattgttataagaggatagtctctaagatgatgtgtattaccaaggaacccatactaggctcaactgttgtacttgccatactacctccgttgtaaataagtgcatttctggtttcctaagtcaaactatcctaattttaaccaaattcatagaaaaaacaatactccaataattactattcaaatgagcatcattagttccattgtgaaatatattcatagttttacttatttgacatggtagacattattactcttatctataaacttatgcatttgatttagtagaaaactacaaacgcacttattttaggatggaggtagtagtagtttgtctaaatgagaaacgtatccatgacagtcacactcacacactttactccatttccttaatacaaagaacaatcttacaaccatgcttggttctaccagtatcaacactctattcttcttgtcgtgtcatggatctgcactgcatcttttctaatgtctttgcattcacttgttttaactgtccctttgtttgtgtcccctgcaaacctcgtgcaaagcgacaatgggccatactccgagttgcagaggcaacaagttctctacgtctcctatcgtatgtctgaccattttgtaggagcggagttcagggacctttgtcaaggcaggcggccggatttcttgtttccggtgctgcaatatgctcaggcgcgttccttttttcttttttttttggagaacttagccactaggtaaaggttgtaaaatgccgtagcatctgttctctgtaaatacgactgggtgaatacagtgaattggtatgtttcactttcgtcgatttgttggtttgaaccgtgtctgaagttcacaaatctgtacactatcatgctgcatcagtcgaatctctgggaaacggaatggtcatcagacgtcttttgagaatttgagatctccgagcactatgtataagatgtattagaacgtgtctttttttctgaacacgtacttgaattccaatcactatactttgtcatttcacaaacaaatatactagattgaaattgacgagaaacgcatccccagtttccctacggagaagtaccatccaaacaaccatgcgtatcgaggtctgacgatgcaaaacctgtggctttcagtttctactttcagtttccacagtccagtgctctctgcttaggtggccactggagggggtaccgaattccacaagtctanannggcgtnngttccaaagcgcacntatggnttaaaagaacgn

SEQ ID NO: 6760 - DNA, 1060 bp, Oryza sativa
  unsure (1)..(1060): unsure at all n locations
cctccatccacggcacgagcaacgcgcgcgtccacnggtcaacccggccgcgttgcacgcggttcatgtagtccggcgacgaccgctcgcggcgggccatctccatggcccgaaggctggcgtacaggtcggcgtcgtacgtccacgccgcgcaggcgcatctctcgcnggcgcagtagctcccgtccgtctcgtcgccagcagccgctccgcagggaccattggcggcgacggcggccgcgatctcccgaagcatagcctcgacgtcggcgtcggcatcatccagatagagataatccatggcgcgctctgggcgcggagctagcccgcgagctcggtgatgaattcttgaaagatggaaagagaggaagacaacgtgctcgctgcaaatttatagcgccccgaatatgatgatgaacccgttgactccgacatgatcactgcgatgcgacgagctcaagagtccgaattggagttgacctggcccgcaagtccgacttgatcccgtactgggccgagggatacggcctgtgggccggcctgctccggccttgggctgcagctagctgggccggcgactccgtggagaccatctccgggcaaggaatttttttcatttttaatttttttcttttaatatttacagaaataatctatcggcgcaaaaaattacaaaaatagaccctgccgccctagtggcgggcggcaagccgacgcggcagacagcgggtcgacggccccgtctgcagccggatggcaaattgcacctatcttaaaagctttttaacgaaattttcgagaaattagcatgggcaacctttttctaaaaaggtgtcttgagaacagaggacccctctctggattgtttttggggaaatgcatctgggaaaattggatcttattccccctcccttaattctatactctcttgtttcccaaaaaaacctacggcttcgtaaccgccctacccttccccgcatcggatacggcttattcctcctatcttaccctgatttgccctcaccccacactgccaactcctacatccttatacccaccc

SEQ ID NO: 6761 - DNA, 1500 bp, Oryza sativa
  unsure (1)..(1500): unsure at all n locations
nactcctggagttgactcgtggggtgatgaattgatttcttcagcttgacataaaatttgtcaaattttgagccttgtatttgtgtagcccccgactctttgattagttgggaaacaactgaacatagagtcgaaaactgtagcctcttgtcgtcgaatagttattgcttgattgaagatatgtgttgaagatttccaagtagaaatcatgaatgttggagagcctcttattgtagtaaaataacatggcatcgcatgccgagatgtcgaggcatgatgacaaagacgtcgtggttggtgaagtagtaaaacttgcgaagtagcagcaatagagtttgccagtgccgaagataataaagatgaagtcgctccaccatgatgacaaagttgcatcgccgtgatgaagtgaacacgagtcggcggcaacagaagcaaactggtagcgaagacgcgcagttgtgaagataaaagcactagtcggcggcggcataaccagtcggcaacggaagacgatgatgtccatcagtagtggtagctgtataaaccagacgtagaggcgagggcactagtcagcagcagacgagacgaaaggcgatgaagatggtaaggccaatcaacactggcagaatcatgcagccatggaagtgaagaaaccagtcggcagccatggcaaacgtaggcagcttgtgttgaagatactgatgcctataagtagtgacagcgatgtagccagccgtgaagaagatagcatcagttggcgttataacaggccagccgtgcaagcgatgacaccagtcagcggcggatgcggcggccggtcggtgaagacgtagacgcccaacaacggcagcataataggccagccgtgcaggcggaagtaccagtcggcggcggacgaggcggccggtcggtgaagacgtagacgcccaacaacggcagcatactaggccagccgtgcaggcggaaacaccagtcggcggcggacgaggcggccggtcggtgaagacgtagacgcccaacaacggcgacataaaggccagccgtgcaggcggggacaccagtcggcggcggcgaaggcaagccggtcggtgaagacgtagacgcccaacaacggcggcataataggccagccgtgcaagcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtaagacgttctgtctgatccattcctggagcgtaagagataagcttaaagccatgaatttatcaatactgactttatcaatttgtacatgtatttttgtcaaggattacgtggaaaatacaaaaaaatattgtgtgtttaaaataaaatatgaatgagccggtagaaatnnnnnnnnnnnnnnnnnnnnnnnnnnnnnnnnnnnntagtaggacnnatgnttcatnaacatt

SEQ ID NO: 6762 - DNA, 1379 bp, Oryza sativa
  unsure (1)..(1379): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacggcctaaagtcctggtttgataatattgtaaagtagatttaggaaccgattgccgtattggttaaggtttctatctggtattcctgcccccccccctatataaggtgggcaggaggccctctagggggcatgatgacacaaactagatcgtcagatctataatacacccggcggattcaaatccccaaacaggagtagggtattacctctcattgagagggcctgaacctgtctaaatcctttgtctccgcatccatccacttttaggtctcgtgcgctacccccttttattattgccgaattcatgtttcgacacctctatgacctaaatggtcttatgataaactaaacgtcttcgtcctaatctcgctgacgtctcaacgaacccataaacaagaactcaatattcagctcgctagtacggagtactacgctgtatataacagtaaattatacagaataatcaccattcatgtactaatgtattatgtactccgattagtgcatgaaccacatggctaagctgaccactgtgctcgcagatctaagcatgttcctgatgcacgtgttaggttctttctttttactgccacttgcccggagaatttttttcatttttaaatttttttcttttaatatttacagaaataatccatgggccgcaaanatnacaaaattgaancttgccgcctttacttgtaatgcaggttccttttaagatgccattgactgcttacacggcctccgcaccaagaaattttttttttggacag

SEQ ID NO: 6763 - DNA, 1115 bp, Oryza sativa
  unsure (1)..(1115): unsure at all n locations
cacaccattataaatattctctattnttttttttaaaggcctcatatcttgtttataaactctctatttattgttatnncccccncccccccccggcatgtgacactcctggaaccacgcnnnnnagatngaggaanncggnaccccagccccaactccccntaattattgactaatgttaaaccacataaaatattttagctagcaattcttatgaaactacgccacccatagtggaataagagacccttggctaccgattccaagagtgtagcaccattgcgcatagtatcctgctcctcttgtggtagcattgtagaccataagtggagccagtaggaagacatgaagataacctgcatagggttagataattgtttaccattaaaaactttatcattgcgacaacgccaaattgaccaacatacagcgctagctccaattagaatcatcttcttaatggacctagatacccctctaagccaattatcgaaaatgtttttggcgttacggggtggggggatattaaaaacaaaaaacacacatctccaaaaacaaactgagcaacatgacactcaaagaaaagatgttggattgtctcttgtgtatagcagaaagaacaatgtttgtctccgccccctccaattttcttttacccaggttatctttcgttagaaatactttcttgtgaagaaactacataaagaccttgatctccagtggaattttcaagtcccacagaattctctttttgatccgaacattacagttcatgatcgcgacatacatagatttgacggaaaattgaccattcttatagagcgaccatacaaagcagtccttttcatttgacagagttatattagctagcctgaggatcaaatcgttccactcgattagctagcctctcctttctatgtggaaaaagtacattgaaggtccctgacttgtcatcgagtatcaaatcatnccttacccgnaaatcagatatatgacactctcaactaccaaanccgccatttagaaccttagcagntttgtctcggttatttgcatggcggntggtaagggtggaccactgagcccatctttgatgccgtttttctcatatgacg

SEQ ID NO: 6764 - DNA, 1105 bp, Oryza sativa
  unsure (1)..(1105): unsure at all n locations
ccgncgnagagaagggttcgtcgacgggaagcggtcggaggccggcgagaaagaaggccctctcccggagcgcacgggagaatcgcgccttgactagcctcttcgcctccatcccactgctgcgcatgtcggcggcggcggcggcagcaggtcacgaaggcagcgaggatgaagtcggcggacgggaagtacggggaaaagcgcgncgncggcgctcggtggcgaagatgggcggcagctggggaagatggagcagccatcttgtggctctgggcctctggcgtagactcaccatgtgcatcagtttggtcatcttgttcgtctttgtttgatggtgatggatcatccccttcaatcaagtatccctcctcatttgtagtctcgtttattgagtagcccctttcagctggatcagcagtgccaagatttgctaaacctgacgctaggcctgaaataggagtatcagcagattcccctgtatccatagacagaatctcatcaccagtatcaaacaggccttctctaaccaaagaagaatagatgtcatgaggattggcatctgcactttgcaagcttgcaaaaagtcctgtctgttcagagttatcttcttgtgctgatcttccactcggtgcttcacttgtccctgtcagcgtaacttggtcctagaatttcagatttattaactgaaaatttgttgaatttcagtcattagctggatcatttgctaaatttcagtcattcattgaaacttttgctgaatttcagagtcaccaacttggcacaatctctgaaacttttgctgaatttcagattctttgactgaaacttctgtatctcttttgctcttttttagattcgtttactttggcgtcattttctctggaactttgcctagtgttagagtaactaacttgatagcgccatttttttttctggaactttatctgaaatactaacttcttgttgcatttacctggaacaaccaaacaggttacatatctcagccagtgaaattggaagctctgggcattccagcatacagatcattttctttggttgagctcgaagcggcgactaatgacttcaaagttaatggggagaggcc

SEQ ID NO: 6765 - DNA, 2012 bp, Oryza sativa
  unsure (1)..(2012): unsure at all n locations
ataaatataaagttgtacctatcttcactttcaatttagtattttatatatctatttacttctgaaattcaaaatcaataataattagcaagatataaagggcatcattgacatatcttcaccaatataaagggtgaaccctacgaaaccaggtaatagttattcttgttatcataatgtgtggataagttgtatctcacatttaagagaaatggctggattgagaagaaagaatggacgagagagagagagaggagagtattaatatttatttattgcttgtcgcctgttattagtgttactactaagatgatactactacctttttactacttagagtatctcacaaaggtaaactagataacaagcttccttactactcactttttgacatattgtgaatactctactgatagatcgttcttttaatcaaaaccacacaattcaataaataatcattgtattcactgtatgattaaatttagagtaaattttacaaaaatatgtatatactttgatcaaattatcacaaaactatatatttaataccaaatttatcacataactacatatttaagttggagtatcgtaaaactacaaatttaataataaagctatcataaaactacatgtttagagtcaatttagtcacaaaacttggatgtttataattgaaacataacattattagtgctaaggatttaaatcctaaaatatgtagttttgtgatacttcgctttgaccgtatagttaatgttgtgataaatttgttattaaattcgtagtgttttttgatacatcaccaattttgggataatttggcgaacgtatttatagttttgtgaaatttacttttaaaattataatattaataatccagaataaataaatagcgggtaaacttcccatgaatgcctaggaatgaaagtgaaaggcggctagctagccgacgacggtgtgtcctgcgtcgttgaccacctaccccccaaaagggtactactccgtactagtagttaagagtaacagtcgcggagaactgtcaacagtaaaatcatctcgaatgcaggaagcttcacagaaagcatctgttgctagctgtttcacttgtactaccgttctgtttttgcctctcaattctcacgtgaataatggaaaatttcgacgtcctcgcccgagcgccattgtacttagggcatccacaatgtgttgagaaaccaggtaataggcattcaatgctcctctacaacctggtaatagccattgtggaactagtaaataagtagtaccgggtagtatgcttactaccgatagcaagggaataaataatgttgtttacacaatcgagacagagagagtacaggatgaaagcatctttacttatgaatggttgagggttggagaatattttattggtggaccccaccttaaaatctcatacacattatgctgcctgcgtacaactactacctctgacccaaaacctgacactaatgctcacttcaattttatacattggtgttgccctcatgtcatctgcttcaacaaatggagaaaaataataaagaaaaaaaaaagcttcctctcacatttcgcacgagggaaaacaaaatcggctactccaagtcagctgcttcaacaaagggagaaaataattaaaaaaaacttcctttcactttcagtgatctaccattccaagcagtgatataatatggggaacgctaataggcgatcaatcgattggagtgatcgatccccattcccctgtacgctcctctccccttcctcatccccttcttctcttcctatacaccataaatttttaaaaaaataaaaaaaacaaagttgaaaaaaatatgtatagaaatactatattaaaaatatatttgaatttaaattcaaatttgaaacatgtatgcaaacttttgatttataaannnnnnnnnnnnnnnnnnnnnnnnnnnnnnnnnnnnnnnnnnnnnnnnnnnnnngagatacgatnttcatgggggcgg

SEQ ID NO: 6766 - DNA, 3344 bp, Oryza sativa
  unsure (1)..(3344): unsure at all n locations
gcgtgcattgaatgcgaatcgcttggaccnnacgccnnnnnnnnnnnnnnnnnnnnnnnnnnnncttgtaaaagtggcaaatagttaatatttgtgtggtactatgtggtaccagcccttgtacccacttgtatcacatgatacctacctagtaccactgtagtaccgaccaagtatcaatgggtattaattagctggtaccgacgagcatcagttggtgcctgataagtaccagccgatacccctagtacatataggataccagagtctgatactttatagatatcatcctgtctgaacaagatccatggtatagtagcccctataatatagttgcttgtggcaaactcataacaggtccaactctaaccacaacatgtgtaacttgcttacttgcagcatatatagtcttctttttattccaagatcaccaacattacagtgttctagacaggcgaagtagtaggagttcttttaaaaaaaatattacaaagctcctgataaaccggcatctagacagagcctgcattggtacatagcggctagaattttgaaagggttggaggtatccaaacgtagccatgggtctgcacgtagcccatcctcttgctcagctcgtcggcctctgggggtccccgggttcccggcttgtacggcagggccttcaccttgccgtcgtcgatgtcgtgcagcagcggagtgaagatctcccacgcagcctgaaaaccaacacggcgtcaggtattcattcagtcacaagcgagccgattgcaagtcacacagcgtcaattacacaaagcacaaaccttcagttcgtctcggcgaacaaagtgctgctgatcccctcttatcctgtcaaaaaaatggaagatgatatcatggttcatcctttatatatatataatggattaaaaacccggcctctacatccaacacggatagttcatcttggatatggcatgtgttgggaacaaggcgcaatgcaagtgaagaagttattagtgtagcagaaagaaatgggggaagaaggatggaacaggacgtacgtatccaggatgaggcgttcatacgcttctgggatcttcacgtcttggtagcgtagcccatatgacagatccagctcgctttgttcggttgccatttctagtccgggtttcttgacctgcaacagttcatgcactttgttcagacaacacttgtttttttggagttctcttcaggcaaagatgaatagacaattctgacatatcttcagataaatgggtttacagaagttgtacatacagttaatttcatatacatggcttccgatggctgcaaccgtataacgaattcattccttccttgcttcttgcctttatcagggtgaaataaaaacagagttttagacaccattggcagaagcaaaacaatagcagacagaactgtattgattcaaataggttacggatgtttaactacattcacagttatgtgaaatttctctagtctgctcatgagacaaaaatacgttttgttatcatgtaaaggtaccacacacgcacacattttaacttactgccagattcttgcgcctatagaaaacaataattagttatctgaaggagttaaacagaacaagtttttacttcataccaggtcttttggacagtattattaccaataagaaaatgacagctcacttccaaatctattaaacacaaacaggctgacaagcagggtcaacataagtcatagaaacagtgactcaaccaattagtaaggtgacccggcaaaaaccaatagtaaggtactcaggtcaaattgaaagtagggagcttatagcaattttagatactaaaatgtagcaaagtagcaaaccgtctcatgcttattcttgtctattttctaaaggaagtgttgcttatactaaggtgtcacatcataacccattataagaagtaactttttcataccaaagcactagcacatttttacattatttctcagtattatcaagaaggaatgtttagtactctctttagtgcttgcataatgcaacatcttatatttccaatagagttgtctgccgttatccattaactcttgacagagatattcagatttttcagtttgttttgggactagcattcagatattctaaatcaaataacttagtttcttaaaataggttgtgacttttgcaagatcagacttgatgacaagtttcacagcacatttggatacgagaaggtgtttagcgcatacatttaaaaatgtcaccaggagcatccttgaactgcacacgtatctctgctttcctattgttcagtgctttgccagccttgagaatgaaaggaactcctgcagcgcacgattattactatgttaactgcactgaaagataagataatggtaactggagggtcagaaatagatgtcaatgcagcttcattttttctaggacaatgtaggcatatggaaaatggaaatcttggaaccaaatgcccatgtttgatcaaagtgatgcagaacagctgaaactcttgtatcgaaaaaaggcagttcagttggaaaatgcagatatttgtttaaaagtgacttcaaaatactgtatatctgtatgttgtaaggtgtaacatataccttcccatctttcattgtttaccctcaatacaagagatgcaaaagtaggtgtgttggagtcatctggtaccgtagagtcatccttgtagccatcatattgcccaaggaccacctcatcatgctttataggtgtcactgactgaagaacctgacattgtggtataaaaacgcagaaggaagtattgtaagcaacgaaggatgacaaaaaaaaaaaaaaagatccatacaggtttcctactttcagttagagtagaattgtataaggagaagcaaaaaccttgactttttcatctcttatgtgctcaggcttaagagagacaggcttttccatagccaccaaacagaagacctgcagacaagagcgaaatcaatacagaaagggggcctcaagtcgtgaaagtggaaacagcaatattctcttttgaggaattataatgcatgacaggttgctgctctgcctcctcgtggtataacataagaatggtgatggaataaagcaccaatcattctgaatggtcaagtaaaatgttcagcagtccccacagaccacagtaagcaaatgctaatgtagattcacattgggaagtgaaagtgcacataaaactcccctagaaaaggcaagtgcatggaaaactatnnnnnnnnnnnnnnnnnnnnnnnnnnnnnnnnnnnnnnnnnnnnnnnnggngtgctagagtagtgtcacttnnanaccgcgt

SEQ ID NO: 6767 - DNA, 2673 bp, Oryza sativa
  unsure (1)..(2673): unsure at all n locations
ngatcaaagtaccctccacgtcctcaagtcccaaagtcctctctgaatacaatctgcagcatatattaattatgtccaagcacatgttgttcgcaccatgataatgataaaactttccagaatttccaaaactaatccattcaactttataccaataacagaggatgtcatagatgtaactacagttgacaaataaaaatacaaagggctacatagaaaagcatattacctgtacattagcaatgttatcacgattccaaagaggtaggaacaaacggtttgcaaagcgaagcacaagctgaaatatattgaaatatgttatagtagcatggaatatatcgttcaactaactagacgaagccatacaacttaccagattttggaccaattcttttcctaaatagtggtcaattctgtacagctgttgttcattaaacagctctccaagctgggcactgagttcctctgcagactccaagtccttcccaaagggcttttcaacaataacccttgtccagccagaatgagaagctgaaagcacaatatgacagttacagaaggtgactagcataaaagaaatgaaactacaacatagtatagcacaacttctaaaaatcaaacttaaaaataattaatttgatttttaatttactatgaaccaacacatgactcaattaataactaagagcaaattcattgcacccaaattgcttccagaaaaccaaaactttatgtttcaaaagtcccaatgaaaaagcaatgtcaggaaaagagtcggcgactgctaggaattggtatgcttagaaagttgaaatagtagcaaagttccacaaggcaaatacttagttaaataaagaggacaaaaggaaaatagtacaaacaagagtggatacaaccaaatatatttcctatattttgaaactctgttgtggataacttcactacaccaaaggaagtgcagcagctttcaaaatccgtaaaaaaggggaagtactcacatggattcatgcagtatgatcttatcattttgcatactgaggggtagactgatggaggcaatgccaaataaaatagtctacgtgagcttcctggtttgttgttcttcgaagtttcattctctgaaatggcgttatttaatgatgcaaatccttccccgctattgtaggaaccactaacatatttaatctgcaaagaaaattcaacgtgttacgaaatctaaatgcaaagaagctattcatgatatcagtgacttactaattgcaaaaattgtgaaatatgttcatctgaagctcctttgaggtatctgcgataacaggagaatgctatttaggcactagtatatcatcagacttaaaaacagagaaactacttcctcatacagaacatcccaatttatttttacatgaaattcttaaattattttatggtaaatgttggtgctaatatgtatctttcttacccacgaatgcgttctcttaatccatcatccgaaatatttgatcttgcatacccaaatatatggacttctccagattgtagaaatccctatcaacaccaaaggttacagttcagaactttgtacgtgtgtcaacctgacaaaacattatgtacatggcatgcaatagcaatatagcattataaagtgctgcagtagaatttctgagcaattataactcatcacgaatgcatcaattttatttctttttcactacaactctttcagaagtttgacaactatggaagaagctagtataccaaactatgtaagaagctactagttacaatcaaattacctgctgaaagaggtgaaacagcgctgggaatgttttcttcttagcaaggtctccagaagcacctaggaccacaatggacaagcaaccagactctgaagacagttctaggtccttcaaacctgacaaagaactgaagctagcccgccctgatgaaggggaagaatcaccagatcctcctgacatgatgaactgtatggtctcttcctttggagacaaaacctaagaatgtaaaaaaaagtactgttagtctcaatatgaggtattcacaaataacttataatctatccaaaactttaatctatgctaatatgaacaaaaaggtctattggttgaatgatggattcttgaactgaatcacctgtcagtacctaacagccaatttgcaacagagtgtaaatcaaaatgaatgtttgcttcagaaaaaaaaaatcaaaatgaatgggattaaagttggtttcatgaaatcagtactaaactactaatatagctaccctgaacttacatcagcgaactactcccattgtttgccaacttatagtcaaagttctcataaaacacaaacaggtactgtagttatgctagtcaaatgcttctatgagattctaatacagaaaaaaaaaagtatctacaagactacaaatgtaaatcaattgaactcggtgcccctacattttgtacgggtaaactggaacacatgcaacaactgaaccactgcactcactagaagtctagaacacacaacagcccaaccacccaataatcccgaaataaactagaactgcaacttgcaaagcaaattctgttccgagagcttcaaatgattaaaacgaacctatacagcaagcgcatcagggcgccaggaaatcgaggagcacacgcn

SEQ ID NO: 6768 - DNA, 4272 bp, Oryza sativa
  unsure (1)..(4272): unsure at all n locations
cgctgggcattgatgcctgacagcgccttgggannnnnnnnnnnnnnnnnnnnnnnnnnnnnnnnnnnnacggaaccgatcaaccaccaaagaggaatctaagcagtgtggatgaggaggaggagggagactaaccagcagtggcgacgagatttgacttcccgaggtggaagaagaagacgacgacggcgaattgggcaatggatggtgatcttttccgggtgcgatttatagggggatcttcctcactcacacccgctttccatccacccctccactctcctcccccgccgcttttatactcgcggacgactcgtctctcgtcggcgttgttctcagctttgacccgcgcttagccgcctctctgctttgccacacgcccacacccaccaaccctgctcgcttactgttaccctaccaacatagtataaatcaccaatcttataagttattttttttaaaaaaaatagcgtcaatccgattgattgaactactaatataatccatccgtttcacaatgtggagagtgctagaatgacttacattgtgaaacggaggaagtatataaaaaatgtgaaccgtgaagcgtaacgctgtggtagaaccaagtcaggttcaagctctatatttactcccttcggattgataatacttgtcgttttagaccagggtgagatcaaatcttttattatgaatcatttttaaaatatttatctttcaaatatggctactatatgtataaattagtcttaaaaagtagtttaataaaattatatatttgttaatatttttatacacattataatgaaaaataatggtcaaaattatttttttaagactatgcctttgtccaaaacgataaatattatccggagtaacatggatgctcgtatttatcaatactgactttatcaatttgtaatgtatttttgtcaaggactacgtggcaacttcatcaatatatactgtgtttcaaataaaatatgaatgaaccggtagaaatagtttatcattaacatttaatatttgtatcacttgttttagcgatagaaatagtgcatcagtaacatttactcgctttatataagttaatagaaaataaaactacgacaaataaaaaatcctaaaatgaactctataaatttcaaattttatatttttgctgaagctgatatactgagatttacactcccgtcccgtaaaaaaaatatacttagatacatagttagaagttgaacatccataactaaatattgtttttttttctatggattgaagggagttgaagatgcaggcgataagtctgagatgagaccaaagcaatctgtggaatgccgatggattgtagttttttctatggattgtagttttcccgagtatcctcactctggtactctagtactctacgtggccgtgtttagttgtaatttttttcttcaaactttaaactttttcatcacatggtttaaatttcaaccaaatttttaatttttgtgtgaattaaacacacctagtgttggtgacaaagtttttcactttttccaacccatgaggccatgacatgacatcaaccaaatggcgccgcaaatcgagcatcgtctggaaaatcaattcacgagtcgaacggcgcggccggtggtatatctatcatccccatctctttgttctttttttttttctgtttcgatgatttaacaatggtcatcagcgacgtcacaaaatacgctaaaaagcaccacgttttaatcctcttgtggatattatgggtaccccatacccatacggcatggttatccgactagtcataggggataacttatatctatggaatatgtaatagatcatgactcgggtattacgtttccttatatattacggaagggcttaaagtcctggtttgataatattgtaaagtagatttaggaaaccgataccgtattggttaaggtttctatcttgtaatcctgccccccaccctatataaggtgggcaggaggccctctagggggcatgatgacacaaactagatcgtcagatctataatacacccggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggttgcgtcgagtttcccatcaacaagcgcgatggaatcaatttcatgggtcgccgacttcgttttcgctttgggagttttcacttcctttccgtcgaccacttcttcaacctcctcttctctgacttgatccaaatcagtcagggggaaactcaatctgatttttatcattgtttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgtcggccaccaccgttgatgggcatcgtcatctacgccgccggtctgcctccgtcgccgccgactggtgtccccgcctatacggtcggttggtcacaccaccgttgatgggcatcgtcatctacaccgccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttcatgggcgtccacgacttcaccgccggcctgcctccgtcgccgcagactggtgcctccgcctacacggctggcctattatgccgccgctgttgggcgtctacgacttcaccgccggcctgcctccgtcgccgccgactggtgtccccgcctatacggtcggttggtcacaccaccgttcatgggcgtccacgacttcaccgccggcctgccttcgtcgccgcagactggtgcctccgcctacacggctggcctattatgctgccgttgttggatgcctacatcctcaccgttggctcaccttcgttgccgtcgactggtgtttccgcttacacgactgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggtgctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgaatagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctttatgccgccgttgttgggcgtctacgtcttcaccgaccggcttgccttcgccgccgccgactggtgtttccgcttgcacggctggcctattatgccgncgttgntgggcgcctacgtcttcaccgaccggcttgccttcn

SEQ ID NO: 6769 - DNA, 3453 bp, Oryza sativa
  unsure (1)..(3453): unsure at all n locations
ccgctgccttgttgaacaacnnnnnnnnnnnnnnnnnnnnnnnnnnnnnnnnnnnnnnnnnnnnnnnnnnnnnnnnnnnnnnatcaaatgataggaaaagaattaatcattactttttttttaaaataagacgaacggtcaaacatgtttaaaaaaatcaacggcgtcaaatatttaggaacggagtattatatagagtaaaatgcactagtggtccttaaacttgtcatgaggtttcacttagatccacaaacttgcaaagtgcacatcgaggtccctaaacttggtttatcgtatcattctggtccaaagcgtcgtttgaccgtggtcttgcctatgtggcacaccacgtggatgatgacatggtgtttttttttccttttccccattttctttttcctcctcctcttttatcttcttcctccactggagccacgtcgagctcccccgtgccgaccgccgccgtcgtcacgtagcgttgctgctgtcgaaggaagaggctgaagaagagagaaatgaaagaggaagaagggagaaaaaagaaaaaataataataatgtgccatgtcgttgtctacatggcatgccacgtaggcaagatcacggtcaaatgagactttggaccgggatgatataataaaccaagtttagagacctcgatacatactttgtaagttcgtcgacctaaatgaaagctgcttacaagttcaagaaccaccggtgtgttttactctattatatattacaactttaatggagcagtttgttgccaacaaatgctaggtatgcacaaatattcattcgatctgttttcagtattgtgtcgcccctctgcaactacgtgacttctaatttcagcatgattttctttcaaaatgtaaatcatatgaatatttacttgtttcttagtttcttttttcaaaatatatcagggagatataagataattattaatatgttagattatgcactctctgttgctatgaaactacaccaccattggtcagacgtatcaaggatttctaatatctgtttcctaagcaaaggagaaaacaaaaatcattaatgttttcattcctatcaccgtatgattatttctacacttgattattttgatatctttcattcttgtatgctctttgcacctgatccatgtagagaaaaatctggtaggactaattgatatgcacctattcaaagaggttaatatggattgtggccaagccacatactcgcactgaccctgctgtaaaacggcaaaaaaaaaaaaatcttatccttgacgattggcttgaacaataattaagaatgttatacctgctttcaggtaagtggtctgttatttttgaaatgaacaagcggttaacgggacaagtgatgatcaagttctcgctccaaaaaaaaaaaaaagaagaagaagaagaagtgatgatcaagtgtggtgtgcaagattttgtcacgctgtggaaagaaaatgagaaagttgacattgttgattcactgagaggtgtgttattgtagtattcgtgcgtgtatttttgtccactcttaagaatgattcttgatccatgcatatacttttttttcttttttttttaaccttgatggaaggaacgttgaatgatttgttggtttttgcgtcatggaatgaattttgtgcattaactgattagctaagttacttgttgatcatacaaggaattaagggtgtgttcgctattcctggatcccaaccggatccctccgcacgaaaaatggagcgatctattagcgcgtgattaattaagtattagctaatttttttttcaaaaatagattaatttgatttttctaaaacaactttcctatagaaacttttttttaaaaaaatacactatttagcagtttgaaaagtgtacgtgcggaaaacgagaaagatgagttgggaaaaatggtatccgaacacaccctatgtgtgggtatcgacgtattgatgtttttaaaaaatcccatatcacgatatcaatgtatccatatcgtcgtagcagtatcgcgtatccgtgcatcaccaatggcggatacaaagggtggtccgggtggtcccgggaccaccaaaaaaagggcgatggaaccccctattaattataaaaaaaagaaaatagcgacaattgaaaagaaagaaaagaaagcgacataatccatattccctaatgccgacgcgctattccctaatgatggctccagagaccccacacacgcgtatggaatcgatctgatcgacgcgatcacgactctctctgacgcgatctctctgacgcgatcacgactctctgtctctctcctcatcgccgccctagcccgtaggccgtagcaactgccctaggccctagcctggctagcgacgccgacgagccgacgagaggagagacgacgcgtcgacgccgcgacggcgcgaccacgcgagcagcccccacgcggccacggccacgccgccgcgcgcgacgccgtgaccggcgacctgctgctgtcctgctgtctgctgtctgtttaatagtgttcgtcagttcgtgtgccgctggacgccgccgcgaggagccgtcgtcgagccgatcagccgcccgcgccaacacaaggtaacaattttagttttaggttttctaattgtccacctttttcaatttttagttttaaaatcttaaactcttgtgcattgtgagattaaattgtagtattatattgtagattgttgattgttgaatcatgaagaaagatggagttatcgtatcgctttttctttaaagtggatgaagaggatataatgaacactttcatggccattagaagacgtagacccgataagaagaaaaagtaatatggtaattttctttaagctttcatagccgtacaagcttctttaaatcaaaattttacttaattactaattttatatattttaagatgttttgttaatatatcatggtaagtttttgataatttgatctattttattacttatagttacattgtatatattagtatcgttaggtttactgtgtttagaaaaaaaattttaggtcggaccacccatatcctaaattctagatccgccactctgcatcacaggtgaacatccattgactgatcgacgtttgccaataccggtcggaaatttgaagatcatattaacatgccgtgttgttgttgacattgcccaagtgcatgcccacgaaacttcgaggaagcttcgtagatttgccattcacggcgtaacggaacaccggaaattgtcttaaaaattgtcaccatccacatgcgtatccatcgtcggctggaacaccatggtcggctggaacaccatggtgctggaacaccatggtcggctggaaccaaattaacttcccgtatcctagttgacctgaattgaaggtacaattttccacaatcgctttcaaacaagccctataaagtccatncc

SEQ ID NO: 6770 - DNA, 7445 bp, Oryza sativa
cgcgcggcagtggcgcttcccgcctcttcgcggcgttcgtcgcctggctcgtcggctgcctctcgctgtttgtcgcgccgccctgaagggctgcacgtttcatcggaggttgaaagcatagccatcaggtattcaggattaatctatcagcatcaatcatcagcggtagtgtggtgtaacggggctcgttttttgttttttttttcttctttatgtggagtgggagtatgacgttctgcaggtttatttatgttgaccactcgttgtttattcggacttgtttgtccgtttcagcagtaggctactgttaggctgcctgtatcagatttctctgcacatgagagcaggtaaaatagcatgctattagccagctataaatatattttaatgagataaaagataagagagaagagcagcgggctacagatctgtagccagttacagcacggactccaagacgcagtgtgtatatgacaggtgggaccgtatattaatagtatagtaaacaactattgtatgaattgactattagatcggctatagatgaattggagcaggtagtgggctatactattaaacttgctctgacgcggcttaatttttttacctcaaagcgtttgatctaaatgcttttttattggtcagtgtgagtgtgacagtttatccggctacgacgcagcgtcgcaggctcgcagcgctgagcagcagcagcagagcccagtgttttggccgagaccgagcgtccccggccaaaacagtacgagcaaagctgatgctaactagtactacgagcaaagtgtgacagtttatccggctataattctgtcacgagcaaaaataaaattgctactccctacgtttcacaatataaatcattctagcattttacacattcatactgatattatatgtctagattcattaacatcaatataaatataggaaatactagaatgatttacattgtaaaacggaggaagtatacgagagcataagaaacaagaccaagcaggagggcgatctagatcaccatgccattttctgcaactggacatgctttggaccaagcttgtccgatctggaaatagacaaaggctatagatgttgttgggtcagagactcaggccgaagccagataaaccgagccccgaaagcccacataaacaggggggcaaaggcagtagtagcagcggtattaaactgtagtacgctaccgttatgtgcaatcggttttgttaaatcatattcaacccgcaaagacagaaacatgcaaatcaagcaactaatgtatatcaagaacaactggttggatgagcttgcagcatcatgcaatttattatggcacattcctcacatcagactgaaaaactgattcagtgattccacaagcagaatagttctacacaaccaaaactgaacttcaaaacatatgggacagtatcaggtatatctacactgagcttcgatatctccgcatcccgtttcccagaaaccatcatcactagttcactcagtcttcaattatcctttttttaaaaaaagttcactcaatcttgattctcgatcagcttcttgactatgcttttaagagctggtgcactagcactgcacttctgatcgacgaagcatgacctcccttcctcagccgccttgcatagctgtggatccatgggcaccttgccaaggaaaggtactcccatttcgttgcacattttctccgcaccacccttgctgctatcaaacacctcgctgcatgcaaccattgtcaaaagctcaggagctttctccttgatatagttcagcgcccattctgtagcatccatctcgcctccctcaccttgcttcacgaatctgaaatctgagagaacctgccgcaagccactcatgttctccacaacacctaagatcggcacaccaaccttcttgcagaaatttatttccttccgcacatcgattagagagacctgctggggagtggtcacgattattgcaccatcaattcctgtggcttgaaggtactgaacgattgaaatatgttcatctgatgtccctggaggagcatcaaccacaagatagtcaatctccccccaatcgacatccttcaagaactgtttgatgagtccgttcttgcgaggtcctctccatataacagcatcatctgggttgggcagcatgaaaccaattgacatgacaccaaggttggactccacatagactggtgaccaaccaaggttgctttgatgaatatcctgaccttcaaggcctaacatttttgggatgctagggccacatatatctatatcaagaaggccaacctggcagtccatttcagcaagggcaaatgagagctgggctgaaaatgtactcttccctacacctcctttcccagacagaaccagtatcttgtgttttactgtagccatccgttcaacaataccaaccaagtctacaaacacaatcaggcaatacaatcaataattatttcactgtgtggacgaaagcagcagtaattaatattgtctatgaataacaatcggtcatggctaaaattaggaatgcgagaagtacgtaggaaagaaacaccaattatattcatgaaagaatttacttgttcaactacaatttttgtaacatgaacttgtcttcctaggtgctcaatcacatgagttcctttttttaagtggcaatactgctgtgaaatattttcatggataagtggatatcactagatgtgttctccgtattgggtttccaacaaagttttttctttaacattcttgatgcactccattttttgtatgttaaacatttaagtatttccgagtgccattctatttagaaaaggaggcagctgtgtttcaactttcaggtgggacaccagatcatgcacttccatttctttccctctttaatgttacactcacaagtaaaatgtacttcctgacagtacattagatttggaaaatcagtaaggaccacatatttcttcatgggtttgggattgggtttggctccagtgtagtaataaactaatgatcatcatgctttcaatgtcagccccaagccttgctacctccatcactcacgttgcttctgtttttttaaccatctgaactatctacctaagaacctacaaggtgtttggttgtactgttatatatgcaataaggtagaacaatagatttatgaaatcacataaaaaacactgaagacatatcattgtggtatatggcatcttcatgcccaatataaaacatcagaactgacagaacaaagctggttggtaaatatcaaaggtaaaaactatccataaggcatagaacacaatcaacatgatccagctttggagctggtagattagagcattgggcctcaaacccacatcgcacacacccaacaaaaccatacaatgagatgaggagcataataaatactttcatcccgctcctatgaaaaattttggatgttgactactaacaaccccaattttcttccttcagcttcaactgctcaacttattcatacgagtgctcttgtaagatgtatcaacagcgaggaataggtatctgtgtgcctattaattttaattcatccatctcttttccccaaaattcacaaaacaagacacaacaacccgaaatctgataattttaagagaggcccaaactgaaaacactgcagctatgtggcacgaactaaattaactctaaactatgatatatgcagggaaatagcaaacaggtatcgcacaccccagaaagaacgatcacatggaaaaattttgccagaacacggtacaacaacaattggtcaagttaccaggatcagggcccttgggggcggtggcgcaaatctgctggttggggcatccggcgcaagcattcggctttcccgcctcctccgactgcgtcccagggcaatctgcagaatcaaacacttatcgttagggttgcgcatagcagacacccatccctttttccattgcaaggcgatcgaaacccacaccaaaccgaacggaaacaggggggaaaggtagcaatcgagtcttacgctcgttggcgtccgccgggacgtcgctcttgccgccatcgccgccgccgccgccggcgttctccatctccctcgccgcctccaactccgcctctggagttctcgttactttctcgcgaggtttgctgcctggtttggggacttgaagcctagagagcgacggaaatgaggagaaaaggagtatttgtgagagagaagggagaggctggtcaaagaggatatggagcgtccgattgtgatcgaacggtccagataccggttgtcaaggacaagtttgcatctcgtattctcgttgcatatccgtcgggggcgctctctctctctgtggattatttttttccgtgattttttttcccgtggttgactttattcctaattaaaatataagggatgatttcatattttagaaaaaaaaaacgaggtgatccaaagatattttaactactctagaagagcaaataatggacccatcgtagtagttggcaaagtatgattcgaccataaatactctcttgtttttcaaaatccaaaataaaatacagtcacaccgtgaaactataattgggtctagaaaataccaagacttttaggatctgcttggaagattagcccagagctaattttgaaaggtaatatttagtcaggaattggtaggctaaacattagcctagggtggtatgttgggatccatgggctaatttaaggctaaaaggtggagagagagtagaaagagaggagagagaaggagagagagaggtgctttttgatggtccccacataaaattagccccattagcacctcttggaggggctaatgttttgagggaggctaattcacattagctcaaaattagctcacctgtttggatccttgagggctaatttgaggctaaaaggtgaaggataaacattagcccatgaaaccaaacagagccttatgctttaggattggttgtgttcgggctaattggggcaaagaagataaacaactttcttgatctggtcaaatccatcatttccccaagcatatttttagaattaaacttttcacggacatggacccatcaacatgacttggccacaaagtactttctttattctccacaatcaaactcacaatatatatataggccctgtttagttccttaaatttttttcccaaaaacatcacatcgaatctttggacatatacatggagcattaaatatagattaaaacaaaaactatttgtacaattaggggaaaaatcgcgagatgaatttttttagcctaattagtctatgattaactatacgtgctacagtaacctacatgtgctaatgacggattaattagtctcaaacgattcgtctcgctgtttctagccgagttatgaaattaggttttttttattcgtgcccgaaaacccctttcgacatccaatcaaacattcgatgtgatatccaaaaattttattttcgcgaactaaacaggcccataaacaggttgtgaaaccgatagacatgataattgggtcccacgaaatattaccaaaccatcaattagtatactcaaatatagaacatttttaaatattatcacatctgttctaaaatatagtaacataatactaaataggacatattaatactacgaatttgaaccgataatgtgtcacatttaattatatgtctttctctggtcatataatcatcctccccagactttaattttcactataagagctagttgatgtcgttcctggtatctaaaggggataaggcggcaccatcagctgcttaactttgacttccagtctcccaccacttcagcttgaagaagtaaacatgactgataatctggcatgtgcataagcgagtctgtatagattaatgatagataccctaacggcaactgtatggttgaaaaagacataaatattagagaattatctaatatcaaataattagaaggagcgaggttttgaatttagattgtttagcccaccatctagccggcgagcatttctccgttatggttgaaaaagaaacagaagagggaaactacgattcgatatgatgagacgcagacactaatcaaaccagactacaagataaaagtacggaatactatactggtacagcactagtgtagtaacaacgacacaaatgacacgattcgttgtacatgtactaatcgtactgagctctgcaaaagcgtgagaggctcagagccacggcgcgaacagagtgatgcacccaacgagccaaatcagcagctcggcgagcagccgaggccatggcacccggtcccccgcgcccgcggacgcgccgacggcggcgatgatcatcgtggcgccggacaccatcagcaggaacgcggcgcgagtggtggctgcgcctccgccgcggccgtcggcgtgcggtggctctggctcttcgccgaaggcgatctcctcgggatccatttgccttggctcgagatcggccgtcgatgatatgttttctactgtatttgcctttgtgccagagcgtgtgcaatatatgttccagatcgagctccgttggcagtggcaacgaccatttttatatacgcatcgagggcaatataggtgggaacacagaatgggcccccggttgaaacgataagtcaatttgtagtataaagtccatgcgagctgtgtgcatttggccgcttcttgtgttgcgttaaccttttctagtcaatttcttcactgtttctagcttactggctggtttgacgctggtacgttactttgaaataagtattctgttatacctgcaccaatgcgcggtgaaatcactgacaggtcggtccgatacagcacatcgacccacttatcagtgataactccaggtcgtgtagagctcgcagttcgtacgtgtaggaacgtaattgcgtacggaggggaggaacgtgggctggattttttacattttgatccttttgaaaaacttattttgtaaatagacccctaaaaaaacttattccagaaatggtcctttttggggcgccagagtggctggcgccgtcattcagcctctctggcgccgtcctcctgccaccgtggggcacgcgaaccgacgtggcaagaggagggcgccagcataccatgctggcgcccccccaaggaggagggcgccagcatggctggcgcccgcgcctccattcctgtgtttctgtatggagttgcaacggtgccatttgtattttattttttttggatgtttcttcaaccctcaggatcattgatacaaccccaaaaaaaaaattataactcgaacctaccactttagcttaaagtctgaaaattatctaagcattcccaccttatgtctaactttgcaccctgtcccttaaaattaagacccattaccatctagctcccttttacg

SEQ ID NO: 6771 - DNA, 1616 bp, Oryza sativa
  unsure (1)..(1616): unsure at all n locations
cacgcccttgatgaacacannnnnnnnnnnnnnnnnnnnnnnnnnnnnnnnnnnnnnnnnnnnnnnnnnnnnnnnnnnnntatgaaattacttaatctaattcaaaatataaccacatgaaatgagatatataagttaaacagtacatatagatgcaatttttttatttttattttattttttttttgatatttttttcacacttaggagaacataggaaccaaccgtataaaaaataaactcaaacggacaaaatatgtgacatgtagaattttccaaaactctaccgaaacggacaaaatatgacatctattaaaataggcgtaactttctcatacggactcggaatcaggcaaataatatatgcacggacatctacagaaaaagttacatccgattctcccccgctttgccgggttcggcgatattaaaacctccaaattccgcttgcaagattgtgttttcgaggagagaagtttttcggtggagctttggaaaattccacatgccacatatttcgtccgtttgagtttattttttacgtggttggttcctgtgagtttctaagtgtgaaaaaaatatcaaaaaaataaataaaaataaaaaagttgcacatctctctcctctgcactagttcggagagaggagaggagaggaaaaattctacatgtcacatattacgtctatttgagttcaatttttctatggttggttcttgtgtgtccctaagcgtgcaaaaaatatcaaacccatgaaacaaaaataaaaaatttcgggggggggcgccagccactctggcgcactccccctagccacctcagcatcgccccgccacgtcggcggtgggacggcgccaaagaggctggcgccgtcccgttgaacgacggcgccagccactctggcgccccaaaaagaaccatttttgggataagtttttctagggatctacttgcgaaataagttttttaaaaggaccaaaatgtgaaaaatccagggaacgtgggcgcggcaaaaggaacaggttggtggcttggcgtgacgggggtggattatgtggctgtggccctgtgggatgtcagtgccgcgttccgcaatcgctcgctcgctcgcccgcccgtccggcgccagcccgaacctgctaggaaacttcctcgggttcaaaatcctcaactttgccaacagaatcgccttacttgttgtttcacacctctcagaattactttcttcctcctggaaatgctgtcgttttaaggttgagtgaacaaattagcgacaagtaaaaatgaccatattaccctaaaccctaaaccctaaaccctaattaccctcatttaattattgcatttgtcacttcagattgtactgtagataattaactaatcacttctagcagaccatctatcgcattgcacagacatgggtagtactagtagtggcaccgtagtatactaaatagcaggttcaaatgaatcgatgggatagactaggcttagctcgctggtcaagatgctacaacgacaaattttgtgggnnnnnnnnnnnnnnnnnnnnnnnnnnnnnnnnnnnnnnnnnnnnnnnnnnnnnnnnnnnnnngttgtattatatcatggccgcgt

SEQ ID NO: 6772 - DNA, 2250 bp, Oryza sativa
  unsure (1)..(2250): unsure at all n locations
nctgagtaggcgtttttcttcacgtgcacnacattttgtccaggagtgattacagtcaatgtttagagacaggacattgggagtcggagaggagcacttgctttccctcaaatcaacatagcgataaatatggggaactccaaaacatgtgcaaggctagggatcattggatccgatttttcacctaaaagccctcaaaatcagatttgggaagaatataagagaaaggttggtgatgctcttattccctccataaaaaaataaccttataatacgatgtgacatatcaaatttggacagatagtatgttcagatttgttatactagaatatatcacattctattatgaggttgattttttaggtggcttatactccctccatccttgcagttgtgggtttctgtgtatagcgtttaaccgtccttcttatttgaaatttttgtaattaatatttttattgttattagacgataaaaatactttatgtgtttttcaaataagacgtattgtcaaatattggacacggaaacccacaactacacttaaaatgggacagatggagtagtcgataagttataaggttatttctatttttctcctctctatctctcgcctatgcatttaatgcatttattatggagtatgtgatagatagctcttgcatgagaaccaactatattcttttttttttcaaattttctcttatccacgtaagcttatactccctccgtccaaaaaaaaaggcaaaccctgggtttccgtgtccaactttaactgtctgtcttatatgaaatttttttataattcgtattttcattgttgttaaatgataaaacatgattaatattttatgtgtgacttgtctttttaatttttttcataatttttttaaataagacggacggttaaatgttgggaatcacggtttgccttttttttttttggacagagggagtagttggctcttacaggtatgtggtgtcatgggtttagtcagaggctcatagcagcagggccagaccaccaaaagttcttgctgaatttcggaactgaatattcagattgaggcacgaagactttttctgaatcaatgaggcttttagcgggattacttaaattatgtcgtcacatttttcacttccatttttttccatatatgattgtcctctctccgatatttaagctcttccatgtagataataaattgtttaaattataattttcttatatattgtgtattagaaaattttcgatgtaaatattaaaatatacattgtaattatagtataagttttataattttcaacgtaattacatgtaatgtaagtataggtaatttacattttttaaatgttcttactgttttttaaaaagaaaaatatgatctattgcagctactcgttcagatagaattaagcagatgcaaactgcaacgagcactgaaaaatgttggctttgcctatttggaggaatgagtctattttgcctccctcaacttttgcttcttattgaatcacctctcttaaccacaaaaccatataggaataacgtctccaccatcttcgaaaaccggtgtaaattgaccactttggtggtttgaaaggcgttttttttttgctgacgtggcgagttgatcatggttgactcactgaatcatcgagtaaacctcacccaacagggactctatcttctttcaacgcgacgagctagttggggggggtccacctgtcgccctttgcatctgttccttttcttctactctcttttttctctcctcctcgctcctctcgaacatggctaagtggcacggcggcaatgaggcaaaaagggcaacgacgattggcgatgggtgatgcgggtcttggagaagaggcttccggattggcaacgagcagtggccggaggagtagcgctcgggcgtggacaaatcgatcccacatgggggcaacgctcgagctcgtggaggcaacaatagcggaggtgcaacggcaagggggaggtcagcatgcctggggttatggctattggagagcaaagatccctagtggtgagccggcctcctgagaggtggctaggttgaggagatcgagtggtggatggcattgcgtggggaaaagggccggtggaggcccagggtatgaatgcctcctacccattgccatccccctttttttggcttattattacctgcgtacttaccaatggtccccatgcgcgaggaaacaagatcatccccctcgcacagaagc

SEQ ID NO: 6773 - DNA, 2279 bp, Oryza sativa
  unsure (1)..(2279): unsure at all n locations
cgccatgatgcgcttggatgacgcccncagaantttgatattagcccccacgncggntntgcggttgagggatgcggttcattcaataggaagaaatgaaggagagaaaatagacttattccctacttgcagcatctcattggaggtccagtacgtaaggcccactacccaccacgtccacacactgcaggccttaaggcccagtaaaatatggaccactcacgtgggagttctgtttgggcccaacaggtacttggggacgccgttccgacccaaattggcgtggagtgcaaaacggcccgctcttctgctgcttgccagaacttccgcatgatctctctccagctctccagccgtccgagcttctgaagcgctctgctacttgttccttgagagtttgagacgctttccaccatccagccagcatcttgcgctaatccgctgccgccgtgaagccgatccaccgatccacggaccacggccgtctttttggcttcatgcctccgacccgccttctgctcggacgcctcctctgcgcgaccatcggtgcttgatcttttctttttctttagacaatgataatgatcggtgcttgatctgaccatgtattatcttgtcggcgtcagattaagcaaactgcactttcatcttctctgcattttaagcaaacggagtattaattaattaatttcggaaacaaaatggtaccaatgggcacggcggtagccatcagctgccggagatcgaaaagaggtgggagaccgaagatacagctccgatacaggtcacgggtatcgtcgggcttctcgagaaagcggacggccgccgcccgccggacgcgtgcctcgcgagatgatcgagctggccgttgtcatcagactgacgaggaggtagtagtgtgccacgtatgtatagcttcgcggcaccccattccaatcaaatgatccttgcgacgtgaaccatccaaagaggatcggtggaatttcgacttgcacagccagcccattcctgcaaaggcttttatcaacttctctccgttcgaaaaagggtttatcacgagtgcacattcaacgtgtacacgtatactacatggttcgacactcgaacagttctttttcttttaaagatgttcgaacgtcagttcgggcaaacaacgttatctgttttttggagtgcacattttacaatcccgaggttgcgatatgtggcccaataatgtgcactctgctgcattcccctttggagaaggttggatcagatgtagtatagggtgtgtttatttcacgctaaaattgaaagtttggttgaaattgaaacgatgtgatagaaaagttgaaagtttatgtgtgtaggaaagttttgatatgatgaaaaaattaaaagtttaaaaaaaaatttgtaactaaacaagaccataatgtattaatcacttgcgttgacaacaattggcacactcaaactccacaagccatctcatacactcctattatattattattagtagtattttttgctgggaacattaggtacagtctactattttaaggaggccaaaacgaaaagcacatcctcttttctttttctttttaacgcattgacatgacagtgtagcaccaacaacttcaacaccagcacgatcaagcatattctaccatagaaacttcaacagttcaaccaacatcagcatcaactcctgttccgttcaaaagaacgtccaaactctacctaattgacaaatgatttcaccacgtccctttccattttcccttgttttttttcctcctcgaagaggtcgctttctgtaccgtctggaagacgtcatgtgttcttactatagaatgcccacagaaaatcctgcattccacggcggccgaaatccaatcttgccgatggtttggtttcctcttcctcactttttctttctttcttcctctccaagaagacaagtcacccttccccacgcccctctctctcctgacgagtggggcccaagtcgtgcggtcatagactttttactactacaaccaacgttcgcgacccaccgaaagttccagaaatccaccgctctccgggccccacctgtcgccctgggcccgcatgtcatacgcgtgcccgccaccgcgctgcgggcgccgcctctcccggtgggtttagaaactgtgagggccgaacccataacgcggagggcgcggtggtccccccgcgtgagaaaacccccccgcccgcccgcgtgtcacgttacttccgcgggccccgcacgaggcacaaaccctatgtcc

SEQ ID NO: 6774 - DNA, 4455 bp, Oryza sativa
  unsure (1)..(4455): unsure at all n locations
agtgttcgagcatacgattggatctggttattttatggtatggggtttattcggtgcggatttgtgatggatttttttggtttggatgatgcagggttcggccgcatcggcaggctggtggccagggtggcgctgcagagcgaggatgtcgagctcgttgccgtcaacgatcccttcatcaccaccgagtacatggtaccgtctctttccctcgcctcccccgcgaattagttgatctggtgcttttgagaatgtatgatatgatgattgtgctcgcttcggttaaattgaattgcacgaattcggtgcccatcaattgggattgaggcatcctggtagatttgttaggactatttgttataaaccttgtttggatttgtgatctgcagtactgtagatgtcactgtcgttctgctctgatggaccacaacgcactctgtttataccatggattcataaatgcaattcttgtctgctttgactgaatatttctgtagatccatatagtagatggtttgtgttcatctcttcttttatctgatggtgctatggatgggatgattggtatgagtctattacactacagtatttataaagtcatgcagacatgcatactgatgtgggtctcttttgcatgcttcaatgcatttagaaactatgtgtagttgagtacttgaatggcgttcctacctacaagacctgatttccttgatagtacagaatgctaattttggtttgatctgttgtatatgctaaattggactgtcgttgcgtgcagacatacatgttcaagtatgacaccgtccacggccagtggaagcatcatgaggtcaaggtcaaggactccaagaccctcatctttggcacgaaagaggttgcggtgttcggctgcaggtttgttgccatccatttcagtatcatttttgttcatctgctcacaagagttacagccagtctgataagccaatattctgatgtaggaaccctgaggagatcccatgggctgcggctggtgctgaatacgttgttgagtctactggtgttttcaccgacaaggacaaggcagcagctcacttgaaggtacattcctgtgtcaatttttctgttcagggtcaagctgtagatctgttctcaatcatttttcatatgcagggtggtgccaagaaggtcgtcatttctgctcccagcaaagacgcccccatgttcgttgttggtgtcaacgagaaggagtacaagtctgacgttannnnnnnnnnnnnnnnnnnnnnnnnnnnnnnnnnnnnnnnnnntctcgccaaggtgtttattctgatataatttggcgcctgctcctgtgcgcatgtagctactactggagttttaagctaacattttgtcttgttacaggtcatcaatgacagatttggcatcgttgagggtttgatgaccactgtccatgccatcactggtaggcatcactttgcttaatattaatattggactgagtaaaacgtttggtaccatctatctgatctgatttcaattcaagtgattaacatttgaattcctacagctacccagaagactgttgatgggccctcgatgaaggactggagaggtggaagggctgctagcttcaacatcattcctagcagcactggagctgccaaggtataaacttgtatttctgtatgtattacattgttgataatgtttcgttatcagacatttgcacctaatattgatatgtttcaaggatctcgtggtatcgttttgtatttactttataatgcaagtataacattaaaaaattgactttccactccttgctagtttgccccccttttcctttgcaaaattaaggtttgtttcgttgcctgccaaataacagtaccggtgtttaatcagatggaatgatggatctcacaaaatgtggcaaccaccttatttttgttgtgttttgttaaaactacactgaaccttctgtatcgggcaccattaaacctgtttatcgtgtactcaattagttttactcaatttctcataggctgtcggcaaggtgcttcctgccctcaatggaaagctgactggaatggctttccgtgttcccacagtccatgtttccgttgttgatctgactgttaggcttgagaagcccgccagctatgaccagatcaaggctgcaatcaagtgagtaattcttaacaactatgggctctgtaaatctttatgaacttctgatttctggaccgagaagaatctgcttgtgttttcagaaaagaaaattatttgctgccttgaatgtttcactaattttgctacatcttctcagggaggaggctgagggcaagctcaagggcatccttggatacgttgaggaggaccttgtttccactgacttccagggtgacagcaggtaaatttacccattgcagtttcttgtataattatgggtcatattggttacctctaggctcttgctatccgacctattaatttaccaaaaaaatgcacttatccatcacaggtccagcatctttnnnnnnnnnnnnnnnnnnnnnnnnnnnnnnnnnnnnnnnnnnnnnnnnnnnnnnnnnnnnnnnnnntggggatacaggttagtgtgtgctgcattatgaaagtgtaattctctgttacatgctcacgacagtctgcttaaaccacattttcctctgattgcagcacccgtgtgatcgacctgatccgtcacatgcacagcaccaactagacgagccctcctcatggaggcctgcagatacaggggagttgtgttttgccccagagaagagtagatgaagcctcttccgagaataaattttaaattctgtatggttttatgtccgtcgaaacctaaaactatacttggttgtatcatggtggttggttgggcctggtcatggctcatattttgtgtctaattttcttgcgcttaatctaaatcgaagtgttgcttcgcagatgcatttgctctgttttctggttgcttcttaaatacgcgcgccctaaaccctatgtgcgcgcgccagagtttcttcctgatttacaacgtttgctgtttagtcattggccaaaccccttagagcccaccttgattgatcgaaacccatctcctccatcgataaaaattggacctaacttatcgttaatgcaagtgcattgtctcgctggggatgagaaaaccaccagcaggtcagcaagccaggagctacttctgtccgctttgtctctagaatttgtagaatgctcgttttcaacggaaatgtggactgccatcaggcctcaattgtgaagtctccattgcacacgaggatttatctctagaatttgtagaatgcccgttttcaaaggaaatgtggactgccattaggcctcaattgggaagtctccattgcacacgaggattgaatcaaaaaaaaaaatttgaaggacgaaataagcaggtgttccagaatgattgcaggaactgataaacaagaaaattgaagaattgtgaacttggaggtacagagtttctgtatctctgttctgaaaactgaagaattgtaaacttgaggtgagactatttctctgcccctgctctgttttcttctatcttggcattttagctctgtaacttgctcttgttttatcgcacagcctgacctgttaaaacgaaaaactgcacgcacaataatggatgatctctatcacaaatgagatcgaaaatcatacgttcatttctgacaagaagtcgtacgaaggagatatgaacagcaaatttattcagtcacaacgatcacatataaagcatggaaatgcagagcagacagccagagaagcagagcgcccaacggtgtgtaatgctgctttgccaacggcgggtggtggctcactgcaagggcacacgaacaatgggacacaaccaaagtggattctttcttcccacgttgatgcctatctcctccgtcatgtctagttcgttcggcgcaactccttcaagaagctcccatttaaagtggtataagagcgtagcaagcatgagctccacggtggcatgcccgaatgtcaccccggggcaactcctcctaccagcaccaaacggaatatactcaaagtttgcacctttgaagtcgatcttgccatcatcgaaccgctctggcttgaacacctcagggtcatcccaatgcttggggtctctgttaattgcccatatgttcacaaacacggtggtgcctttaggcacgtcgtagcccatgaccttgcacgcatggagacactctcttggaagaagcaatggtaccacaggatgcaaccttagagtctccttgatgataagctttagatacttgatgttaactaagtcatcttccttcagtgtatgggttggaaagtcgataagtctgtggatgccgtagagcctcccnacncnttgnntgcttggagagangntgttcggacntcagtnngccgcgcttn

SEQ ID NO: 6775 - DNA, 990 bp, Oryza sativa
  unsure (1)..(990): unsure at all n locations
nnnnnnnnnnnnnnnnnnnnnnnnnnnnnnnnnnnnnnnnnnntgtggttacagggagccggcgacggccgggggaggtgtggggcctcctcctgaggcaggcggcggaaggagcgcacgcgcggggcgtggagcatctcccgatgcggcacctggggagctgccgccacaggtcgcggtagggggcgaacccccggccctcgcggtgggggcgcagccggcgcacggtgggcggccacggacggaacgcgaagggggggtggtgcgtgcacgtcacctgcggggcggagtgggggagggacgcgacaacgcggggaacgccgccgagctggaggcgcatgatcggcgcgtcgtcgagaccgcgcgccaggtccgccatggtgcggtggacgagcgggccgcggagcatcagctggtggaggttgccgatgaccggcagccgccacgggccgggcggtggctggcgcaggcgcgcgccgtcgccgccgcgcccgcgcttgcccccgatcctgacgaggagcaggagagccaagaaggcgcagatcgaccagcacgcgacctgatccatggcggtggaggccatggccatgcaatgcaagcgaccgcgttctggtatggagcggtgagtgcaactgtgcaagatcgccgtgcaaagctcaagcactgcaagcctatatagagaggacggaagtggatcttttgactttgtgcggtttacagctcagtaattaacatgtaaaccatattttactgtatttcacgtgtcagtgacataactataaactatacaaagtctaagggcacccacaatggttatctataggctctctataagagatccatgtcagcatattttcctacttggaagagattaaatgaagagagagagcaaagctatctactaannnnnnnnnnnnnnnnnnnnnnnnnnnnnnnnnnnnnnnnnnnnnnnnnnnngtgctatgncgttgtctatctanggacagtcgt

SEQ ID NO: 6776 - DNA, 2475 bp, Oryza sativa
  unsure (1)..(2475): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttagtttgtttcttcttcagtttgatctttaagttctatcgatgtaacgagcaagatattctatgtatgccattaacaaaaattaatggcttgttcctatatatttttcaaagatggcttgggttgacttagcaatacaaggctacatggcttatcgttattcttacagtgcgatgatcagtggcaaagccaatgcccaaccaccatgggcagttgcccagcacatgataagagggcggacaagctgcatcgttgtggtgttttgaacggctgttttgaacgatgccggtggctagccgtacagtggagtttgcagaactggatttttttttattttagttcttttaaaaaaaacttatttataaataggtatatggaaaaacttattttagaaatacacccttttctcagcgttagggtcattggcgctgacaaatgtcttgacgctaatgacattggtgccaacactcttacctcttatcccttgggaagctaagtcactaatgtgaggggtcgatgccaataacattgtgccgaggatctatttgtaaaaaaattcagaaaaattgaaatataaatgattttttataaatagatcctcaatatcaatgaattaacaccaaatacctttttgcaagaaaaatcggttgaatgccattggtgacgaccgcagtgacttagcttcgcttccgtaggaggcgagggtgtggtcggccttgacgtctgggtcactagcaccagaaaaatgtccgttcttggaataagactttttgaagggtccaaaaatatttttttaaaaaagactaaaatgtaaaaaggtgcaggtttgggcaagttgtaaaagaatttactccgtctatgccgagacgtcctcctccgttgccgccgacacttttgtttaaaccccacgggatatatttatattaaagtagagggaaacgctgtacaatagccatgaaggctaggaggttacaacgaaaagagtaaaaagaaagcggttattggggggggggtgtgaacccaaaaaggaggcgtgcggattattattacgaaaatagatgcacaacggagacgaattttacgtggaaaaccattgtggtaaaaaaccacgagcatcaaaccggcaattatcagtattgatgagttgattacaaatgtagaggaataacaatagtaacgtcacccttttttacagcttacaacaagagtgtatgtgtgtgtgtgtgtatatatatatatatatatatatatatatatatatatatatatatatatatatatatatatatattccgccncctccttataaaaaataaaaaataaaagaattttccatcgtccgtttggaaaaaaaaaagcgagaaaaccaaaaaagaggaaagaaccttcaatcgccaaaaaaaaaaagtccgacacctctgttagaaaaaaaaggagagaaaaaccaaaaaccgaagagaaaaaaaaatggacgtccgactcccctgtgaagaaaaaaaaaagagaaaaaacttctaccgtgaaaaaaaagaaaaaaaacgtcgactccttgagaaaagctacgactaccaaaaaaaaattatcgtccgtaatcttctcttccacttatactactttcctttttaaaaatatataatataaaaattgaagatgtttttgccggtactttgatacgtcattcatgtataggtcggtttttaaatttgttcgcttttagaaatacagatccgtatttgagtcagtttttaagtttgttcgcttttaaaaatatataaggaatcctataagaaatcatttttaaaaagttgcatgttaatttgagacgatcgaactcctaattgcgatggcagctcatgattttctaacaaaatatatatccaagcgaaattaaaacgatgaatttcatcttaactaaaccatatctatataactaatataaatattcgtatttttcctttcgtcacatctaatttcatgttaactaaaccatatctatataactaatataaatattcgtatttttccgttcggtcacatctaattttcgtcctgttcgtacgcaatccgtctcagttagcaatagccatggaaaaaattgcaaaaaaaaaaaannnnnnnnnnnnnnnnnnnnnnnnnnnnnnnnnnnnnnnnnnnnnnnnnnnnnnnnnnnnnnnnnnn

SEQ ID NO: 6777 - DNA, 3337 bp, Oryza sativa
  unsure (1)..(3337): unsure at all n locations
cggtgnncatgatccactgaggcctgnnnnnnnnnnnnnnnnnnnnnnnnnnnnnnnnatcaatttctaactgatctgagccgtccatcaaaacgaacggctcaaatcgatcgagggtttgggccgcacgcgggccggtggtccagcaagtgagatgaggagtatggggtattaagtagacttttacgcttgcgggctaaagaagaaaatgggttgaaaaaggcccatagagaaaaatgatttttatttaaataaatgctgaaatgatatttgtattatcaaaattaccaattaagctatgtaaattccaagaaaatttcaaagagtgtaattaatatagaaaatttaacaaaaattaaatccaaccatcatattttatttctcacacttaatttacttgaaaattaatttaattatatacctaccaacataaaaataccctaatattccagaaaatgtgtatttcatttaattagaatttaatatgttttaatttaactgttgtttttttcctttctgttgcaacgcacaggcacttttgctaaaatttcaaagtgtgtaattaatattgtagaaaatttatttttcattaaattagaatttaatatgttttaatttaattttctcattttttctttccgttgcaacgcacgggcacttttgctaaaccaaacaacacttttggttaatatatacactccgtaatcacccggtgcaatgctcgggcacttttgctaatgtgtgtgtgtatatatatatatataaaagaaaaacacctagtatgaaaacacatgttttactagaaaattaatccgaatatgttgtagacctaaattaagatcacatatttaacagtcaacctgagctacacatacacgatgcagctctgtcacaggttcagcatctacaccacatcaacatcaatcgtcgtcgtcggagtggatcgctgatgacacacgaggactgtggcaagacgaaaacgacggagaactttttacggtacattatactgtcagtatatactagcagtatttgtaagagcatgttaggaattggcaaaaaaattaggaagtattttttagtaattttatggttcagagttaatccaatcctattaattagtactcgttcgcctgcgctgttggttctcatacgtgcgcctgcgcgattccatggcaacggcgccagcgtgattcgacagagaataggcgcgcaacggcgattcccgttcagcacttcagctgctacggcgtcccttgcatcttgctactgtgttcacgagagactaggcgcgtgtggcggtatcaaatactacatagtacagtagatagttagctttgtcagtgttaaagtgttaatgtttgatctctacctgatggtcatgtactggcactggcttgtgtcatcaagctgtgtgacaagtgacgactagtccatgcttaagcatgcgctgattatgtactaatctattgcggcatgtacctttgccatcttcagattaaattgttcagaataaaatggcagagaacgatagtacttgggtctggccatgtagcctaattaggctgcggagtgctggagaatgactggctagttgcctttgcgtaagtgcgagcgattgtggcggcacggcgctagcggggcatgtgattgcgcgggcgtagcagtagcctgacgagcgagacgactacgacggcgatgcggagaatccggggtgcgtgcacgagccgcaagaggcagatcgatccatagatcatcgggcgctaggcaagccataaggcaggagactgctaatctactatttgtctattgcaatatctctagtgttcatggtggctggcggcaacggcgcggcgtggcatgcgccggcgacggcggtcgcccgtcgtgaagacgaaggaatcttggaaggggaacgaacagagacttttttttggctgagctagagcagaggaaacgttagaacaaataaagacaaatttaccctttcaaattttataatgcaatttaattaagtgaaagatcaaatcaatctataccgttagattaattatactagcagtatatactaccaatatattgtaccgtaaaagtgctcaaacgacgaggaccgagcaaccgcacgggttcgataggggatgaagatggggaatatgggatggctgttccatgcgtgcagcactgcaatgtcggcgagtatctccaccgtctgttatgttgaccgcgacttcgcaagcacatgttacgtggtccgtgcatcaatcacgctaggcatgatcccctgaccgctataaaagatcgctaattctcaccagagctggaggttgtgctgctctgccaaacggcgaaaacatgttgatgctgtttagcaatgttaatttcgccaaaaaccttatccaaaacgaggatcattgctaaaattgggatatgttgctgcacgtcttcttgattggtgactttgtgttatgtagtttaatccataatttggtactaaggctgaaatgaaatgttgctgggccttactgtcaacatctcatcaccatgttttgaacttatgacgatgttcgcttgtcattcccatcgattagcagttgtgtcagactaatttctgtgtaattacctcagcgcacgtgaaatgatgcattatggccaccctattttttgtaaagagttctatctacattttcttctttttttcagtcagtctcgcaaatattactggttgtgaactgtgaatgatcaggttgtatacagtgagctgtgagccgagccccaagtacaaggaatttttaaaatttttaatttaaattaattttatttattaaaatattttttttcaaagtttcacaaatctacacatctaacgctctacaaaaacgccctcccaaaggtcattttttatggcgtggcacacacccattggtgtgttgtaacagttacgtaaacattttatagacggcactcttgcagctctctagtgagctacctgtaaaataacgacatacgatattttacaaacgcccccctgcatctttctagaaggacggcaaggggtctacctataaatggccagccatggttattttgcaagcggcccccttagagcaggtacaatagcgagctataagccagctataaacatattttaaagagataaaggaagagagagaagagcagcaggctacagatctgtagccagctgtagcacggactccaagacgtaacgagtgtatgataggtgggaccgggtattaatagtatagtaagcanctagtgtaggggtgccaaattaccaatcgtnnggnggatcgaccgaggagccaatcaatggcagcgc

SEQ ID NO: 6778 - DNA, 1257 bp, Oryza sativa
gacgagctatgagatccgagtgacaagaccccgagatcttgtagcccgctactgctcttctctctcattgtttatctcattaaaatatgtttattgctggctaatagcctgctattgtacctgctcttaaacttgctcttatagccctttaggagggcggtaaggggttgcctgcaaaatgaccggtcaccctacatgtggccattagaatgtaccaacagacgtgtgctacatcataaaaaacgttctctggaagggcgatttaaaaaaaatcctccaagagggcgttaggggtgtagatttgtaaaactttgagcaaaaaattatttttgtaaatattttaataataaaatttaaaatttaaaaaattcaagtacaataccattgctggtgacctggattgccaagcaattttctgcagctggacctatcttgggccaagattagtccgatctggaaactgaacatggctctgcaggccgctgtgccagactaggccgaggcaagatggcctttacaaatcgagcgcataatgctggtagccagaaggggggcaaagcccagctttgcaatggcagtagcaacagtggtacaatgcaacacttctatattttagatcctcctgtcaatattagaacaagttcttaaaactttgatcaccttcatattaaaatcagtttatgaaatatgataacttcatgatattatgatattatgatagtagtatctttcaagaaaaatctatgcatatcttttttaagatcaattttgctacatggcattgtgacttcacggtttttacgtttgccacaggataacttcatgaagggcagctcgagatggagatagatagatgggaaatttgacagtgggctcatgggactttctgagctttcatatgatttctttcttctattcaattaaataaactagctgggaggcccgcgcaattgcgcggctagcatctgtacaaaattatatattttttacatatgattttacttacattttgtcaaatagttatctcgttgtcttaagactttggactgaaccttatcatcccgatgtttctacttttatagtttatataaaagtcacgtcagtcgctatcacttactcctttggcacatctccattatttgcttgctcgatctaccattgtttctatttattctccttgaaaacttaaaaattataccttatactcccttcgttttttaatagatgacgccgccccccttttcctgactttcttct

SEQ ID NO: 6779 - DNA, 5250 bp, Oryza sativa
  unsure (1)..(5250): unsure at all n locations
ggacccaatttggtggagagtataaacaggccggttattagaagcatccaaagatccgagatgatctgtagcaagctatcgagcgggtcaggttatatgaagcaatagtcacctatgttcttagagagtgtagaaggactttcggacatacagtcaaacttagtggggttagtacatggtatccgttgaagaaaatagaacgatgcaggaaccgagtaagtatattggacttcagtacatgggagccgcctgggagtgagttgattcctaggggaagaaataggggggggattttgtggggtatcagtttacgaagagaacggtgttggatgtgagcatgatagttaggacgggtcaaaaaaggagggggaacattcatgagcncggagcnccaagccgtcatctattaaaaaacggaggtagtggtttttagagtttgttggcttgttaggtttcatttttacaatatttagatgtctcgtcaaacactgctactgtagtcctctatgctctacggttcgtccactgcctctctttattaatattaatattgagattttaaaagtcgaacataattatctagaagtcccgtcaaccgatgccactgtactcctctacagcgggaaatattgcctcctctctttattaacattgagattttaaaaattgaacataattatctagaagtcccgccaaaccttcagcggctttgccaatgtactcttctatggttcgcccgttgcttcccctctttgttattattgatattttaaagattatacatgattattattggggtttgtttttttactttctagaagtcctgccaaatcatcagtggcaaagccactgtactcttctacggctcgcccgctgcctcccctcaaccattgtgaacattctacttaatgacatgtctatgttcctcctcttaatcttaattgggattctatttggagttttgtttataatttttagatgtcccatcaaccatcatctctactactctacaggcatgttgcttctcatttttattatcgtttgtcattgttgtattctagattgtccttttttttaaaaaaattccatatttttcattctagcattttttatttataaattgtattcctgcatgaactcttccataatttttagaagtcctgttaaacaccgccactgtacttctctatggggcagccactgcctcctctctttattatcattggggttttaaaaaacaaacataattatcgtgttggttcagcttttactttctagaagttctgccaaaccgtcaatggcttagccaatgtactcatctacggctcgcctggtgcctcccctccttattgtttttgatattttaaaaattgtacacgattatcattgggtttattttttttactttctataagtccaaccaactgctataaccatactatccgccgtccctccttttaatcttcattgggattctatttggtttgtttttaatttttagaattctcattaaccgtcaccactctacttctttataggcatgaccatgatcaaactatttagattttttttaatccgagaatttgtaagtctcgagagcaaacttagagacttttttttacattactttattaagataatagatagaatattttatttgtatataattatatcaatcaatatacaccattaaaatctagatcctttaaatacttcacttttttttaattaatatggtgatttccgtccgcttctcagctctgccccattctcggagtatgagctataacatatggaccctaaatatagagaaagctattgggaatcttgttacttagaatttatttttttctaaaaaacataccgtctctaaagattatgcgatagagcaaaacttaaatatggttgaaggagttcggatgcccagttgttttatctcccctacatatgattttgtacaggacgtgtcagttgtgcatatttattatttctaatttagctatgcagacatgacgtgtttgtctcctgtcagtaaattaagtttcctaatttgattttgatttcaaaggctgctgcgtagcacgcatcaaaatctaactccacgctctttcacgtgtccgattcataaaaacagaatcaaagagtcaagcttttacatatattgtgattaaatctcaacccttgtagtctagatatgttaggatctaacggtgtagattttttctttttccccgattaatgtgggaatttctagcatccacctgtcttctttcaaagctgttttaataatataatagatagatagatagatagatagatagatagatattctatggcaaaatttgctacaggatatcaaaaaacatgtaatgtaattagctgtagaacatcgaaaaacctgactcagctataggacacttcaaaaatgatataatttgctaaaagactctaaagccattattttattatttcttggatcaaatggagagaggaattttttagaagacggcaatgccctcagacctctctccttcctcgatcttgtctgcaggtaaaaaagagaaagaaaaagaaacaagccgtcgttgcacatggcccacacaacaacatactccctccgtcccaaaataagtgcagttttgcactattcacgttcaacgtttggccgttcgtcttatttaaaatttttttatgattagtatttttattgctattagatgataaaacatgaataatactttacgtgtaactaaatatttttaaatttttcataaacttttcaaataagacggacggtcaaacgttaggcacggatatccacggctgcacttattttgggacggaggtaatacaacggtgtttcggtgtcctccatggaggaccaccgtggcgagggcaatgatggcggcattcacatgatctctgatgatcgcctaaaacaccctattgataaattgagaacaacacagattttgccaccaatccagctgagaattcaggatggagggagggcacatcaggatggtgttgatcatgatgaggctgaagaggaggaagaggggcctaagctggagcacgacaagcatgagagacactgcatggctggttccgccgcaacttccaatctcgggtcagaaggccgagggggcaaaaggccgaagattttggtcgtctgctcaccccaagcgccctctccacctcatccagtggggggcggtggctcagcgggtggtggatggcaacgaatctgccggcgacgagagaagacgaggagatggacacgatgaagaggtggggtgaggcttgctcgctcctctggaggtttttcatggggtagctcgcgaggactatgccgtacctcatggcagtgcgtgggcgcatccctcctcgtcgttcaacatcgacgcatgatgccgtctccagtgctctgccacggacctgtcctctgcatagcgccatctacgttgtcgccgcaagtgctagatggggggagcgattcggctctaaagggcaaactcgtattttctatgttgtttctccatttgacctaaaaataataaaataatagcttcaatgtcctctagcaaattacaccttttttagagtgtcctagagctaaatcatggttttacgatatctcacagctaattacatatttttttggtgtcccgtagcaaattttgctttttctcggagagatttatacgtggttggctgttttacccacaaaaatcctcatttttttttcacaaaatatacgttctccagcgcaaaaaaaaatatcgtgtgaagagatttacacgtggttgactgttttactgagctcctctttgaaaaaaagtctatttgtccaccctcatctctttgggttatctttgacatggcttgactaagtctattcctcatcttttggaccgtaccttaggaaaaagtatactttaactcccccaactatcgcccgagtatgattcatgtcatttaaccacaaaaccaggtatatcgacttctccaagtattaaaaccggtgcaaacaatgccacttgatggttttggaggtggttttgtctggcgtgacgcctacgtgacggtcttgaccaagtctttgtcctatatggcattagaataaaaaataaaaaaaatgtggaacccatatgtcattcacacaaataaagtattgtgggacccacatgtcatcctccctttccttcccttcttcctgctccctccctctctctcccttatctctctctctctctctccccaagcctttctcttcaccttgggcggagcggcggtgtggaccgtggtagggagcggcggcggcggctgccaacccgaagcacgagctcttccccgaagcacgaagcacgagatcctccccgaagcattgtttgcaccggttttgatagctggaggagtcgatatgcccggttttgtggctggaggacatgaatcatactcgtgcgatagttgaggaagtcaaagtataattttccctgtgccttatatgtcggtaataagtctattttggctcccttatcgttggaccgggccaggtcgggcagcccatcgtgacgaggcagaggcctaggcacagcccaaaggtcaggctgtgccatgcttgggctagaccagaaccccgtgctatgggtcaggccgtcgggcctcgagtcttttggctaactatagatgaggaacaaggtgagcaagcacttaaccatttcattaaaattgagatctttattatttgcatggaaatgagctgaagaattgtgatctttgtgtttgcatggatatgaattgaagaaggataatattatattcttggagttcccaaaaggacggtccaatggccgatgaaggcattatttgatgctcggtttaataagttaataaggtatagtctcctgcttaatatgagttaacaaggtgaacagcaagtgctaaaaagtttcatattatgaaaaatttccagtttccatgttgttcgctttgataaatgaaatactccatccatccataaatatttgacgccgttgactttttaaaacatgtttgaccgttcgtcatattaataaactttttgtgaaatatgtaaaaatatatgcacaccacaagtatgctccgtcggtaaaaaaaaaaaaaatntaggattgtatgtgaaatattatagtacaannnnnnnnnnnnnnnnnnnnnnnnnnnnnnnnnnngcgntnnntgccagnagccaggntaacaataaacagt

SEQ ID NO: 6780 - DNA, 693 bp, Oryza sativa
  unsure (1)..(693): unsure at all n locations
cacgcggnnacggatagacgcttnnnnnnnnnnnnnnnnnnnnnnnnnnnnnnnnnnnnnnnnnnnnnnnnnnnnnnnnncggccttcttatactttgagaggaggaggacgctatttaacacaaacgacatgataacaagttgatgaaggccttgtggccgtgggattttgctttccgaacgatgccaaaattccccagagtggaggccagatcttgatgaactgctagaataaaatttagtgatatcccaatccaagagctacagtaacatacatagactgctgaatgcaggattgggtttcactgagggtgtacttgcatgctagcccagtgattgaccctgacaagtactacatggtgacatacaccgtgcgtgcgtccatgattccatcgatgagcgacgagatgagtttgggcttgcggccagacattcgggcacagagtagccgaggagttcactgcgatagattgccaaaaagagagatcttgtcacatggggcgattggttttctctcgccctagccggaatgaattctagtaagcagtggggggaccgatccacatactaggcgtatattggctttcgtatgcgcactgcctgatagatagtgctgtctgacgatggtgcaccattagggtttcatgagtagcgtgcgggatcagaagttgtgcgccatacaacgacagcact

SEQ ID NO: 6781 - DNA, 1236 bp, Oryza sativa
taagttgttcttcaaagatcttaaaaaagttaaacattgtatatttctttactggagcattagcaaatgtgcttaattacctggagaactgctttgatgttgtccatggtgagaggcatgtcgagggcaccttccttctggatcctgaggagcgtgtccaacaggtcctcctccatggcgcaatcatcacgatgcggctgcgcagccatggcgtcccttacctgctcgtgctgccggaaggcgctctcgatcagctcgttccccttccggatgctcgcctccgcgcggcgcgtcatgccgccgacggcggcggcgatcctcgacgacgggaacaggtcgtccaggctgaaccccgtgaagctcctcaccgcctccgtcatcgactccaggaactcctcccgcctctccaacctgtccccgatcaccacgcgcatcgtcgcgtccgccacggccgcggcgaccagcgcgctgacgttcacggcgtcgcggcgggccggtggcgacgacaacgaggcggcgacggccgcggcgaggttggcggcctcctcctcgcgcacgcggcggaacgagcgcacgcgccgggcgctgagcatctccacgacgcacaccttgcggagctgcccccacatggcgccgtagggggcgaacaccacgccctcgcggtgggggcgcagccggcgcacggtgggcggccacggccgcgacgcgaagtcgaggtcgtgcgtgcgcgtcacctcgcgcgcggcgtccgcggacgacgcgacgacgacggggacgccgccgagctggaggcgcatgagcggcgcgtcgtcgaggccgcgcgctaggtccgccatggtgcggtggacgagcggtccccggagcatcagctggtggaggttgccgacgaccggcagccgccacgggcccggcgggaggcgcacgacgtcgcggcgcgcggcgcccagcctgacgaggagcacgagagccaagaaggcgcatgcgcagatgaaccagtacgcgacttgctccatggcgaccaagctgcgcgtttagatggatctgtgagtgcaagatagaattgcaaaagcctaggccttgcaagcgtatatgtagaggtgagagtgtgagatgagttgcatttctacgtgccgacgtagtggctgaccttgctgagagataatagatttaaataaaacccggcctctgtatcccttggatataatgctctatcttggagatactattcggtgaaca

SEQ ID NO: 6782 - DNA, 724 bp, Oryza sativa
  unsure (1)..(724): unsure at all n locations
nttggttcctttatttggcgatgaactactactacccttgctgatcaggattttttttcttgtctcaagtccatccagtttgctcggattttgattgttgcgtgcgtggagtattgtactgacagcggtttcttcccaagaatttttggggatttttggggattcagcttgagccttcatgctccaacttaggtgctgctcctgatgcgtcttatgagtgtcggatgccgccatggcgctgcgagggcgctgcaaccacttccactctgcagattgtctatctcatcatgtacgcaatctagccgagatgtcagcaatgttaacctcacggtggagaaagaagaggcggcgaggctgatcaagaattcgctctcaaaggcacgcaagtggagtgtacaggacttgattcagtgccttggagccgattgttcgggaatccggcttaccggaaacattgtggacaccttgctgttcaagtttggggatgactggaaatcggcattgggcttctttcagtgggcgcagtcgagggatgattacaggcacacggcttatgcctgcaatcggatggttgacctgcttgggaagataaggcagattgaccaaatgtgggagctgttgtctgaaatgcacggcagagggttggtcacggttagccggttgcaaagagcaggggtcggaattttcaaaatnnggggtgttctccaggatcttaaggcaacgt

SEQ ID NO: 6783 - DNA, 1585 bp, Oryza sativa
  unsure (1)..(1585): unsure at all n locations
cggtgtnaaaatgaacgnctgtggcaancnnnnnnnnnnnnnnnnnnnnnnnnnnnnnnncagcgccaatgaccctaacgctgagaaaagggtgtatttctaaaataagtttttccatatacctatttataaataagtggtttttaaaagaactaaaataaaaaaaaatccagttctgcaaactccactgtacggctagccaccggcatcgttcaaaacagccgttcaaaacaccacaacgatgcagcttgtccgccctcttatcatgtgctgggcaactgcccatggtggttgggcattggctttttcactgatcatcgcactgtaagaataacgataagccatgtagccttgtattgctaagtcaacccaagccatctttgaaaaatatataggaacaagccattaatttttgttaatggcatacatagaatatcttgctcgttacatcgatagaacttaaagatcaaactgaagaagaaacaaactaaagaagatacggtccaactttttttttaattaaatatagagttttaatttatagctgcagactaacgttgatgtcggcgaaaatacttaataaattaagagccaacagacaccgcagaaatacaccaaaaagccctcagtttttggaaggggaaaaacgacatgtctatgaaaactctgatttgcactagaatggagagtagccattgtactaaaataaaattttgcccattccatagttcaatcttttcataactatcacgcaggagaatgatatagcacataccctaggagctctttttcatacccgtgcttttgcaccggggttaggagaactatgggtgaatggtttaatgggtttcagttttatctctcagtttctaaaaaaaaaaaaatctctcggttttattaattttggattattttttgcgtggaaacattgttttcttatgtggtggctaatatggttggagaagagaatgacgactctactctttacagcagtagagaaaagtataacttttgtctagtaaactaactagagaacagagatacacataaagccctattttgtgggtgttaagatttaaggtagaatcatgaactcgcaactccaccttcttcccacgctctattgggtttaaaacgtttttttaggtaaagttacttaaagcactttttctccgtcttaattgtgatcttgtattattgttagtttggcgccctttgccaggtccaaattaagaattacccccctgttgcctaacccaaaacacccgacaagccagcaaattaaatagttaaattttgagcataaacctattcttttagacaattaacatacctattcctttcacagagtttaaattttcgccaagcttgtacctttacgcggcatttgatatatagcgggttaattacttagtcgatcgagagctgaaattccgtggaggagaaaacgtacgaaaacgctttaaatcgggcgtccgatgccagcactctcccctatcttctctccccacccactttccccctttctctgtcttcttctctccaccattccccttttctctctcacctagcaacgagaggaagn

SEQ ID NO: 6784 - DNA, 910 bp, Oryza sativa
  unsure (1)..(910): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactagtcccagtgcttgtgggctagttgctgaattagctgtgcatatggtagacgctccttccttctgcttccaaactagctcgaacaaggccctcaattttgatgctgctggatgtcgtaaattatgcgcctggagtatcgcggtaacctgccctacaaatcatcatatgtgcttggaggacggcacagccataatggccgcgacttgcggtactccgagctgttgtcgggtgtatgtatgtagccatctttgaagtgccatggccaggccgcaaggtgggtaagcaatgagaggaccaaatggttctttgcacatagtgaattagtgatccaggtgctaaagctcccagcggcaaaaggtgttgcccagcggcttatagatttttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6785 - DNA, 1282 bp, Oryza sativa
  unsure (1)..(1282): unsure at all n locations
cgtgggccccacccgggccgacgtgacgtggagcggggcgcgctttgactttcttcgagaaggtccgcgcgcggacgcggattcctacccgaactgaggatgacgtgtggggcctactatagctcgggaccacctgtcagtgaccttgaggggtcgtgttggggtgggtggtncggagatcgnccgtcttttatcgagcacgcgggatctgggtacggtttgggcgcgccggaaagcgaggtgacttggaggagaaggcttggtgccacgtgaaaaaaggtgcgtggctgggttattggagggaaggatgtaacgggtacgggttaggtacagaaagagaaaaaacggaaggttagtcgttcgctccattttccatgcgattttcctttttaataaaagggccatattcggcccaagaaaataagggcctaaattgtaggccttttgtataagaataagtccaccttgactcccttaaaagtgaccgaatctaatccgtgtccctgaaccgcaaaaccagatatcatggccccctcaactgttaaaaccggtgcaacttacctcccttagcagttttggagaatggctttactgatgtggtgtctttgactcgatccaactagctaactcagcttgtgggacctacacgttagtgtcacaattttatctctctcctttctttctttattcctctctttttcccacgctgtctaacagcaaccgaggcggatgcggattggcaacgatagcgccgtcgcggccacacctcacggcgcggggtacggtgtccacatcgctgacaccgccgcgggtggcgcttctttctcccgctccgcatggtcgacctcgacctccgcgacagccacctcgtcggacacggccatttgctcggcgactgtacgtctcgcgccgccggtggcatcgccctcgcctctattttcccccaagcgtgcgtgcgtgtacaccacgtccacggcgcacgtctgcgtcaagaacgtcgcgccagccggggcacccacgtcaacagatgggttcgcttctccgccgcgtcgatagggttcagctgaagaaaaaaacatcctccccttgcacgttttcagtgacccagataactcctctgctcatattgagtttcttcatgtgggttatgtctgcctgaacacagttgctaccactggtttgttggctttgccaannnnnnnnnnnnnnnnnnnnnnnnnnnnnnnnnnnnnnnnnnnnnnnnnnnnnnnnngtatactatgtatcaatnnncacccgcgcg

SEQ ID NO: 6786 - DNA, 723 bp, Oryza sativa
  unsure (1)..(723): unsure at all n locations
accgctgccctgaatgctctcgcctctccccccanccaagggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgctgtcaccctggaagtcagtggaaacaaggtcctcctcaacgtatccaaagatgcccttgagcttgccctcagcctcctccctgagaagatgtagcaaaattagtgaaacattcaaggcagccaataattttcttttctgaaaacacaagccgattcttctcggtcccgaaatcagaagttcataaagatttacagagcccatagttgctaagaattactcacttgattgcagccttgatctggtcatagctggcgggcttctcaagcctaacagtcagatcaacaaccgaaacatcgactgtgggaacaccgaagccattccagtcagctttccattgaaggcaggaaagcaccttgccacagcctatgagaaaattgagtaaacctaattgagtacaccattaaacaggtttaatg

SEQ ID NO: 6787 - DNA, 736 bp, Oryza sativa
  unsure (1)..(736): unsure at all n locations
ccaaccatttatatataaaagcatgataatgcaggtaaagaacccccatggtatgtagcacaactacgacatagtagcttgttccaagggcacacggactataggatgcagataaagagcattcttcctacccacagtgatgcccatctcatctgtcatgtctagttcgttcggtgcaactcctttagggagctcccagtcgaagtggtacagaagcattgcaagcatgagctccacggtagcatgtccgaatgtcatgccagggcaaatcctcctacccgcaccaaacggtatatactcgaaatttgcacctttaaagtcgatctttccactgtgaaaccgttccggcttgaacacctcaggctcatcccagtgcgtagggtctctgttaatcgcccatacgttaacgaacacggtgggttcaaattttgaatttcaattatggctgataagctactagaggctggagcgatgtagaatgcgaactggatgggagggtgaaaatgatgagcggggattgcgatttttttacttactttttttaacttaaaatcaataatatgtggaaccgctattcagaaaggtcatatgttagtgatcacgttaaaagaaaaagtaaataatactaaaaacgtttcacaatgtaagtcattatagcatttctctcacatttatatnnnnnnnnnnnnnnnnnnnnnnnnnnnnnngtgcnttgtgcacgcacactgaagacatt

SEQ ID NO: 6788 - DNA, 879 bp, Oryza sativa
  unsure (1)..(879): unsure at all n locations
aatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgatccgcgcgcgcgtagtccggcggccagcgactcgaccgcggcgtgcaggcggggagccggccgatggatagatggagagagacggcggatttgacggcgtggaggacgtcggagcggagggcgaccatggccggcgaggtcgtcgtcggcgtcgggatgggagaggaggaagagcttgcgggccggcacgagcaaccaggtggcgctcctgcttcgcctcctcgccgccggcgtccatgtcgtgccggtcactgacgagtctctcacttttttcagaacattttttttttttgagaacaacgagtctctcactctcttgctgttgccgactgccgagccgaactgaaagaggccatgggccggtttcagccacgaaatgcctttcagttcgaaaaagttctctccacgtacattatgtacgaggtagagtttcaatcgcgtcgcccaattctaaaaccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6789 - DNA, 729 bp, Oryza sativa
  unsure (1)..(729): unsure at all n locations
ntcgctggcatcactagtagcaagcatcaatagtcctcgccgccgtcgcccgtcgttgtgctggtcctggcatcactagtagcaagcattactagtagcaagcatcaacagtcatgaacaccagtagcaagtatcaatagtcctcgcagccatagttgtgttggtcgtcgtcgttgttgtcgcagcgctgccgcccccgtcgtcgcgcagcactgccgccgccgctgtcgtcgcagcgccgcccccgtcttcgtcgtcgtcgtcgtcgcagcgttgttgccgccgtcttcgtcgcgcagcgatgccgccaccgtcgtcgtcgcagcaatgccgccgccgccgccgtcgcagcgctgcccccgtcgtcatcgtcgtcgtcgcagcgccccgtcgctgtcgcagtgccgccgtcttctcccctccgctccttggctgctgctgctgcatctgaggggagagaggagagtgctaggagagagcatattggaccaaagggcaactaagtcattttactgcgccattacccaccgttacaacaaaaacagacggaatagtgtggagggcacgataaagtttaacgatggcagagagggaggcttaaactttttagtggcacagaagcaggcaccatctttcttaatggcatataggaaaaaacctcgttgactggtgaggggggtaccgaattcacaaatctnngggngcttacgaaggcctacagagnaacgt

SEQ ID NO: 6790 - DNA, 1547 bp, Oryza sativa
  unsure (1)..(1547): unsure at all n locations
nctntccctccctccctccacctaatttattttttttttcaccatattactttcctattttagtaaatttatacacctaaagtttatacacctcaagtttacatatctaaagttttttttgctaaaagtttatatatccgattcaaatttgaatttgaattcaaatatttttatatatagtatttctatacatctaaagtttatacacctaaagttcatagacctaaagttcatatatccgattcaaatttaaatttgaattagatctgatttaaatttgaatttaaattcaaatatttttcatatatagtatttctatacatctaaagtttatagacctaaagtttatatacccgattcaaatttgaatttgaattcaaatattttctatatatagtatttctatacatctaaactttatagatccaaagtttataagtcaaaagtttacatacctgattcaaatttgaatttgaattcaaattttttatacataattttttctaactttctgtttttttttaccccccgcgcggggaaggcggaagagagaggtcgcaaattcaggatatctcttgaaaaaaaggagagaaaattttcgtgccttaatcctagttacagattcccgagaaaagattttgagtatcacagtcacagagactagaagaatgaagaaaactttggtcaaaaggaaactgggaaaaatactactagtagttcataaaccactaccatgcacagagattcaaaatgaagatcaacaaaagcatcactagatcaatcaccttcagaactaaaaaggctagagatgattcgtaaacaattaattcaaggtgtctcagtctagcaaagtagcacaaccaaactactactatcaacgggtcggtgctattactcgtctaccactaacaggatcagaattcagaatatataagttcccaatcggaaagaccggaactggcagtggcgtcgaccttgacctcgtcgccggtgttgctgtcgtcagacccggcattggcagtgggatcaacctcctcgctggtgttaatgaagaagtagttgtccacaatggtgatggttgcagtcgacaacgacaccacggtggcttcgtcggcagccacggcggtggtactgctgctgccgacggcagtggcagtggcgtcgaccttgacctcatcgctggtgttgctgtcatcagacccggcattggcagtgggatcaacctcgttggcggggtcgttgttgtcgacatcatcgccggtgtggctgtcagtgtcagtgtcggtgtcgaccggcggaacagcagggtaggcgccgggcttgaacagaaccaggatgacggtcgtgttgtcgcccgatggcaagccaaactgaacaagctcctcacagatgacacgcgcttctgcacccttctgcatagcgatattaattggtcacagcaagtcagcaatatttggccacagcaaaaggaacaacangtttaacaacgaaacantcgannnnnnnnnnnnnnnnnnnnnnnnnnnnnnnnnnnnnnnnnnnnnntt

SEQ ID NO: 6791 - DNA, 932 bp, Oryza sativa
  unsure (1)..(932): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatctactttacaatattatcaaaccaggactttaggccgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6792 - DNA, 1422 bp, Oryza sativa
  unsure (1)..(1422): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccaataactccggagggacgttgcaatagttgttttttagcgcgtacactcggtaaagtatgcccgctaaacaaatatatatctgggacaggttccacagcggggaggagtttctggagtcgatcacgtagagggtgaggagcttcacggggttcagcctggacgtcctgttccagtagtcgaggctcgcctcgctgatcggtggaatgacgcgccgagcgcaggccagctctgggaagggctcccagcaaatgaacagcgccttcggaaagcaccagcagttgagggaggtcatggcggagcaccggcatcttgatgattgcgccatgaagcagaacttgttggacccgctcgtcaggatctagaagtaagacaccctcgacgtgcctctcaccaccggcaacatcaaagccgttctcctggtatgtatacattaaatttgctttaacgtcaaacccgtcacagatgactcatcacagatgccaggttctatagtagtgggtgataatagtgtcattttcgctttgtataatgccgtaatatatacacaggacatctttggtgcggggagtgacacatcttcacacatggtccagtgggtcttgtcagagctaatgaggaacccagaagcgatgcacaaagcacaaatcgagcttcggagtacccttcaagggaagcagatggtaagtgaagacgacttggcaagcctgacgtacctaaagcttgtcatcaaggagaccctgaggcttcatcccgtggtgccattgcttctcccgagggagtgtcgtcaaacatgcaaggtcatggggtacgatgtgcctcaaggcaccaccgtgttcgttaacgtatgggcgattaacagagaccctaggcactgggatgagcctgaggtgttcaagccggaacggtttcacagtggaaagatcgactttaaaggtgcaaatttcgagtatataccgtttggtgcgggtaggaggatttgccctggcatgacattcggacatgctaccgtggagctcatgcttgcaatgcttctgtaccacttcgactgggagctccctaaaggagttgcaccgaacgaactagacatgacagaggagatgggcatcactgtgggtaggaagaatgctctttatctgcatcctatagtccgtgtgcccttggaacaagctactatgtcgtagttgtgctacataccatgggggttctataccttgcattatcatgcttttatatataaatggttgtggcgggcgtgccnacttcctcaantntcnaangcgnaggtggcgcagggntaccgganttacgaggccagttn

SEQ ID NO: 6793 - DNA, 958 bp, Oryza sativa
  unsure (1)..(958): unsure at all n locations
acgcgctcnnattgatgctatcctnnnnnnnnnnnnnnnnnnnnnnnnnnnnnnnnnnnnnnnnnnnnnnnnnnnnnnnnncgatacaaaggggccaaacataatgtgggagttatttgctctttattttcagatagtgaaatcatctcgcagtaaaattgctcttctttcaggctaaaatcaaagtagatgaaaatgagatattgtataacgtttacgctgaacacctgtatttctttgttggttgaaaaatgaccctattaatattgtgcgctcagccaataccataattgctctctacgttgacgaacaaaatacaaactagtgatccataacagatatatccccccatagtgaccagaatacttactgatatgcattatgtatcaggatcagcttctgcaacatgaagagcccatatgcatatcaattccaaaccagttggaatgtcctgatttctttctataagaactgatgagacatacatcaggtgcagcgctatcaatttgcaagaagttgcaaacaacacatagaccttctgacatatgcttcaggatgttgtgaaacagctctgttgaaacaaaagttaatgtcaaaattgtacctaactaataaagttccttaacacaggaaatgtctgtttaggcttggagtacccagatcttattgtatcaagaatagctgtggcaacagctgatgcttccggatgcattgtcatgcacttcatacagacgccaagcatgcatacaatttacctaggacaacaaagtagcgactgagcaaatcgataccatattaccatgtgaccttttatcatatcatcgcctgagtgggagcctaaagcgccgcttaacccacagctaccacggaatctatttttgcccctcgactgcaatcttagctttcagcaccattccagatttccgataagtaaacctgccgactatggacctcttct

SEQ ID NO: 6794 - DNA, 2204 bp, Oryza sativa
  unsure (1)..(2204): unsure at all n locations
agtggttgnnaattganatctgctctgacnncnnnnnnnnnnnnnnnnnnnnnnnnnnnnnnnnnnatccagaaggaaggtgccctcgacatgcctctcaccatggacaatatcaaagcagttatccaggtaattaagcacatttgctaatgctccagtaaagaaatatacaatgtttaacttttttaagatctttgaagaacaacttagaccacagatttgtattacaaataagttaaaaaaatctaatagtaagttctgtaggactatgaaagtattgattttcaggacaaatctacaaatatcatttttatgttttcaaactgtattatgaaaattaatgagagaagtttcaaaattttggctggaccttcttcaaaacgtcatatattttctaccggaagtagtactgtgatgaatgtacatcagtggcacattggttttttgcttgacattgttaaatcaatttactaaattctacatcggtatacaggacatatttggtgcgggaagtgatacatcttcaaatataattcaatgggccatcaagaaacacccttcaaggaaaacatccagtgaaggaagatgacttagttaacatcaagtatctaaagcttatcatcaaggagactctaaggttgcatcctgtggtaccattgcttcttccaagagagtgtctccatgcgtgcaaggtcatgggctacgacgtgcctaaaggcaccaccgtgtttgtgaacatatgggcaattaacagagaccccaagcattgggatgaccctgaggtgttcaagccagagcggttcgatgatggcaagatcgacttcaaaggtgcaaactttgagtatattccgtttggtgctggtaggaggagttgccccggggtgacattcgggcatgccaccgtggagctcatgcttgctacgctcttataccactttaaatgggagcttcttgaaggagttgcgccgaacgaactagacatgacggaggagataggcatcaacgtgggaaggaagaatccactttggttgtgtcccattgttcgtgtgcccttgcagtgagccaccacccgccgttggcaaagcagcattacacaccgttgggcgctctgcttctctggctgtctgctctgcatttccatgctttatatgtgatcgttgtgactgaataaatttgctgttcatatctccttcgtacgacttcttgtcagaaatgaacgtatgattttcgatctcatttgtgatagagatcatccattattgtgcgtgcagtttttcgttttaacaggtcaggctgtgcgataaaacaagagcaagttacagagctaaaatgccaagatagaagaaaacagagcaggggcagagaaatagtctcacctcaagtttacaattcttcagttttcagaacagagatacagaaactctgtacctccaagttcacaattcttcaattttcttgtttatcagttcctgcaatcattctggaacacctgcttatttcgtccttcaaatttttttttttgattcaatcctcgtgtgcaatggagacttcccaattgaggcctaatggcagtccacatttcctttgaaaacgggcattctacaaattctagagataaatcctcgtgtgcaatggagacttcacaattgaggcctgatggcagtccacatttccgttgaaaacgagcattctacaaattctagagacaaagcggacagaagtagctcctggcttgctgacctgctggtggttttctcatccccagcgagacaatgcacttgcattaacgataagttaggtccaatttttatcgatggaggagatgggtttcgatcaatcaaggtgggctctaaggggtttggccaatgactaaacagcaaacgttgtaaatcaggaagaaactctggcgcgcgcacatagggtttagggcgcgcgtatttaagaagcaaccagaaaacagagcaaatgcatctgcgaagcaacacttcgatttagattaagcgcaagaaaattagacacaaaatatgagccatgaccaggcccaaccaaccaccatgatacaaccaagtatagttttaggtttcgacggacataaaaccatacagaatttaaaatttattctcggaagaggcttcatctactcttctctggggcaaaacacaaattccctgtatctgcaggcctccatgaggagggctcgtctt

SEQ ID NO: 6795 - DNA, 2985 bp, Oryza sativa
  unsure (1)..(2985): unsure at all n locations
gtanccatatgacccataataatcaagaactgcaatgggtaatttaccctgctgtcaccctggaagtcagtggaaacaaggtcctcctcaacgtatccaagaatgcccttgagcttgccctcagcctcctccctgagaagatgtagcaaaattagtgaaacattcaaggcagcaaataattttcttttctgaaaacacaagcagattcttctcggtccagaaatcagaagttcataaagatttacagagcccatagttgttaagaattactcacttgattgcagccttgatctggtcatagctggcgggcttctcaagcctaacagtcagatcaacaacggaaacatcgactgtgggaacacggaaagccattccagtcagctttccattgagggcaggaagcaccttgccgacagcctatgagaaattgagtaaaactaattgagtacacgataaacaggtttaatggtgcccgatacagaaggttcagtgtagttttaacaaaacacaacaaaaataaggtggttgccacattttgtgagatccatcattccatctgattaaacaccgctactgttatttggcaggcaacgaaacaaaccttaattttgcaaaggaaaaggggggcaaactagcaaggagtggaaagtcaattttttaatgttatacttgcattataaagtaaatacaaaacgataccacgagatccttgaaacatatcaatattaggtgcaaatgtctgataacgaaacattatcaacaatgtaatacatacagaaatacaagtttataccttggcagctccagtgctgctaggaatgatgttgaagctagcagcccttccacctctccagtccttcatcgagggcccatcaacagtcttctgggtagctgtaggaattcaaatgttaatcacttgaattgaaatcagatcagatagatggtaccaaacgttttactcagtccaatattaatattaagcaaagtgatgcctaccagtgatggcatggacagtggtcatcaaaccctcaacgatgccaaatctgtcattgatgacctgtaacaagacaaaatgttagcttaaaactccagtagtagctacatgcgcacaggagcaggcgccaaattatatcagaataaacaccttggcgagannnnnnnnnnnnnnnnnnnnnnnnnnnnnnnnnnnnnnnnnnntaacgtcagacttgtactccttctcgttgacaccaacaacgaacatgggggcgtctttgctgggagcagaaatgacgaccttcttggcaccaccctgcatatgaaaaatgattgagaacagatctacagcttgaccctgaacagaaaaattgacacaggaatgtaccttcaagtgagctgctgccttgtccttgtcggtgaaaacaccagtagactcaacaacgtattcagcaccagccgcagcccatgggatctcctcagggttcctacatcagaatattggcttatcagactggctgtaactcttgtgagcagatgaacaaaaatgatactgaaatggatggcaacaaacctgcagccgaacaccgcaacctctttcgtgccaaagatgagggtcttggagtccttgaccttgacctcatgatgcttccactggccgtggacggtgtcatacttgaacatgtatgtctgcacgcaacgacagtccaatttagcatatacaacagatcaaaccaaaattagcattctgtactatcaaggaaatcaggtcttgtaggtaggaacgccattcaagtactcaactacacatagtttctaaatgcattgaagcatgcaaaagagacccacatcagtatgcatgtctgcatgactttataaatactgtagtgtaatagactcataccaatcatcccatccatagcaccatcagataaaagaagagatgaacacaaaccatctactatatggatctacagaaatattcagtcaaagcagacaagaattgcatttatgaatccatggtataaacagagtgcgttgtggtccatcagagcagaacgacagtgacatctacagtactgcagatcacaaatccaaacaaggtttataacaaatagtcctaacaaatctaccaggatgcctcaatcccaattgatgggcaccgaattcgtgcaattcaatttaaccgaagcgagcacaatcatcatatcatacattctcaaaagcaccagatcaactaattcgcgggggaggcgagggaaagagacggtaccatgtactcggtggtgatgaagggatcgttgacggcaacgagctcgacatcctcgctctgcagcgccacccttgccaccagcctgccgatgcggccgaaccctgcatcatccaaaccaaaaaaatccatcacaaatccgcaccgaataaaccccataccataaaataaccagatccaatcgtatgctcgaacactcaccattgattccgatcttaatcttgcctgctcattccagagaaaccaaaaaaaaaaaaatcacaaaccaatcagccaaaaacacatacaaaatcaaacccaaaatcaaactcaaaataaaataaaatcaaagattggcggatttacccatgagtgaaagagaggcggagcaaacgaggaactcaaaaacgaatggagatcgagaggagtgcaaacgcaaagctgtggggatccgatcaccggagcggggcgggtcgggtttatataagcggcctagggtttgtgcctcgttgcggggcccacgggagtaaacgtggcacgcgcggcggcgggggtggttttcgctagacggtgggcccaccacggccgccgcggtatgcggatcggcctcacagtttctaaaccccccggaagaggcggcgcccaaagcgcggtggcgggcacgcgtatgacatgcggnnnnnnnnnnnnnnnnnnnnnnnnnnnnnnnnnnnnnnnnnnnnnnnnnnnnnngctataagatttgcaaacaaaggcacacg

SEQ ID NO: 6796 - DNA, 2321 bp, Oryza sativa
  unsure (1)..(2321): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnatgacgtcttccagacggtacagaaagcgacctcttcgaggaggaaaaaaaacaagggaaaatggaaagggacgtggtgaaatcatttgtcaattaggtagagtttggacgttcttttgaacggaacaggagttgatgctgatgttggttgaactgttgaagtttctatggtagaatatgcttgatcgtgctggtgttgaagttgttggtgctacactgtcatgtcaatgcgttaaaaagaaaaagaaaagaggatgtgcttttcgttttggcctccttaaaatagtagactgtacctaatgttcccagcaaaaaatactactaataataatataataggagtgtatgagatggcttgtggagtttgagtgtgccaattgttgtcaacgcaagtgattaatacattatggtcttgtttagttacaaatttttttttaaacttttaattttttcatcatatcaaaactttcctacacacataaactttcaacttttctatcacatcgtttcaatttcaaccaaactttcaattttagcgtgaaataaacacaccctatactacatctgatccaaccttctccaaaggggaatgcagcagagtgcacattattgggccacatatcgcaacctcgggattgtaaaatgtgcactccaaaaaacagataacgttgtttgcccgaactgacgttcgaacatctttaaaagaaaaagaactgttcgagtgtcgaaccatgtagtatacgtgtacacgttgaatgtgcactcgtgataaaccctttttcgaacggagagaagttgataaaagcctttgcaggaatgggctggctgggcaagtcgaaattccaccgatcctctttggatgggtcacgtcgcaaggatcatttgattggaatggggtgccgcgaagctatacatacgtggcacactactacctcctcgtcagtctgatgacaacggccagctcgatcatctcgcgaggcacgcgtccggcgggcgggggccgtccgctttctcgagaagcccgacgatacccgtgacctgtatcggagctgtatcctcggtctcccaccttttttcgatctccggcagctgatggctaccgccgtgcccattggtaccattttgtttccgaaattaattaattaatactccgtttgcttaaaatgcagagaagatgaaagtgcagtttgcttaatctgacgccgacaagataatacatggtcagatcaagcaccgatcattatcattgtctaaagaaaaagaaaagatcaagcaccgatggtcgcgcagaggaggcgtccgagcagaaggcgggtcggaggcatgaagccaaaaagacggccgtggtccgtggatcggtggatcggcttcacggcggcagcggattagcgcaagatgctggctggatggtggaaagcgtctcaaactctcaaggaacaagtagcagagcgcttcagaagctcggacggctggagagctggagagagatcatgcggaagttctggcaagcagcagaagagcgggccgttttgcactccacgccaatttgggtcggaacggcgtccccaagtacctgttgggcccaaacagaactcccacgtgagtggtccatattttactgggccttaaggcctgcagtgtgtggacgtggtgggtagtgggccttacgtactggacctccaatgagatgctgcaagtagggaataagtctattttctctccttcatttcttcctattgaatgaaccgcattcctcaaccgcaaaaccgacaataacgcctcccccatctttcaaaaccagcacaaatcaactccttcgatattttaggatgtgatttctgctaatatggtaggttgaccacagttgacacgttgagtcagcaagtggagcccacctaccatggactattttctttcttgtgtgggtaaaccaagaaggtgggggcaagcgtggggtgcacctgtcggcctttgcatatgctccttttcttatactctcttctttctctcctcgtcactcatcttcttcctcactcctctcgaacattgctgagtgacacagtgataataaggcaaaaaaagggtgatggcaatgggtaggaggcatttctaccctcgacctccacctgcctttttccccacaccaatgccatccaccactcgatctcctcaacctagccacctctcgcagagccagaacaccactagcgatctttgctctccaatagccataaccn

SEQ ID NO: 6797 - DNA, 1748 bp, Oryza sativa
  unsure (1)..(1748): unsure at all n locations
cgcgggctcaaccgtgccccccagtcggatacattggtcccggcccaacgataatcctccggccctgctttgttaccaatccggaagcctcttctccaagacccgcatcacccatcgccaatagtcgttgccctttgtgcctcattgcccccgtgccacttagccatgtttgaaaggagcgaggaggagagaaagaagagagtagaagaaaaggaacagatgcaaagggnaacaggtggaccccccccaactagctcgtcgcgttgaaagaagatagagtccctgttgggtgaggtttactcgatgattcagtgagtcaaccatgatcaactcgccacgtcagcaaaaaaaaaacgcctttcaaaccaccaaagtggtcaatttacgccggttttcgaagatggtggagacgttattcctatatggttttgtggttaagagaggtgattcaataagaagcaaaagttgagggaggcaaaatagactcattcctccaaataggcaaagccaacatttttcagtgctcgttgcagtttgcatctgcttaattctatctgaacgagtagctgcaatagatcatatttttctttttaaaaaacagtaagaacatttaaaaaatgtaaattacctatacttacattacatgtaattacgttgaaaattataaaacttatactataattacaatgtatattttaatatttacatcgaaaattttctaatacccaatatataagaaaattataatttaaacaatttattatctacatggaagagcttaaatatcggagagaggacaatcatatatggaaaaaaatggaagtgaaaaatgtgacgacataatttaagtaatcccgctaaaagcctcattgattcagaaaaagtcttcgtgcctcaatctgaatattcagttccgaaattcagcaagaacttttggtggtctggccctgctgctatgagcctctgactaaacccatgacaccacatacctgtaagagccaactactccctctgtccaaaaaaaaaaaaggcaaaccgtgattcccaacatttaacggtcggtcttatttaaaaaaattatgaaaaaaattaaaaagccaagtcccacataaaatattaatcatgttttatcatttaccaccaatgaaaatacgaattataaaaaaatttcatataagacagacagttaaagttggacacggaaacccagggtttgcctttttttttggacggagggagtataagcttacgtggataagagaaaatttgaaaaaaaaaagaatatagttggttctcatgcaagagctatctatcacatactccataataaatgcattaaatgcataggcgagagatagagaggagaaaaatagaaataaccttataacttatcgactactccatctgtcccattttaagtgtagttgtgggtttccgtgtccaatatttgacaatacgtcttatttgaaaaacacataaagtatttttatcgtctaataacaataaaaatattaattacaaaaatttcaaataagaaggacggttaaacgctatacacagaaacccacaactgcaaggatggagggagtataagccacctaaaaaatcaacctcataatagaatgtgatatattctagtataacaaatctgaacatactatctgtccaaatttgatatgtcacatcgtattataaggttatttttttatggagggaataagagcatcaccaacctttctcttatattn

SEQ ID NO: 6798 - DNA, 5067 bp, Oryza sativa
  unsure (1)..(5067): unsure at all n locations
acgcgnattganaactgatatcgcttgcccgcgcnnnnnnnnnnnnnnnnnnnnnnnnnnnnnnnnnnnnnnataatacttcctccgtcccagaaagctagtcatcccgctgttcagaaaaatgtcccacaaaatttgtcgttgtagcatcttgaccagcgagctaagcctagtctatcccatcgattcatttgaacctgctatttagtatactacggggccactactagtactacccatgtctgtgcaatgcgatagatggtctgctagaagtgattagttaattatctacagtacaatctgaagtgacaaatgcaataattaaatgagggtaattagggtttagggtttagggtttagggtaatatggtcatttttacttgtcgctaatttgttcactcaaccttaaaacgacagcatttccaggaggaagaaagtaattctgagaggtgtgaaacaacaagtaaggcgattctgttggcaaagttgaggattttgaacccgaggaagtttcctagcaggttcgggctggcgccggacgggcgggcgagcgagcgagcgattgcggaacgcggcactgacatcccacagggccacagccacataatccacccccgtcacgccaagccaccaacctgttccttttgccgcgcccacgttccctggatttttcacattttggtccttttaaaaaacttatttcgcaagtagatccctagaaaaacttatcccaaaaatggttctttttggggcgccaaagtggctggccccgtcgttcaacgggacggcgccagcctctttggcgccgtcccaccgccgacgtggcggggcgatgctgaggtggctagggggagtgcgccagagtggctggcgcccccccccgaaattttttatttttgttttatttgtttgatattttttgcacgcttagggacacacaagaaccaaccatagaaaaattgaactcaaatagacgtaatatgtgacatgtagaatttttcctctcctctcctctctccgaactagtgcagaggagagagatgtgcaacttttttatttttatttatttttttgatatttttttcacacttagaaactcacaggaaccaaccacgtaaaaaataaactcaaacggacgaaatatgtggcatgtggaattttccaaagctccaccgaaaaacttctctcctcgaaaacacaatcttgcaagcggaatttggaggttttaatatcgccgaacccggcaaagcgggggagaatcggatgtaactttttctgtagatgtccgtgcatatattatttgcctgattccgagtccgtatgagaaagttacgcctattttaatagatgtcatattttgtccgtttcggtagagttttggaaaattctacatgtcacatattttgtccgtttgagtttattttttatacggttggttcctatgttctcctaagtgtgaaaaaaatatcaaaaaaaaaataaaataaaaataaaaaaattgcatctatatgtactgtttaacttatatatctcatttcatgtggttatattttgaattagattaagtaatttcatatggtggtagagtgcattatgtttaacatgctgatcaaaggattttactaaaggagctatggttatggtctaattttagtgaaggtgcaaagtagactaagtggtatgctagatattttcagacttagctaagtggtagttcgagtttaattttttttttggttgtatcatgatcctgagtgtgaaaaaacatccaaaaaaataaaataaaaatgacaccgttgcaactccatacagagaaacaggaatggaggcggcggcgccagccatgctggcgccctcctccctggggcggcgccagcatggtatgctggcgccctcctcctgccacgtcggttcgcgtgcaccacggtggcaggaggacggcgccagagaggctggatgacggcgccagccactctggcgccccaaaaaggaccatttctgggataagtttttttaggggtctatttacgaaataagtttttcaaaaggatcaaaatgtaaaaaatccagcccacgttcctcccctccgtacgcaattacgttcctacacgtacgaactgcgagctctacacgacctggagttatcactgataagtgggtcgatgtgctgtatcggaccgacctgtcagtgatttcaccgcgcattggtgcaggtataacagaatacttatttcaaagtaacgtaccagcgtcaaaccagccagtaagctagaaacagtgaagaaattgactagaaaaggttaacgcaacacaagaagcggccaaatgcacacagctcgcatggactttatactacaaattgacttatcgtttcaaccgggggcccattctgtgttcccacctatattgccctcgatgcgtatataaaaatggtcgttgccactgccaacggagctcgatctggaacatatattgcacacgctctggcacaaaggcaaatacagtagaaaacatatcatcgacggccgatctcgagccaaggcaaatggatcccgaggagatcgccttcggcgaagagccagagccaccgcacgccgacggccgcggcggaggcgcagccaccactcgcgccgcgttcctgctgatggtgtccggcgccacgatgatcatcgccgccgtcggcgcgtccgcgggcgcgggggaccgggtgccatggcctcggctgctccccgagctgctgatttggctcgttgggtgcatcactctgttcgcgccgtggctctgagcctctcacgcttttgcagagctcagtacgattagtacatgtacaacgaatcgtgtcatttgtgtcgttggtactacactagtgctgtaccagtatagtattccgtacttttatcttgtagtctggtttgattagtgtctgcgtctcatcatatcgaatcgtagtttccctcttctgtttctttttcaaccataacggagaaatgctcgccggctagatggtgggctaaacaatctaaattcaaaacctcgctccttctaattatttgatattagataattctctaatatttatgtctttttcaaccatacagttgccgttagggtatctatcattaatctatacagactcgcttatgcacatgccagattatcagtcatgtttacttcttcaagctgaagtggtgggagactggaagtcaaagttaagcagctgatggtgccgccttatcccctttagataccaggaacgacatcaactagctcttatagtgaaaattaaagtctggggaggatgattatatgaccagagaaagacatataattaaatgtgacacattatcggttcaaattcgtagtattaatatgtcctatttagtattatgttactatattttagaacagatgtgataatatttaaaaatgttctatatttgagtatactaattgatggtttggtaatatttcgtgggacccaattatcatgtctatcggtttcacaacctgtttatgggcctgtttagttcgcgaaaataaaatttttggatatcacatcgaatgtttgactggatgtcgaaaggggttttcgggcacgaataaaaaaaaactaatttcataactcggctagaaacagcgagacgaatcgtttgagactaattaatccgtcattagcacatgtaggttactgtagcacgtatagttaatcatagactaattaggctaaaaaaattcatctcgcgatttttcccctaattgtacaaatagtttttgttttaatctatatttaatgctccatgtatatgtccaaagattcgatgtgatgtttttgggaaaaaaatttaaggaactaaacagggcctatatatatattgtgagtttgattgtggagaataaagaaagtactttgtggccaagtcatgttgatgggtccatgtccgtgaaaagtttaattctaaaaatatgcttggggaaatgatggatttgaccagatcaagaaagttgtttatcttctttgccccaattagcccgaacacaaccaatcctaaagcataaggctctgtttggtttcatgggctaatgtttatccttcaccttttagcctcaaattagccctcaaggatccaaacaggtgagctaattttgagctaatgtgaattagcctccctcaaaacattagcccctccaagaggtgctaatggggctaattttatgtggggaccatcaaaaagcacctctctctcttcttctctcttcttctctttctactctctcttcactttttagccttaaataagcccatggatccaaacataccaccctaggcttatggttagcctaacaattcctgactaaatattacctttcaaaattagctctgggctaatcttccaagcagatcctaaaagtcttggtattttctagacccaattatagtttcacggtgtgactgtattttattttggattttgaaaaacaagagagtatttatggtcgaatcatactttgccaactactacgatgggtccattatttgctcttctagagtagttaaaatatctttggatcacctcgttttttttttctaaaatatgaaatcatccattatattttaattaggaataaagtcaaccacgggaaaaaaaatcacggaaaaaaataatccacagagagagagagcgcgcgcgacggatatgcaacgagaatacgagatgcaaacttgtccttgacaaccggtatttggaccgttcgatcacaatcggacgctccatatcctctttgaccagcctctcccttctctctcacaaatactccttttctcctcatttccgtcgctctctaggcttcaagtccccaaaccaggcagcaaacctcgcgagaaagtaacgagaactcgagaggcggagttggaggcggcgagggagatggagaacggcggcggcggcggcggcgatggcggcaagagcgacgtcccggcggacgccannnnnnnnnnnnnnnnnnnnnnnnnnnnnnnnnnnnnnnnnnnnnnnnnnnngagcataaggatcgcaatcaaggcgcgcg

SEQ ID NO: 6799 - DNA, 9743 bp, Oryza sativa
  unsure (1)..(9743): unsure at all n locations
gtgccccccccattagaatgatatatctcctatgcacnnnnnnnnnnnnnnnnnnnnnnnnnnnnnnnnnnnnnnnnnnnnnnnnnnnnatagctgcagtgttttcagtttgggcctctcttaaaattatcagatttcgggttgttgtgtcttgttttgtgaattttggggaaaagagatggatgaattaaaattaataggcacacagatacctattcctcgctgttgatacatcttacaagagcactcgtatgaataagttgagcagttgaagctgaaggaagaaaattggggttgttagtagtcaacatccaaaatttttcataggagcgggatgaaagtatttattatgctcctcatctcattgtatggttttgttgggtgtgtgcgatgtgggtttgaggcccaatgctctaatctaccagctccaaagctggatcatgttgattgtgttctatgccttatggatagtttttacctttgatatttaccaaccagctttgttctgtcagttctgatgttttatattgggcatgaagatgccatataccacaatgatatgtcttcagtgttttttatgtgatttcataaatctattgttctaccttattgcatatataacagtacaaccaaacaccttgtaggttcttaggtagatagttcagatggttaaaaaaacagaagcaacgtgagtgatggaggtagcaaggcttggggctgacattgaaagcatgatgatcattagtttattactacactggagccaaacccaatcccaaacccatgaagaaatatgtggtccttactgattttccaaatctaatgtactgtcaggaagtacattttacttgtgagtgtaacattaaagagggaaagaaatggaagtgcatgatctggtgtcccacctgaaagttgaaacacagctgcctccttttctaaatagaatggcactcggaaatacttaaatgtttaacatacaaaaaatggagtgcatcaagaatgttaaagaaaaaactttgttggaaacccaatacggagaacacatctagtgatatccacttatccatgaaaatatttcacagcagtattgccacttaaaaaaaggaactcatgtgattgagcacctaggaagacaagttcatgttacaaaaattgtagttgaacaagtaaattctttcatgaatataattggtgtttctttcctacgtacttctcgcattcctaattttagccatgaccgattgttattcatagacaatattaattactgctgctttcgtccacacagtgaaataattattgattgtattgcctgattgtgtttgtagacttggttggtattgttgaacggatggctacagtaaaacacaagatactggttctgtctgggaaaggaggtgtagggaagagtacattttcagcccagctctcatttgcccttgctgaaatggactgccaggttggccttcttgatatagatatatgtggccctagcatcccaaaaatgttaggccttgaaggtcaggatattcatcaaagcaaccttggttggtcaccagtctatgtggagtccaaccttggtgtcatgtcaattggtttcatgctgcccaacccagatgatgctgttatatggagaggacctcgcaagaacggactcatcaaacagttcttgaaggatgtcgattggggggagattgactatcttgtggttgatgctcctccagggacatcagatgaacatatttcaatcgttcagtacctttaagccacaggaattgatggtgcaataatcgtgaccactccccagcaggtctctctaatcgatgtgcggaaggaaataaatttctgcaagaaggttggtgtgccgatcttaggtgttgtggagaacatgagtggcttgcggcaggttctctcagatttcagattcgtgaagcaaggtgagggaggcgagatggatgctacagaatgggcgctgaactatatcaaggagaaagctcctgagcttttgacaatggttgcatgcagcgaggtgtttgatagcagcaagggtggtgcggagaaaatgtgcaacgaaatgggagtacctttccttggcaaggtgcccatggatccacagctatgcaaggcggctgaggaagggaggtcatgcttcgtcgatcagaagtgcagtgctagtgcaccagctcttaaaagcatagtcaagaagctgatcgagaatcaagattgagtgaactttttttaaaaaaaggataattgaagactgagtgaactagtgatgatggtttctgggaaacgggatgcggagatatcgaagctcagtgtagatatacctgatactgtcccatatgttttgaagttcagttttggttgtgtagaactattctgcttgtggaatcactgaatcagtttttcagtctgatgtgaggaatgtgccataataaattgcatgatgctgcaagctcatccaaccagttgttcttgatatacattagttgcttgatttgcatgtttctgtctttgcgggttgaatatgatttaacaaaaccgattgcacataacggtagcgtactacagtttaataccgctgctactactgcctttgcccccctgtttatgtgggctttcggggctcggtttatctggcttcggcctgagtctctgacccaacaacatctatagcctttgtctatttccagatcggacaagcttggtccaaagcatgtccagttgcagaaaattgcatggtgatctagatcgccctcctgcttggtcttgtttcttatgctctcgtatactttcctccgttttacaatgtaaatcattctagtatttcctatatttatattgatgttaatgaatctagacatataatatcagtatgaatgtgtaaaatgctagaatgatttatattgtgaaacgtagggagtagcaattttatttttgctcgtgacagaattatagccggataaactgtcacactttgctcgtagtactagttagcatcagctttgctcgtactgttttggccggggacgctcggtctcggccaaaacactgggctctgctgctgctgctcagcgctgcgagcctgcgacgctgcgtcgtagccggataaactgtcacactcacactgaccaataaaaaagcatttagatcaaacgctttgaggtaaaaaaattaagccgcgtcagagcaagtttaatagtatagcccactacctgctccaattcatctatagccgatctaatagtcaattcatacaatagttgtttactatactattaatatacggtcccacctgtcatatacacactgcgtcttggagtccgtgctgtaactggctacagatctgtagcccgctgctcttctctcttatcttttatctcattaaaatatatttatagctggctaatagcatgctattttacctgctctcatgtgcagagaaatctgatacaggcagcctaacagtagcctactgctgaaacggacaaacaagtccgaataaacaacgagtggtcaacataaataaacctgcagaacgtcatactcccactccacataaagaagaaaaaaaaaacaaaaaacgagccccgttacaccacactaccgatgatgattgatgctgatagattaatcctgaatacctgatggctatgctttcaacctccgatgaaacgtgcagcccttcagggcggcgcgacaaacagcgagaggcagccgacgagccaggcgacgaacgccgcgaagaggcggggaagcgccactggcggcgcggcgtacgagctgacgatctcgtacgccgcgaacagcatcagctgcatcgcggcgaggcgcagcatcggcccgcgatgaatcgccccccgggcggcggcggcggcggtggcaagggcctggttcgccggcgccggcgcctgcgcctccgcctccttgctgctgttgccagcgtcgtccatggtcactggagcaatcgaattcggtggcgggttgggccgtacgtgcaggtggacaatggcgagaggtcgaggggatgggactttataggccttgtttgaagcgaatgttggaaattgtaccttcaattccagtcaactaggatacgggaagttgaatttgttccagccgaccatggtgttccagcaccatggtgttccagccgaccatggtgttccagccgacgatggatacgcatgtggatggtgacaatttttaagacaatttccggtgttccgttacgccgtgaatggcaaatctacgaagcttcctcgaagtttcgtgggcatgcacttgggcaatgtcaacaacaacacggcatgttaatatgatcttcaaatttccgaccggtattggcaaacgtcgatcagtcaatggatgttcacctgtgatgcagagtggcggatctagaatttaggatatgggtggtccgacctaaaattttttttctaaacacagtaaacctaacgatactaatatatacaatgtaactataagtaataaaatagatcaaattatcaaaaacttaccatgatatattaacaaaacatcttaaaatatataaaattagtaattaagtaaaattttgatttaaagaagcttgtacggctatgaaagcttaaagaaaattaccatattactttttcttcttatcgggtctacgtcttctaatggccatgaaagtgttcattatatcctcttcatccactttaaagaaaaagcgatacgataactccatctttcttcatgattcaacaatcaacaatctacaatataatactacaatttaatctcacaatgcacaagagtttaagattttaaaactaaaaattgaaaaaggtggacaattagaaaacctaaaactaaaattgttaccttgtgttggcgcgggcggctgatcggctcgacgacggctcctcgcggcggcgtccagcggcacacgaactgacgaacactattaaacagacagcagacagcaggacagcagcaggtcgccggtcacggcgtcgcgcgcggcggcgtggccgtggccgcgtgggggctgctcgcgtggtcgcgccgtcgcggcgtcgacgcgtcgtctctcctctcgtcggctcgtcggcgtcgctagccaggctagggcctagggcagttgctacggcctacgggctagggcggcgatgaggagagagacagagagtcgtgatcgcgtcagagagatcgcgtcagagagagtcgtgatcgcgtcgatcagatcgattccatacgcgtgtgtggggtctctggagccatcattagggaatagcgcgtcggcattagggaatatggattatgtcgctttcttttctttcttttcaattgtcgctattttcttttttttataattaatagggggttccatcgccctttttttggtggtcccgggaccacccggaccaccctttgtatccgccattggtgatgcacggatacgcgatactgctacgacgatatggatacattgatatcgtgatatgggattttttaaaaacatcaatacgtcgatacccacacatagggtgtgttcggataccatttttcccaactcatctttctcgttttccgcacgtacacttttcaaactgctaaatagtgtatttttttaaaaaaaagtttctataggaaagttgttttagaaaaatcaaattaatctatttttgaaaaaaaaattagctaatacttaattaatcacgcgctaatagatcgctccatttttcgtgcggagggatccggttgggatccaggaatagcgaacacacccttaattccttgtatgatcaacaagtaacttagctaatcagttaatgcacaaaattcattccatgacgcaaaaaccaacaaatcattcaacgttccttccatcaaggttaaaaaaaaaagaaaaaaaagtatatgcatggatcaagaatcattcttaagagtggacaaaaatacacgcacgaatactacaataacacacctctcagtgaatcaacaatgtcaactttctcattttctttccacagcgtgacaaaatcttgcacaccacacttgatcatcacttcttcttcttcttcttttttttttttttggagcgagaacttgatcatcacttgtcccgttaaccgcttgttcatttcaaaaataacagaccacttacctgaaagcaggtataacattcttaattattgttcaagccaatcgtcaaggataagatttttttttttttgccgttttacagcagggtcagtgcgagtatgtggcttggccacaatccatattaacctctttgaataggtgcatatcaattagtcctaccagatttttctctacatggatcaggtgccaagagcatacaagaatgaaagatatcaaaataatcaagtgtagaaataatcatacggtgataggaatgaaaacattaatgatttttgttttctcctttgcttaggaaacagatattagaaatccttgatacgtctgaccaatggtggtgtagtttcatagcaacagagagtgcataatctaacatattaataattatcttatatctccctgatatattttgaaaaaagaaactaagaaacaagtaaatattcatatgatttacattttgaaagaaaatcatgctgaaattagaagtcacgtagttgcagaggggcgacacaatactgaaaacagatcgaatgaatatttgtgcatacctagcatttgttggcaacaaactgctccattaaagttgtaatatataatagagtaaaacacaccggtggttcttgaacttgtaagcagctttcatttaggtcgacgaacttacaaagtatgtatcgaggtctctaaacttggtttattatatcatcccggtccaaagtctcatttgaccgtgatcttgcctacgtggcatgccatgtagacaacgacatggcacattattattattttttcttttttctcccttcttcctctttcatttctctcttcttcagcctcttccttcgacagcagcaacgctacgtgacgacggcggcggtcggcacgggggagctcgacgtggctccagtggaggaagaagataaaagaggaggaggaaaaagaaaatggggaaaaggaaaaaaaaacaccatgtcatcatccacgtggtgtgccacataggcaagaccacggtcaaacgacgctttggaccagaatgatacgataaaccaagtttagggacctcgatgtgcactttgcaagtttgtggatctaagtgaaacctcatgacaagtttaaggaccactagtgcattttactctatataatactccgttcctaaatatttgacgccgttgatttttttaaacatgtttgaccgttcgtcttattttaaaaaaaaagtaatgattaattcttttcctatcatttgatacattgctaaatactctctgtcccataaaaaccaacatagtactggatgtaacatattctagtactacgaatctagacatatctctgtccagattcgttgtactataatatgtcacatccaatcctagatttgtttttttgggacggagggagtatacttttatgtatacatatagttttacatatttcacaaaaagtttatgaattagacgaacggtcaaacatgttttaaaaagtcaacggcgtcaaatatttagggatggatggagtatttcatttagcaaagcgaagaacatggaaactggaaatttttcataatatgaaactttgtagcacttgcggttcaccttgttaactcagattaagcaggagactataccttattaacttagtaaaccgagcatcaaagaatgccttcatcggccattggaccgtccttttgggaactccaagaatataatattatccttcttcaattcatatccatgcaaacacaaagatcacaattcttcagctcatttccatgcaaataataaagatctcaattttaatgaaatggttaagtgcttgctcaccttgttcctcatctatagttagccaaaagactcgaggcccgacggcctgacccatagcacggggttctggtctagcccaagcatggcacagcctgacctttgggctgtgcctaggcctctgcctcgtcacgatgggctgcccgacctggcccggtccaacgataagggagccaaaatagacttattacggacatataaggcacagggaaaattatactttgacttcctcaactatcgcacgagtatgattcatgtcctccaaccacaaaaccgggcatatcgactcctccagctatcaaaaccggtgcaaacaatgcttcggggaggatctcgtgcttcgtgcttcggggaagagctcgtgcttcggttggcagccgccgccgccgctccctaccaccgtccacaccgccgctccgcccaaggtgaagagaaaggcttggggagagagagagagagagataagggagagagagggagggagcaggaagaagggaaggaaagggaggatgacatgtgggtcccacaatactttatttgtgtgaatgacatatgggttccacattttttttattttttattctaatgccatataggacaaagacttggtcaagaccgtcacgtaggcgtcacgccagacaaaaccacctccaaaaccatcaagtggcattgtttgcaccggttttaatacttggagaagtcgatatacctggttttgtggttaaatgacatgaatcatactcgggcgatagttgggggagttaaagtatactttttcctaaggtacggtccaaaagatgaggaatagacttagtcaagccatgtcaaagataacccaaagagatgagggtggacaaatagactttttttcaaagaggagctcagtaaaacagtcacccacgtgtaaatctcttcacacgatatttttttttgcgctggagaacgtatattttgtgaaaaaaaaatgaggatttttgtgggtaaaacagccaaccacgtataaatctctccgagaaaaagcaaaatttgctacgggacaccaaaaaaatatgtaattagctgtgagatatcgtaaaaccatgatttagctctagacactctaaaaaaggtgtaatttgctagaggacattgaagctattattttattatttttaggtcaaatggagaaacaacatagaaaatacgagtttgccctttagagcggaatcgctccccccatctagcacttgcggcgacaacgtagatggcgctatgcagaggacaggtccgtggcagagcactggagacggcatcatgcgtcgatgttgaacgacgaggagggatgcgcccacgcactgccatgaggtacggcatagtcctcgcgagctaccccatgaaaaacctccagaggagcgagcaagcctcaccccacctcttcatcgtgtccatctcctcgtctcctctcgtcgccggcagattcgttgccatccaccacccgctgagccaccgccccccactggatgaggtggagagggcgcttggggtgagcagacgaccaaaatcttcggccttttgccccctcggccttctgacccgagattggaagttgcggcggaaccagccatgcagtgtctctcatgcttgtcgtgctccagcttaggcccctcttcctcctcttcagcctcatcatgatcaacaccatcctgatgtgccctccctccatnnnnnnnnnnnnnnnnnnnnnnnnnnnnnnnnngtgnttcccaggcgcttaccgattcaaattttttctct

SEQ ID NO: 6800 - DNA, 1038 bp, Oryza sativa
  unsure (1)..(1038): unsure at all n locations
cgcgttgnnattggaatgcctaccnccacatgatanccactttgggaanncggnaccccagcaaaattgatcttaaaaaagatatgcatagatttttcttgaaagatactactatcataatatcataatatcatgaaggtatcatatttcataaactgattttaatatgaaggtgatcaaagttttaagaacttgttctaatattgacaggaggatctaaaatatagaagtgttgcattgtaccactgttgctactgccattgcaaagctgggctttgccccccttctggctaccagcattatgcgctcgatttgtaaaggccatcttgcctcggcctagtctggcacagcggcctgcagagccatgttcagtttccagatcggactaatcttggcccaagataggtccagctgcagaaaattgcttggcaatccaggtcaccagcaatggtattggacttgaattttttaaattttaaattttattattaaaatatttacaaaaataattttttgctcaaagttttacaaatctacacccctaacgccctcttggaggattttttttaaatcgcccttccagagaacgttttttatgatgtagcacacgtctgttggtacattctaatggccacatgtagggtgaccggtcattttgcaggcaaccccttaccgccctcctaaagggctataagagcaagtttaagagcaggtacaatagcaggctattagccagcaataaacatattttaatgagataaacaatgagagagaagagcagtagcgggctacagatctgtagctagctgcagcacggactccaagacgcaatgtgtgtatgacaggtgggaccaggtattaatagtatagtaagcaactattgtatgaattggctatcacatcggctatagatgaattaaagctagtagtgggctatactattaaacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6801 - DNA, 3144 bp, Oryza sativa
ataaataaaattaatttaaattaaaaattttaaaaattccttgtacttggggctcggctcacagctcactctatacaacctgatcaatcacagttcacaaccagtaatatttgcgagactgactggaaaaaaagaagaaaatgtagataaaactctggagaaaaaatagggtcgccataatgcatcatttcacatgcgctgaggtaattacagagaaattaatctgacacaactgctaatcgatgggaataaacagcgaacatcgacataagttcagaacatggtgatgagatgaaaacagtaaggcccagcaacatttcatttcagccttagtaccaaattatggattaaactacataacacaaagtcaccaaacaagaagacgtgcagcaacatatcccaattttagcaatgatcctcgttttggataaggtttttggcgaaattaacattgctaaacagcatcaacatgttttcgccgtttggcagagcagcacaacctccagctctggtgagaattagcgatcttttatagcggtcaggggatcatgcctagcgtgattgatgcacggaccacgtaacatgtgcttgcgaagtcgcggtcaacataacagacggtggagatactcgccgacattgcagtgctgcacgcatggaacagccatcccatattccccatcttcatcccctatcgaacccgtgcgggtgctcggtcctcgtcgtttgagcacttttacggtacaatatattggtagtatatactgctagtataattaatctaacggtatagattgatttgatctttcacttaattaaattgcattataaaattgaaagggtaaatttgtctttatttgttctaacgtttcctctgctctagctcagccaaaaaaaagtctctgttcgttccccttccaagattccttcgtcttcacgacgggcgaccgccgtcgccggcgcatgccacgccgcgccgttgccgccagccaccatgaacactagagatattgcaatagacaaatagtagattagcagtctcctgccttatggcttgcctagcgcccgatgatctatggatcgatctgcctcttgcggctcgtgcacgcaccccggattctccgcatcgccgtcgtagtcgtctcgctcgtcaggctactgctacgcccgcgcaatcacatgccccgctagcgccgtgccgccacaatcgctcgcacttacgcaaaggcaactagccagtcattctccagcactccgcagcctaattaggctacatggccagaccaaagtactatcgttctctgccattttattctgaacaatttaatctgaagatggcaaaggtacatgcagcaatagattagtacataatcagcgcatgcttaagcatggactagtcgtcacttgtcacacagcttgatgacacaagccagtgccagtacatgaccatcaggtagagatcaaacattaacactttaacactgacaaagctaactatctactgtactatgtagtatttgataccgccacacgcgcctagtctctcgtgaacacagtagcaagatgcaagggacgcggtagcagctgaagtgctgaacgggaatcgccgttgcgcgcctattctctgtcgaatcacgctggcgccgttgccatggaatcgcgcaggcgcacgtatgagaaccaacagcgcaggcgaacgagtactaattaataggattggattaactctgaaccataaaattactaaaaaatacttcctaattttttgccaaattcctaacatgctcttacaaatactgctagtatatactgacagtataatgtaccgtaaaaagttctccgtcgttttcgtcttgccacagtcctcgtgtgtcatcagcgatccactccgacgacgacgattgatgttgatgtggtgtagatgctgaacctgtgacagagctgcatcgtgtatgtgtagctcaggttgactgttaaatatgtgatcttaatttaggtctacaacatattcggattaattttctagtaaaacatgtgttttcctactaggtgtttttcttttatatatatatatatacacacacacattagcaaaagtgcccgagcattgcaccgggtgattacggagtgtatatattaaccaaaagtgttgtttggtttagcaaaagtgcccgtgcgttgcaacggaaagaaaaaatgagaaaattaaattaaaacatattaaattctaatttaatgaaaaataaattttctacaatattaattacacactttgaaattttagcaaaagtgcctgtgcgttgcaacagaaaggaaaaaaacaacagttaaattaaaacatattaaattctaattaaatgaaatacacattttctggaatattagggtatttttatgttggtaggtatataattaaattaattttcaagtaaattaagtgtgagaaataaaatatgatggttggatttaatttttgttaaattttctatattaattacactctttgaaattttcttggaatttacatagcttaattggtaattttgataatacaaatatcatttcagcatttatttaaataaaaatcatttttctctatgggcctttttcaacccattttcttctttagcccgcaagcgtaaaagtctacttaataccccatactcctcatctcacttgctggaccaccggcccgcgtgcggcccaaaccctcgatcgatttgagccgttcgttttgatggacggctcagatcagttagaaattgatgaaaaccataaccctaaccctccccctcccccctacccgagccccgccgcaatcccgtactcgacgccgcctctttctcatcccgagttcccattggggccgctttccctccctaccctacatcggggccgatcacttttgcccatatcccggctatatccccatcgcctagagcggtgggttttctttttcaacgggaaccgctttttttttgtggtttttgtgctcactaatcaaggggggggtctttccttctttacgggtgatttctcccccacgctcctctttttgtatcctcaaacattctcatggttacagccccctttctttaacgccggtgaatcattgcttcctgaaagaaggacctcttcatctttgcg

SEQ ID NO: 6802 - DNA, 4341 bp, Oryza sativa
  unsure (1)..(4341): unsure at all n locations
caaacggctcctcccgggccgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaccggcaccatctctctctggcacggcgcagcgacgacggggtgcgccggagacaacgacaacggttgtccctcccactccccctctccctctccccgtcggcctcgacggcgatggcgccctctcaacggcggcgtcgatagcgacgacggcgtcggcttcgtccgcgggtgaatccgtcagcggtggcggatcctgcagcggtggctccctccgccgcctctcttctccctccagcggcagtggtggcgttggcggccaccgtttttttttttttgcaattttttccatggctattgctaactgagacggattgcgtacgaacaggacgaaaattagatgtgacgaaaggaaaaatacgaatatttatattagttatatagatatggtttagttaacatgaaattagatgtgacgaaaggaaaaatacgaatatttatattagttatatagatatggtttagttaagatgaaattcatcgttttaatttcgcttggatatatattttgttagaaaatcatgagctgcaatcgcaattaggagttcgatcgtctcaaattaacatgcaactttttaaaaatgatttcttataggattccttatatatttttaaaagcgaacaaacttaaaaactgactcaaatacggatctgtatttctaaaagcgaacaaatttaaaaaccgacctatacatgaatgacgtatcaaagtaccggcaaaaacatcttcaatttttatattatatatttttaaaaagtaaagtagtataagtggaagagaagattacggacgataatttttttttggtagtcgtagcttttctcaaggagtcgacgttttttttcttttttttcacggtagaagttttttctcttttttttttctccacaggggagtcggacgtccatttttttttctcttcgttttttgttttttctccccttttttttctaacagaggtgtcggactttttttttttgccgattgatgtttctttcctcttttttgtttttctcgctttttttttcccaaacggacgatggaaatttcttttattttgtattttttataagtagaagtatatatatatatatatatatatatatatatatatatatatatatatatatatatatatatatatatacacacacacacacatacactcttgttgtaagctgtaaaaaagggtgacgttactattgttattcctctacatttgtaatcaactcatcaatactgataattgccggtttgatgctcgtggttttttaccacaatggttttccacgtaaaattcgtctccgttgtgcatctattttcgtaataataatccgcacgcctcctttttgggttcacaccccccccccaataaccgctttctttttactcttttcgttgtaacctcctagccttcatggctattgtacagcgtttccctctactttaatataaatatatcccgtggggtttaaacaaaagtgtcggcggcaacggaggaggacgtctcggcatagacggagtaaattcttttacaacttgcccaaacctgcacctttttacattttagtcttttttaaaaaaatatttttggacccttcaaaaagtcttattccaagaacggacatttttctggtgctagtgacccagacgtcaaggccgaccacaccctcgcctcctacggaagcgaagctaagtcactgcggtcgtcaccaatggcattcaaccgatttttcttgcaaaaaggtatttggtgttaattcattgatattgaggatctatttataaaaaatcatttatatttcaatttttctgaatttttttacaaatagatcctcggcacaatgttattggcatcgacccctcacattagtgacttagcttcccaagggataagaggtaagagtgttggcaccaatgtcattagcgtcaagacatttgtcagcgccaatgaccctaacgctgagaaaagggtgtatttctaaaataagtttttccatatacctatttataaataagttttttttaaaagaactaaaataaaaaaaaatccagttctgcaaactccactgtacggctagccaccggcatcgttcaaaacagccgttcaaaacaccacaacgatgcagcttgtccgccctcttatcatgtgctgggcaactgcccatggtggttgggcattggctttgccactgatcatcgcactgtaagaataacgataagccatgtagccttgtattgctaagtcaacccaagccatctttgaaaaatatataggaacaagccattaatttttgttaatggcatacatagaatatcttgctcgttacatcgatagaacttaaagatcaaactgaagaagaaacaaactaaagaagatacggtccaactttttttttaattaaatatagagttttaatttatagctgcagactaacgttgatgtcggcgaaaatacttaataaattaagagccaacagacaccgcagaaatacaccaaaaagccctcagtttttggaaggggaaaaacgacatgtctatgaaaactctgatttgcactagaatggagagtagccattgtactaaaataaaattttgcccattccatagttcaatcttttcataactatcacgcaggagaatgatatagcacataccctaggagctctttttcatacccgtgcttttgcaacggggttaggagaactatgggtgaatggttttattggtttcagttttatctctcagtttctaaaaaaaaaaaaatctctccgttttattaatttttgattattttttcgtggaaacattgttttcttatgtggtggctaatatggttggagaagagaatgacgactctactctttacagcagtagagaaaagtataacttttgtctagtaaactaactagagaacagagatacacataaagccctattttgtgggtgttaagatttaaggtagaatcatgaactcgcaactccaccttcttcccacgctctattgggtttaaaacgtttttttaggtaaagttacttaaagcactttttctccgtcttaattgtgatcttgtattattgttagtttggcgccctttgccaggtccaaattaagaattacccccctgttgcctaacccaaaacacccgcaagccagcaaattaaatagttaaattttgagcataaacctattcttttagacaattaacatacctattcctttcacagagtttaaattttcgccaagcttgtacctttacgcggcatttgatatatagcgggttaattacttagtcgatcgagagctgaaattccgtggaggagaaaacgtacgaaaacgctttaaatcgggcgtccgatgccagcactctcccctatcttctctccccacccactttccccctttctctgtcttcttctctccaccattccccttttctctctcacctagcaacgagaggaagcgagtgtatgcagagcgacgaggcggcgacggtgccggagcggaggagggcgacgttgcggcggccggggaggcggcggcggcagcggcagtgctggagcggaagagggcggcgttccggcggtcggggagaaggtggcggcggcggcggcggagcatgtcgttggagctgaagttgcaggacttcgggttcaccttctccgaggacgacgtggacgccgagctcgtctccatcgtgagtgggcttcggcggcagcgctcggatgaggacgacgccagaaaggccccggccttcgcggtggcttccgccgaggaggaagcagccggtcgccggatcggctttgctccgaccggcgcctcctcgtcctcctcaacgctgaggaggccgcacctgtcggaggtgtgggccgaggaggaggaacaggtgaggaggatgctgcgcatgattgttgcacacacgttttttttttttttttttgcacatagtgtattcgtgatggggtaccgaattcctcntgtcaagggggcgtccaagcgaggggcattagtaatccatnnnaaccac

SEQ ID NO: 6803 - DNA, 2387 bp, Oryza sativa
  unsure (1)..(2387): unsure at all n locations
cgtgggtnnnnnttgattaagatgcacatcctgcnnnnnnnnnnnnnnnnnnnnnnnnnnnnnnnnnnnnnnnnnnnnnnnnnnnnnncgatcaatcgatagccaataacgcgcgattggtatgcgcggcgcccggccggcgtggcgccagcgctcgcgaccggccatgtcgtcacggcggcgggagcgggacgagcagcgagaggcagccgacgagccaggccacgagcgccgcgaacagccgtggcagcggggtcacgggcgccccgacgcccgcggcgccaacgatcacggtcgccccgaacagcatgaggtacagcgcggagaggcgcatcggcggttcagcacgccgccgtccgcgggcaacggcgagctgctgcggcggcggcggcgcatggtcgtcgttgctgctgctgccattgccgctgccgctgcaagtgatgttatcctcggcagccatcgcgcggtggatcagaacgcaccggccacggcggctgtggttgtctagctacttaattaattttgtggttaattaatttttggaagcgagcgcgaggcaagctagctagctagcggagccgtatagaatttataccaccctgatcggcggttgctatcgatcgatcgaccgggatgatgatcgataattcgatattactgaccaggtgcggatgaatccgggacatcaagatggaagggaagaagcttcatcggaatttcgatcgatcgaggcgtatgtgggtcatggccgggtgaggtggccagggacgaattttctttgttttggtttacttatatctatctatcttctatctattatatatatatactaaataaaagtccattaaacttcctataaacgctctcaagccgccacgtggcactcctacaaacgctcctagaccgccacgtggcaatgtctaattacatcgtcgattttcacttaatcggtggacccaataatttggaccattcgattagattagatgtattttatttaaaaataaactaataccttactgttcaccagaaaaagaaaacaaaaacaaaagtatatactccatataggtacgtacatacataagactaaaaaacaatcaatcttacctactgtttataaaaaaaaaaactatgcacagacttactatagaaaacaataaagctaaaaaaatatacatacatagtaccattgaaaaaatcaattatctttaaaaatggagtattctactatttaaatataaaagctattactctgtaaatttaagcaaatatcaccgtcgatttttaacccaatattttagaccattagattatatttattttattttgaaaacaccatattactctatgtatgtatgtatacgggaaatataagcagtcagtacgtgcaaatgacctgggaaaagaaacgaggtttacctactgtccttcggaaccaagaaaaatctactcacggtggttttctgaaatagtattttcaaaatcacttactataaaaacaataaaaaaatatgtatcattggaaaaagatcgatggtctttttgaattagtattatctactatttgaagataaatatattgctctacaaatttatgcaaatatacgtagttaaactaaatttatattataaatataaaatattccatcaatgatctttattcgttctatcttaacatacaagactaatatatataataattaatgctatgatattttttatttcatatcatattttaaggtgtcaaatatcacttgatgaatatacaacgctaatttaaatgaaaacaatttagttgtttcattttacaccattagattagatttattattgacaaataatacaactctcctatatacggatacatgaaaaatatataactgttgatcggaaaaagtactctgtacgtagttatgattgaaaaaaaacaataatgcttacatatcgtctgacggaaggaaaaaaaatacttatgataaagtaaaacaatcggaggtctttaaaaaatatttttctacaatttaaggataatacctaaaaaacaatttaaggataaaatataataatcttcaaatttacacaaatgtaaatataaaatatccaatcaatgattttaagcgttctatcttttaaattattttaaaattatatatctaatttgtgattcagttgtattcctttaaataaataaactattaatatctataaccctaaatacatcacaaatatggagccggcatgtaataattaatgttatgataataattccacatcacattttagtgtaagaaaccacttgnnnnnnnnnnnnnnnnnnnnnnnnnnnnnnnnnnnnnnnnnnnnnnnnnnnnnnnnnnnnnngatatatcaattcacaatggggagcg

SEQ ID NO: 6804 - DNA, 3232 bp, Oryza sativa
  unsure (1)..(3232): unsure at all n locations
caccanggggagaaaataattaaaaaaaacttcctttcactttcagtgatctaccattccaagcagtgatataatatggggaacgctaataggcgatcaatcgattggagtgatcgatccccattcccctgtacgctcctctccccttcctcatccccttcttctcttcctatacaccataaatttttaaaaaaataaaaaaaacaaagttgaaaaaaatatgtatagaaatactatattaaaaatatatttgaatttaaattcaaatttgaaacatgtatgcaaacttttgatttataaactttgggtctataaattaatatttgaattcaaattcaaatttgaatcgggtatgtaaacttttgacttataaactttgggtctataaactttagatgtatagaaatactatatataaaaaatatttgaattcaaattcaaattaatatttgaattcaaattcaaatttgaatcgggtatataaacttttgacttataaaatctgggtctataaacattagtttagatgtatagaaatactatatataaaaaatatttgaattcaaattcaaatttgaatcgagtatataaacttttgacttataaattttgggtctctattctttaggtgtataaactttatatgtgtaaacttgaggtgtataaactttagatgtataaatctattaaaataggaaattaatgtggtgtcaggaaaagaagccagccacgtggggaggggtgatcgcccaacaggattttcgtataatatacggccgggaatgctagataccaataagatcccatgcatatatagcgctcccaacggcatgccttctcctattttctcgacgcgagtcacatgtcacgcacggttcttccgctcggtgggccaatggtttttgctacgtgtaaatcacgacataataagtaactcacgtcgctttcctagctgagcaacgacggcctcatcttttcactaatgctgatgtttatcagccaaatttaaaatttaaaatttaaaatttggagttgattttagggttttttcatcgaagtttatttttcagtctttgctttagatcactaagaacacgtatataaaagttttgttcacaaatgatttttcatttgcaaataagtcaaatgatggggccgctaaccatatgacataggttctttctcatctttacctatttttctcctttttttggttaaatttcttatttatgagttgaaacaatttgattttttaagagaaatatatgatacttgtgtgacaccgatatttctcatttatttttttcttgaaaaattttcttttttttccaactagcatggtggcccgcgcaaattatatatatatatatatatatatatatatatatatatatatatatatatatatattcttaatttattattaaaatatattaaagtgacaacatatttttagttctgtactaactttaccaaactactaatgtgtgtaacattcatgctgtattgtatatacgtgatagttattaattatttttattatcaaatttaagttatttctaaattgtattcctatatggactctacgctcgtcttctaatattcctttttttaattccattttttttatttctagattgtatttctatatggacactaacctaattttaattttatttttttttaattccgaattttcattagttctaaattgtatatcggtatggactctagtttattctttaatattctctattttattaattctgaatttcagctatttgtaaattatatttctatatagactatgtttttctttttctctaataaatatgagaatttttaggttgtaagagcgaacgtgaaggctcctttttctattagttcaataagttaatagatttatcaagcgatacatatgtatggttctgctaccttatgtaccttatattgtacaagtatcttatttgatgccttatagatacattatttatctttgtcttttgtatgtgctaccagtacgtagaatattattcttggcaccaattgctatataatcaggacgggatcgggcatttaaatatttgccactttaaagatgtggtaattaagcatttgccactcgcgatctatgacatataggctctcatatacctatgacatatgggaccaatgacaaatccttaattgccacttgtaaaagtggcaaatagttaatatttgtgtggtactatgtggtaccagcccttgtacccacttgtatcacatgatacctacctagtaccactgtagtaccgaccaagtatcaatgggtattaattagctggtaccgacgagcatcagttggtgcctgataagtaccagccgatacccctagtacatataggataccagagtctgatactttatagatatcatcctgtctgaacaagatccatggtatagtagcccctataatatagttgcttgtggcaaactcataacaggtccaactctaaccacaacatgtgtaacttgcttacttgcagcatatatagtcttctttttattccaagatcaccaacattacagtgttctagacaggcgaagtagtaggagttcttttaaaaaaaatattacaaagctcctgataaaccggcatctagacagagcctgcattggtacatagcggctagaattttgaaagggttggaggtatccaaacgtagccatgggtctgcacgtagcccatcctcttgctcagctcgtcggcctctgggggtccccgggttcccggcttgtacggcagggccttcaccttgccgtcgtcgatgtcgtgcagcagcggagtgaagatctcccacgcagcctgaaaaccaacacggcgtcaggtattcattcagtcacaagcgagccgattgcaagtcacacagcgtcaattacacaaagcacaaaccttcagttcgtctcggcgaacaaagtgctgctgatcccctcctatcctgtcaaaaaaaatggaagatgatatcatgggtcatcctttatatatatataatggattaaaaaccnngnctctacattcaacacggatagttcatnctggatatggcatgtgttgggaacaagggcgcatgcaagtgaagaagttattagtgtagcagaaagaaatgggggnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6805 - DNA, 2772 bp, Oryza sativa
  unsure (1)..(2772): unsure at all n locations
cggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaagttagtagnagttctttaaaaaaaaatattcaaaagctcctattaacgggcatttagccagagcttgcattggtacatagcggctagaattttgaaagggttgaaggtatccaaacgtagccatgggtctgcacgtagcccatcctcttgctcagctggtcggcctgtgggggtccccgggttcccggcttgtacggcaggcccttcaccttcccgtcgtcgatgtcgtgcaccagcgaagtaaagatctcccacgcagcctgaaaaccaacacggcgtcaggtattcattcagtcacaagcgagccgattgcaagtcacacagcgtcaattacacaaagcacaaaccttcagttcgtctcggcgaacaaagtgctgctgatcccctcttatcctgtcaaaaaaatggaagatgatatcatggttcatcctttatatatatataatggattaaaaacccggcctctacatccaacacggatagttcatcttggatatggcatgtgttgggaacaaggcgcaatgcaagtgaagaagttattagtgtagcagaaagaaatgggggaagaaggatggaacaggacgtacgtatccaggatgaggcgttcatacgcttctgggatcttcacgtcttggtagcgtagcccatatgacagatccagctcgctttgttcggttgccatttctagtccgggtttcttgacctgcaacagttcatgcactttgttcagacaacacttgtttttttggagttctcttcaggcaaagatgaatagacaattctgacatatcttcagataaatgggtttacagaagttgtacatacagttaatttcatatacatggcttccgatggctgcaaccgtataacgaattcattccttccttgcttcttgcctttatcagggtgaaataaaaacagagttttagacaccattggcagaagcaaaacaatagcagacagaactgtattgattcaaataggttacggatgtttaactacattcacagttatgtgaaatttctctagtctgctcatgagacaaaaatacgttttgttatcatgtaaaggtaccacacacgcacacattttaacttactgccagattcttgcgcctatagaaaacaataattagttatctgaaggagttaaacagaacaagtttttacttcataccaggtcttttggacagtattattaccaataagaaaatgacagctcacttccaaatctattaaacacaaacaggctgacaagcagggtcaacataagtcatagaaacagtgactcaaccaattagtaaggtgacccggcaaaaaccaatagtaaggtactcaggtcaaattgaaagtagggagcttatagcaattttagatactaaaatgtagcaaagtagcaacccgtctcatgcttattcttgtctattttctaaaggaagtgttgcttatactaaggtgtcacatcataacccattataagaagtaactttttcataccaaagcactagcacatttttacattatttctcagtattatcaagaaggaatgtttagtactctctttagtgcttgcataatgcaacatcttatatttccaatagagttgtctgccgttatccattaactcttgacagagatattcagatttttcagtttgttttggactagcattcagatattctaaatcaaataacttagtttcttaaaataggttgtgacttttgcaagatcagacttgatgacaagtttcacagcacatttggatacgagaaggtgtttagcgcatacatttaaaaatgtcaccaggagcatccttgaactgcacacgtatctctgctttcctattgttcagtgctttgccagccttgagaatgaaaggaactcctgcagcgcacgattattactatgttaactgcactgaaagataagataatggtaactggagggtcagaaatagatgtcaatgcagcttcattttttctaggacaatgtaggcatatggaaaatggaaatcttggaaccaaatgcccatgtttgatcaaagtgatgcagaacagctgaaactcttgtatcgaaaaaaggcagttcagttggaaaatgcagatatttgtttaaaagtgacttcaaaatactgtatatctgtatgttgtaaggtgtaacatataccttcccatctttcattgtttaccctcaatacaagagatgcaaaagtaggtgtgttggagtcatctggtaccgtagagtcatccttgtagccatcatattgcccaaggaccacctcatcatgctttataggtgtcactgactgaagaacctgacattgtggtataaaaacgcagaaggaagtattgtaagcaacgaaggatgacaaaaaaaaaaaaaaagatccatacaggtttcctactttcagttagagtagaattgtataaggagaagcaaaaaccttgactttttcatctcttatgtgctcaggcttaagagagacaggcttttccatagccaccaaacagaagacctgcagacaagagcgaaatcaatacagaaagggggcctcaagtcgtgaaagtggaaacagcaatattctctnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6806 - DNA, 8218 bp, Oryza sativa
  unsure (1)..(8218): unsure at all n locations
atgttgtccattaagaacncatgtctnnnnnnnnnnnnnnnnnnnnnnnnnnnnnnnnnnnnnnnnnnnnnnnnnnnnnatactgtattatcataaaaactaaagaagtttaatgcctagaagaaaataataaaatgcaatttgtatatttctaatggacaactgtacacgatcgaatgacttcatgtgaactatgggaaccataaaccatttacaatatatcaaagtgattttacacttttatagtatatccacagtcacaagcatatgtgcttacaacaaaatactttcagtaaaaggaactttcatgcaaaataaagttactcccaacatacccatattgatcaaagtaccctccacgtgcttcagtcccaaagtcctctctgaatacaatctgcagcatatatttattatgttcaagcacatgttgttcgcaccatgataatgataaaactttccagaatttccaaaactaatccattcaactttataccaataacagaggatgtcatagatgtaactacagttgacaaataaaaatacaaaggactacatagaaaagcatattacctgtacattagcaatgttatcacgattccaaagaggtaggaacaaacggtttgcaaagcgaagcacaagctgaaatatattgaaatatgttatagtagcatggaatatatcgttcaactaactagacgaagccatacaacttaccagattttggaccaattcttttcctaaatagtggtcaattctgtacagctgttgttcattaaacagctctccaagctgggcactgagttcctctgcagactccaagtccttcccaaagggcttttcaacaataacccttgtccagccagaatgagaagctgaaagcacaatatgacagttacagaaggtgactagcataaaagaaatgaaactccaacatagtatagcacaacttctaaaaatcaaacttaaaaataattaatttgatttttaatttactatgaaccaacacatgactcaattaataactaagagcaaattcattgcacccaaattgcttccagaaaaccaaaactttatgtttcaaaagtcccaatgaaaaagcaatgtcaggaaaagagtcggcgactgctaggaattggtatgcttagaaagttgaaatagtagcaaagttccacaaggcaaatacttagttaaataaagaggacaaaaggaaaatagtacaaacaagagtggatacaaccaaatatatttcctatattttgaaactctgttgtggataacttcactacaccaaagggagtgcagcagctttcaaaatccgtaaaaaaggggaagtactcacatggattcatgcagtatgatcttatcattttgcatactgaggggtagactgatggaggcaatgccaaataaaatagtctacgtgagcttcctggtttgttgttcttcgaagtttcattctctgaaatggcgttatttaatgatgcaaatccttccccgctattgtaggaaccactaacatatttaatctgcaaagaaaattcaacgtgttacgaaatctaaatgcaaagaagctattcatgatatcagtgacttactaattgcaaaaattgtgaaatatgttcatctgaagctcctttgaggtatctgcgataacaggagaatgctatttaggcactagtatatcatcagacttaaaaacagagaaactacttcctcatacagaacatcccaatttatttttacatgaaattcttaaattattttatggtaaatgttggtgctaatatgtatctttcttacccacgaatgcgttctcttaatccatcatccgaaatatttgatcttgcatacccaaatatatggacttctccagattgtagaaatccctatcaacaccaaaggttacagttcagaactttgtacgtgtgtcaacctgacaaaacattatgtacatggcatgcaatagcaatatagcattataaagtgctgcagtagaatttctgagcaattataactcatcacgaatgcatcaattttatttctttttcactacaactctttcagaagtttgacaactatggaagaagctagtataccaaactatgtaagaagctactagttacaatcaaattacctgctgaaagaggtgaaacagcgctgggaatgttttcttcttagcaaggtctccagaagcacctaggaccacaatggacaagcaaccagactctgaagacagttctaggtccttcaaacctgacaaagaactgaagctagcccgccctgatgaaggggaagaatcaccagatcctcctgacatgatgaactgtatggtctcttcctttggagacaaaacctaagaatgtaaaaaaaagtactgttagtctcaatatgaggtattcacaaataacttataatctatccaaaactttaatctatgctaatatgaacaaaaaggtctattggttgaatgatggattcttgaactgaatcacctgtcagtacctaacagccaatttgcaacagagtgtaaatcaaaatgaatgtttgcttcagaaaaaaaaaatcaaaatgaatgggattaaagttggtttcatgaaatcagtactaaactactaatatagctaccctgaacttacatcagcgaactactcccattgtttgccaacttatagtcaaagttctcataaaacacaaacaggtactgtagttatgctagtcaaatgcttctatgagattctaatacagaaaaaaaaaagtatctacaagactacaaatgtaaatcaattgaactcggtgcccctacattttgtacgggtaaactggaacacatgcaacaactgaaccactgcactcactagaagtctagaacacacaacagcccaaccacccaataatcccgaaataaactagaactgcaacttgcaaagcaaattctgttccgagagcttcaaatgattaaaacgaacctatacagcaagcgcatcagggcgccaggaaatcgaggagcacacgcagaataaacacagagatcatgaacacaaacacggcgcacagaacagaggaatttgcctgcgaaggctgcgatgagatcctaaggccgcagcgtagcacaatcccttccacggcaaatgaaatcagcaatggaaaaaccgatcgcgcagaactctgctacggaaccgatcaaccaccaaagaggaatctaagcagtgtggatgaggaggaggagggagactaaccagcagtggcgacgagatttgacttcccgaggtggaagaagaagacgacgacggcgaattgggcaatggatggtgatcttttccgggtgcgatttatagggggatcttcctcactcacacccgctttccatccacccctccactctcctcccccgccgcttttatactcgcggacgactcgtctctcgtcggcgttgttctcagctttgacccgcgcttagccgcctctctgctttgccacacgcccacacccaccaaccctgctcgcttactgttaccctaccaacatagtataaatcaccaatcttataagttattttttttaaaaaaaatagcgtcaatccgattgattgactactaatataatccatccgtttcacaatgtggagagtgctagaatgacttacattgtgaaacggaggaagtatataaaaaatgtgaaccgtaaagcgtaacgctgtggtagaaccaagtcaggttcaagctctatatttactcccttcggattgataatacttgtcgttttagaccagggtgagatcaaatcttttattatgaatcatttttaaaatattatcttttcaaatatggctactatatgtataaattagtcttaaaaagtagtttaataaaattatatatttgttaatatttttacacacattataatgaaaaataatggtcaaaattatttttttaagactatgcctttgtccaaaccgataaatattatccggagtaacatggatgctcgtatttatcaatactgactttatcaatttgtaatgtatttttgtcaaggactacgtggcaacttcatcaatatatactgtgtttcaaataaaatatgaatgaaccggtagaaatagtttatcattaacatttaatatttgtatcacttgttttagcgatagaaatagtgcatcagtaacatttactcgctttatataagttaatagaaaataaaactacgacaaataaaaaatcctaaaatgaactctataaatttcaaattttatatttttgctgaagctgatatactgagatttacactcccgtcccgtaaaaaaaatatacttagatacatagttagaagttgaacatccataactaaatattggttttttttctatggattgaagggagttgaagatgcaggcgataagtctgagatgagaccaaagcaatctgtggaatgccgatggattgtagttttttctatggattgtagttttcccgagtatcctcactctggtactctagtactctacgtggccgtgtttagttgtaatttttttcttcaaactttaaactttttcatcacatggtttaaatttcaaccaaatttttaatttttgtgtgaattaaacacacctagtgttggtgacaaagtttttcactttttccaacccatgaggccatgacatgacatcaaccaaatggcgccgcaaatcgagcatcgtctggaaaatcaattcacgagtcgaacggcgcggccggtggtatatctatcatccccatctctttgttctttttttttttctgtttcgatgatttaacaatggtcatcagcgacgtcacaaaatacgctaaaaagcaccacgttttaatcctcttgtggatattatgggtaccccatacccatacggcatggttatccgactagtcataggggataacttatatctatggaatatgtaatagatcatgactcgggtattacgtttccttatatattacggaacggcctaaagtcctggtttgataatattgtaaagtagatttaggaaaccgataccgtattggttaaggtttctatcttgtaatcctgccccccaccctatataaggtgggcaggaggccctctagggggcatgatgacacaaactagatcgtcagatctataatacacccggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggttgcgtcgagtttcccatcaacaagcgcgatggaatcaatttcatgggtcgccgacttcgttttcgctttgggagttttcacttcctttccgtcgaccacttcttcaacctcctcttctctgacttgatccaaatcagtcagggggaaactcaatctgatttttatcattgtttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgtcggccaccaccgttgatgggcatcgtcatttacgccgccggtctgcctccgtcgccgccgactggtgtccccgcctatacggtcggttggtcatgccgccgttgatgggcatcttcaacttcaccgccggcctgcctccgtcgccgccgactggtgtcctcgcctatacggtcggttggtcacaccaccgttgatgggcatcgacaactacaccgccggcctgcctccgtcgccgccgagtggtgcctccgcctacacggttggtctattatgccgccgctgttgggcgtccacgacttcaccgccggcctgcctccgttgccgcagagtggtgcctccgcctacacggctggcctattatgccgccgctgttgggcgtctacgacttcaccgccggcctgcctccgtcgccgccgactggtgtccccgcctatacggttggttggtcacaccaccgttcatgggcgtctacgacttcaccgccggcttgcctccgtcgccgccgagtggtgcctccgcctacacggctggcctattatgccgccgctgttgggcgtctacgacttcaccgaccggccgcttcgtccgccgccgactggtgtctctgcctgcacggctggcttattatgccgccgctgttgggcgtctacgacttcatcgccggcctgcctctgtcgccgcagagtggtgcctccgcctacacggctggcctattatgctgccgttgttggatgcctacatcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggtgctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgaatagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctttatgccgccgttgttgggcgtctacgtcttcaccgaccggcttgccttcgccgccgccgactggtgtttccgcttgcacggctggcctattatgccgccgttgttgggcgcctacgtcttcaccgaccggcttgccttcgccgccgccgaccgatgtccccgcctgcacggctggcctttatgccgccgttgttgggcgtctacgtcttcaccgaccggcttgccttcgccgccgccgactggtgtttccgcctgcacggctggcctattatgccgccgttgttgggcgtctacgtcttcaccgaccggcttgccttcgccgccgccgactggtgtccccgcctgcacggctggcctttatgccgccgttgttgggcgtctacgtcttcaccgaccggcttgccttcgccgccgccgactggtgtttccgcttgcacggctggcctttatgccgccgttgttgggcgtctacgtcttcaccgaccggcttgccttcgccgccgccgactggtgtttccgcctgcacggctggcctttatgccgccgttgttgggcgtttacgtcttcaccgaccggccgcttcgtccgccgccgattggtgtttccgcctgcacggctggcctagtaaacagccgcccaccaaattaaaaaanancccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6807 - DNA, 756 bp, Oryza sativa
  unsure (1)..(756): unsure at all n locations
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttcatgtatcaaggattgctgacgctgaagagaatttgggtgggattgaagtgcgtgaggcccatctagctgaatccttgtacttcataagtgtcaggcagaaggtataaatctgtatttttctatactttaccctgtggtctggttgacatagtacatgctcgaaatttagctacttcagggacaggggacctcctgtcctgttgcaggtccttggagggaagtcttagaatcaggacacttctgaattgttcacactggtatgaaagaggaggttccatctagatcatgtcaagttaaatacttaaatcaggaaaatctcgtaaatggggtcttggaaaagctaaagatttgcagtcggagtggtcaaaaaatagatttcctttgtatgcttttggtttatgctgctgcttttatgctcccactcatgcaatgatatgataaaagatcacatggtaatatggtatcgatttgctcagtcgctactttgttgtcctaggtaaattgtatgcatgcttggcgtctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgg

SEQ ID NO: 6808 - DNA, 2287 bp, Oryza sativa
  unsure (1)..(2287): unsure at all n locations
aggagtgtgnnnnttggaaatctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgattgtttcgttgttaaaactgttgttccttttgctgtggccaaatattgctgacttgctgtgaccaattaatatcgctatgcaggagggtgcaaaagcgcgtgtcatctgtgaggagcttgttcagtttggcttgccatcgggcgacaacacgaccgtcatcctggttctgttcaagcccggcgcctaccctgctgttccgccggtcgacaccgacactgacactgacagccacaccggcgatgatgtcgacaacaacgaccccgccaacgaggttgatcccactgccaatgccgggtctgatgacagcaacaccagcgatgaggtcaaggtcgacgccactgccactgccgtcggcagcagcagtaccaccgccgtggctgccgacgaagccaccgtggtgtcgttgtcgactgcaaccatcaccattgtggacaactacttcttcattaacaccagcgaggaggttgatcccactgccaatgccgggtctgacgacagcaacaccggcgacgaggtcaaggtcgacgccactgccagttccggtctttccgattgggaacttatatattctgaattctgatcctgttagtggtagacgagtaatagcaccgacccgttgatagtagtagtttggttgtgctactttgctagactgagacaccttgaattaattgtttacgaatcatctctagcctttttagttctgaaggtgattgatctagtgatgcttttgttgatcttcattttgaatctctgtgcatggtagtggtttatgaactactagtagtatttttcccagtttccttttgaccaaagttttcttcattcttctagtctctgtgactgtgatactcaaaatcttttctcgggaatctgtaactaggattaaggcacgaaaattttctctcctttttttcaagagatatcctgaatttgcgacctctctcttccgccttccccgcgcggggggtaaaaaaaaacagaaagttagaaaaaattatgtataaaaaatttgaattcaaattcaaatttgaatcaggtatgtaaacttttgacttataaactttggatctataaagtttagatgtatagaaatactatatatagaaaatatttgaattcaaattcaaatttgaatcgggtatataaactttaggtctataaactttagatgtatagaaatactatatatgaaaaatatttgaatttaaattcaaatttaaatcagatctaattcaaatttaaatttgaatcggatatatgaactttaggtctatgaactttaggtgtataaactttagatgtatagaaatactatatataaaaatatttgaattcaaattcaaatttgaatcggatatataaacttttagcaaaaaaaactttagatatgtaaacttgaggtgtataaactttaggtgtataaatttactaaaataggaaagtaatatggtgaaaaaaaaaataaattaggtggagggagggagggagaggagggggaaatctaatcgccctgggcgatcgctcagtagcatttccgttccccgcgttcacttgcccacccgtccgcttgatcgtgcgggaaaccaacaggcaacagcgatgcaggagggagttctatgtattgggtactgttgaatttgattccaaaattgaatctcaaaattcaggtttccaattaaatatcccttcctatgaatccttgccatctacttctcccaattccaaaaatatcgaattcatattcacgctcccatcggatggcctaatcagtcaaagaaaaagccaaatgttaaattttcaaacttaattttaagatattttcaacgtagtttctttttcaccattgggttttaagtcataaaaacacgtatataaaagttttatctataaattcatttttatttcctaataagccgtaggaaaaaagccaaccgatggggacctcaatttaccttcttgacttcttgttgaacccttgagttan

SEQ ID NO: 6809 - DNA, 1903 bp, Oryza sativa
  unsure (1)..(1903): unsure at all n locations
cgatgtccncncnggtagtgactcgtcttnnnnnnnnnnnnnnnnnnnnnnnnnnnnnnnnnnnnnnnnnatttcctggaaaatggtcaaacattttcccctctggtgggctgcctctcctttctttttagataatggaaatggattgcatctccggcttctgtcataagacacacagccataaatttaatagtaataaaaatgtaagataaaagtaaatcaaaatgagaaataaggtgatgggacaaatccccaactcccctttattattgactaatgttaaaccacataaaatattttagctagcaattcttatgaaactacgccacccatagtggaataagagacccttggctaccgattccaagagtgtagcaccattgcgcatagtatcctgctcctcttgtggtagcattgtagaccataagtggagccagtaggaagacatgaagataacctgcatagggttagataattgtttaccattaaaaactttatcattgcgacaacgccaaattgaccaacatacagcgctagctccaattagaatcatcttcttaatggacctagatacccctctaagccaattatcgaaaatgtttttggcgttacggggtggggggatattaaaaacaaaaaacacacatctccaaaaacaaactgagcaacatgacactcaaagaaaagatgttggattgtctcttgtgtatagcagaaagaacaatgtttgtctccgccccctccaattttcttttacccaggttatctttcgttagaaatactttcttgtgaagaaactacataaagaccttgatctccagtggaattttcaagtcccacagaattctctttttgatccgaacattacagttcatgatcgcgacatacatagatttgacggaaaattgaccattcttatagagcgaccatacaaagcagtccttttcatttgacagagttatattagctagcctgaggatcaaatcgttccactcgattagctagcctctcctttctatgtggaaaaagtacattgaaggtccctcgacttgtcatcgagttacaaaatcatccctcacccgtaaaatcagatatatgacatccttcaacttacaaaatcgttcattttagatcctttagtagttttgttctggttttatttgacatggcggctgagtcagcgtgggacccacgtgagccccacatttctggatgccacgtctcttcctcaccagtcaacgaggttttttcctatatgccattaagaaagatggtgcctgcttctgtgccactaaaaagtttaagcctccctctctgccatcgtaaactttatcgtgccctccacactattccgtctgtttttgttgtaacggtgggtaatggcgcagtaaaatgacttagttgccctttggtccaatatgctctctcctagcactctcctctctcccctcagatgcagcagcagcagccaaggagcggaggggagaagacggcggcactgcgacagcgacggggcgctgcgacgacgacgatgacgacgggggcagcgctgcgacggcggcggcggcggcattgctgcgacgacgacggtggcggcatcgctgcgcgacgaagacggcggcaacaacgctgcgacgacgacgacgacgaagacgggggcggcgctgcgacgacagcggcggcggcagtgctgcgcgacgacgggggcggcagcgctgcgacaacaacgacgacgaccaacacaactatggctgcgaggactattgatacttgctactggtgttcatgactgttgatgcttgctactagtaatgcttgctactagggatgccaggaccagcacaacgacggccgacggcggcgaggactattgatgcttgctactagtgatgccagcgacctn

SEQ ID NO: 6810 - DNA, 707 bp, Oryza sativa
  unsure (1)..(707): unsure at all n locations
ttgcttactcgaaccgccgaaggggatgggtcgagggttaagcccgacggcgatgctcggcggcggctggacgtgaagctcgacgagcgcgccgtcaggccgaagccggaggttgtcggccgaaggtcctcgccgctcgtgttgacgccggcttgcatctgcgtcagcggcgaaggcggagccgcccccgcaacgtggactggttcgttgaactccatgcggatccacggcatggtgaagctgaaggagccggttggaccaaggttgaggaacagcgcaccgacgacgaggatcaggacgacgacgaccgggccgaggcgacggcggcgcggtgccccagctgggcggcggcctgaccgcctgagggagaagaggggaatcgagggagaagactgagtgaaagggcaagagcgacattttttctacccgggcccatatgtcagagctgccaaatagttaaatctaaacggaatagcaacggaacggtgtggagggcgcgataaaattcgacaatggtataaagggagggctcaaatattttagtggcacagggacatatagggccattttggtttgatgccaattcttgcccaaccaattctttggtagttttgaatagtacatnnnnnnnnnnnnnnnnnnnnnnnnnnnnnnnnnnnnnnnnnnnnnnnnnnnnnnnnnaaagagagattctaatggggggcagc

SEQ ID NO: 6811 - DNA, 1533 bp, Oryza sativa
  unsure (1)..(1533): unsure at all n locations
aggtcgtcctcgtcgggaaaggttgggggggacgtcgacgccgggggtaagccaatgtctngggagtaggtcagcccgtcctcgtngtcggtgtcaactagtgcgccatgagaaggatagccagtgccctcgtcagcagccacggcagtggtactgctgctgccgacggcagtggcagtggcgtcgacattgacctcgtcgccggtgttgctgtcgtcagacccggcattggcagtgggatcaacctcgttgccggggtcgttgttgtcggacgcggtggcattgttgctgccggtggggtcgacatcatcgtcaatgtggctgtcagtgtcagtgtcggtgtcgaccggcggaacagcagggaaggcgccgggcttgaacagaaccaggatgacggtcgtgttgtcgcccgatggcaagccaaactgaacaagctcctcacagatgacacgcgcttgtgcaccctcatgcatagcgatattaattggtcacagcaagtcagcaatatttggccacagcaaaaggaacaacagttttaacaacgaaacaatcgagcatgcaagatatttttttgacgtaaacatgcaagatattagtcacagcaatattgatcaaggcaaaaggaacagcagttttaacaacaaaagaatcgaacaatcacaaagcagatgacagtgtacttattagcacttgtttttttcttttttaaaaaatcggatgctttatattgcctgagtgaagtcatttcctagaatttgacacaaaatatttttgctattacagtaggagatctcttgtcctgccaagaagacaaactgagcaaaagaaaaggactcaccaaaagacggtcatgtgtgtgatcaaccacattttgatttgtcatgttgcacctgcatggaaaaaacatagtacagtaggtatgcaactataaatgaaactatatatgcatcagcaggagaaagaaaacagcatcacaaagagtactagtgacatcaaaatgatcaaataataattattgtcagttattttttgttcaaaatttaccagaggccttcagttgctatcacaagaaactccatgtcatcagttatgtccatctgacacagaaagggggattttccatcagaccccacacagcagtacaaacttcaaattcaaccaaatactaaacaaacatagttgcacttacagtcaggatgtccggattacatgtcagcatttgatcttcaggaggtaaacgttcgttcttcttgcaagcgaagtcccctgaaatgtaagtgggtacaacacatcagcaaatcacaacataatatgtttttttttcggtgctattatctgcaataaacgaaaaacagatccaggcaagactataccaattgatcttgagattgatactcttcccctaaaaacagtgaagccccaatggtttttggttacccaccttcccattattttacgataactttccccacagctactccttctggattttgaactcttttcttttagaataactggctgggttatgaccga

SEQ ID NO: 6812 - DNA, 1161 bp, Oryza sativa
  unsure (1)..(1161): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccccgatcctgacgaggagcaagagagccaagaaggcgcagatcgaccagcacgcgacctgatccatggcgggggaggccatggccatgcaatgcaagcgaccgcgttctggtatggagcggtgagtgcaactgtgcaagatcgccgtgcaaagctcaagcactgcaagcctatatagagaggacggaagtggatcttttgactttgtgcggtttacagctcagtaattaacatgtaaaccatattttactgtatttcacgtgtcagtgacataactataaactatacaaagtctaagggcacccacaatggttatctataggctctctataagagatccatgtcagcatattttcctacttggaagagattaaatgaagagagagagcaaagctatctactaacctggagatagtctatagagaaaaacgagacaatatattagagagctatagatacccatgtagacatactattgagatggtttactattaatttagtctattgctgagatgtacatgttttatagatagcaccttactttaccattgcgggtgctctaagaagagagttacatttacattccacgatgcgctacgtgatgaatgctggtgatagatagatactccctccgtcccaaaaaaagacaaaccgtgggtttccgtgtcaatgtttgactgtccgtattatatgaaaattttttataattagtatttttattgttgttagatgataaaacatgattaatactttatacgtgacttatctttttaatttttttataatttttttaaataaaatagatagtcaaacgttgaacatgaaaactaagtttcgttttttttcaacggagggagcagacggactgcatagccatcgcggtgtcgcccacaaaaagccaagcaggactcgaggtcaaaggaagccatatcttttgagatatagatatcataatgactactgatgcactgctatattggagatagtattcggtgacagcgtacaccatatcagtttcgtttaggtttcgttcgattaattcctcttcaaagaaatgag

SEQ ID NO: 6813 - DNA, 4167 bp, Oryza sativa
  unsure (1)..(4167): unsure at all n locations
catgttganacttagaaccctgagaacnnnnnnnnnnnnnnnnnnnnnnnnnnnnnnnnnnnnnnnnnnnnnntgatcccatcttttgacatatagttcgagcctatttgactggaatggtttaggctgaaatctccctggtttggttcgtccggtttggtatttggaggtggggaagtagggtgggttggtttggtgagactccatgagaaagttaactagggcgattttcagttggatttcatcagcttattaatggactaattagcattaatcttaaaatccgttctgatgatgtgttacaccacccaaacatcaaactcgtgtctgttgctcttatactgggaaacaattataaactcctgaggggacgttccatcgttgtttgctacctgccttcactcgtcaagtaggcccgctaaagaaatatttgcatgtgcaataatgcataatccatatcacggttcacaactgagattaaaaattcgtctacaattggaaacaaagtcatagaatgaaaatgagaaccactttattaagtcgccacaaccatttatatataaaagcatgataatgcaaggtagagaacccccatggtatgtagcacaactacgacatagtagcttgttccaagggcacacggactataggatgcagataaagagcattcttcctacccacagtgatgcccatctcctctgtcatgtctagttcgttcggtgcaactcctttagggagctcccagtcgaagtggtacagaagcattgcaagcatgagctccacggtagcatgtccgaatgtcatgccagggcaaatcctcctacccgcaccaaacggtatatactcgaaatttgcacctttaaagtcgatctttccactgtgaaaccgttccggcttgaacacctcaggctcatcccagtgcctagggtctctgttaatcgcccatacgttaacgaacacggtggtgccttgaggcacatcgtaccccatgaccttgcatgtttgacgacactccctcgggagaagcaatggcaccacgggatgaagcctcagggtctccttgatgacaagctttaggtacgtcaggcttgccaagtcgtcttcacttaccatctgcttcccttgaagggtactccgaagctcgatttgtgctttgtgcatcgcttctgggttcctcattagctctgacaagacccactggaccatgtgtgaagatgtgtcactccccgcaccaaagatgtcctgtgtatatattacggcattatacaaagcgaaaatgacactattatcacccactactatagaacctggcatctgtgatgagtcatctgtgacgggtttgacgttaaagcaaatttaatgtatacataccaagagaacggctttgatgttgccggtggtgagaggcacgtcgaggttgtcttccttctggatcctgaggagcgtgtccagcaggtcctcctccatggcgcagtcatcaacctgcgcagccatggcgtccctcagctgctggtgctgtcggaaggcgctgtccattagctggtggcccttccggatgctggcctccgcgcggcgcgtcatgccgccgacggcggcggcgagcctcgacgacgggaacaggtcgtccaggctgaaccccgtgaagctcctcaccgccttcgtgatcgactccaggaactcctcccgcctctcgaacctgtccccgatcacggcgcgcatcgtcgcgtccgccacggccgcggcgatcggcgcgctgacgttcacggcgggggcggcgccgccgtcgtggccggtcggcgaggaggacgacgacgaggcgatggacgcgacgaggcgggcggcctcctcctcgcgcacgcgggggaacgaccgcacgcgccgcgcgctgagcatctccacgacgcacaccttgcggagctgccgccacatggcgccgtagggggcgaacaccacgccctcgcggtgggggcgcagccggcgcacggtgggcggccacggccgcgacgcgaagtcgaggtcgtgcgtgcgcgtcacctcgcgcgcggggtccgcggacgacgcgacgacgacggggacgccgccgagctggaggcgcatgagcggcgcgtcgtcgaggccgcgcgctaggtccgccatggtgcggtggacgagcggtccccggagcatcagctggtggaggttgccgacgaccggcagccgccacgggcccggggggaggcgcacgacgtcgcggcgcgcggcgcccagcctgacgaggagcacgagagccaagaaggcgcatgcgcagatgaaccagtacgcgacttgctccatggcgaccaagctgcgcgtttagatggatctgtgagtgcaagatagaattgcaaaagcctaggccttgcaagcgtatatgtagaggtgagagtgtgagatgagttgcatttctacgtgccgacgtagtggctgaccttgctgagagataatagatttaaataaaacccggcctctgtatcccttggatataatgctctatcttggagatactattcggtgaacattggtcatcttggagatatcttgataataaatgttaagaaatttctgttttagttacaattaatgttttaaagtttatggagtatatctgagtcttacttaaaaattaatgggccacatcacacctgttgtccacagggaataataagacaatactactaagacaataagttcacttgccatctcttatctttccgtcgagtttaaatcatatctctaaatcataatactccatccgtttctaaatatttgacgccgttgactttttaaacatgtttgaccattcgtcttattaaaaaagttaagtaattattatttttttcctatcatttgatttattgttaaatatatttttatgtatacatatagttttacatatttcataaaattttttgaataagacgaacggtcaaacatgtgtaaaaaggttaacgtcgtcaaatatttaggaacgaagggagcactaattaaattcgacgtaaaaattatgggacagtttgtggacttattccagtcaacaggccacattctcccacatgccttgattagatgggcctaaacccagctaatatacgtggaggcccatccatactaggccataagtcctgggagtacctatacatctttcgaaagatttttataatcgtatcacacagatttttaatctttatattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttacagtgtaagtttcataaattacactgtaacttacaaggaaatgcactgtaaatttgagtgagaaaatcgagtgagagataagaaaaaatctttcgagtgagatatagcaaaatcgtaagtccttgtctattccgggctagggttttcggttcaaaacaacgggccgtatattatatgggccattatttagtcggactaccagcccatctccccctccaagcccagcacggcgcaacgcctccacttggcccgccatctcgccgtcccttctcacgagtcacgacgagcgccggccccgcccccgncgggggtacagtacatgcgtgcttcattctaatcttcccccccgcagcattatccacagcggtaacctaattttgagctgagaatttactggcttatgtctcacatcaatagagaagtttggaaggattgcccgctgataaacatatgacatacagagtcaaacacagtaggacgtcaacaagcatgcctacgattgggccgagcccaaaccaaaaaagccccaggctgagaggggttgaggatcaaacgcgcaaggcccatataaaccgccgagaaacgacgagctgggcatattaaagactacattaggtctacgcgctagaatgtaaaggggctttggcagacccaggactctacacatttatctgacccaacaggctgaaagggttgcacgacctacccttttgtttttaaacccaaaggcgggagtttagccacacaaattgccattctgtaccccatccttggaaggtgaccgagggtcttaattttttgcg

SEQ ID NO: 6814 - DNA, 2168 bp, Oryza sativa
  unsure (1)..(2168): unsure at all n locations
tcggtgcccaaataagggcccggttttccccccccccccccccccccccgcgacgagcgtcggcaacggcggcggctggctggctggctgcctcactcctctcatcgaagatcgatttctctcctcctcaacccgctacctcgcctcgcttggatcgaagaaggtacccttctctcattctcctctcggcggctaccgaaccgggcagcccgccctgggtgggattggttcctttatttggcgatgaactactactacccttgctgatccagatttttttttctgtctccagtccatccagtttgctccggatttgattgctgcgtgcgtggagtactgtactgacagcggtttcttcccaagaatttttggggatttttggggattcagcttgagccttcatgctccaacttaggtgctgctcctgatgcgtcttatgagtgtcggatgccgccatggcgctgcgagggcgctgcaaccacttccactctgcagattgtctatctcatcatgtacgcaatctagccgagatgtcagcaatgttaacctcacggtggaggaagaagaggcggcgaggctgatcaagaattcgctctcaaaggcacgcaagtggagtgtacaggacttgattcagtgccttggagccgattgttcgggaatccggcttaccggaaacattgtggacaccttgctgttcaagtttggggatgactggaaatcggcattgggcttctttcagtgggcgcagtcgagggatgattacaggcacacggcttatgcctgcaatcggatggttgacctgcttgggaagatgaggcagattgaccaaatgtgggagctgttgtctgacatgcacggcaaagggttggtcacggttgagacggttgcaaagagcatcaggaggctggcgggtgcgagaagatggaaggatgttgttttgctgtttgataaactggaggatatggggttggaaaggaacacagagacgatgaatgttcttcttgatgtgctctgcaaagagagaaagattgaagtggcacgtgaggtttttgcggtgcttagtccgcacattccgcctgatgcatacacgtttaacatttttgtccatgggtggtgcagtatccgtaggatcgatgaggcaatgtggacaattgaagagatgaaaagacgcggatttccaccttcagtcatcacatacaccactgttcttgaagcttattgtaagcagcgcaactttaggagggtctatgaagttcttgattcaatgggttctcagggctgtcatccaaatgttatcacttacaccatgatcatgacatcgttagcaaagtgcgaaaggtttgaagaagccttgagtgtgtctcatagaatgaagtcatctggttgtaagcctgatacactattctacaactccttgatcaactttcttggtaaatagggccatttgttcgaggctttccaagtatttcgagtggaaatgccaatgaatggtgtgtcccataatctggctacctataacaccatgatttcaatcttttgctactacggtcgagatgatgatgctctcaatgtgctgaaagaaatggaagcacaatcttgtaagcctgacattcagtcatatcggccgcttcttagactttttttaagcagaagaggccaagctgataccgtccggcacttgttgagtgaacttaccagcaaacataatctaggtttagatcttgatacatacacccttctgatacatggtctttgtagagtcggtgataccgtgtgggcgtatcaactgtttgatgagatggttagtagtgaaatagcacctaggagtaaaacatgtgtgatgcttttggatgaagcacaaaggacaaacatggagacttatgttgaaagaatcgggaattacatgagttcctttggaatttctgtttaagtttttaatggatttattctcccatgtgattaatttattagtattcagcatattacatatatttttgcatgaaaaaatgatgcttgctatagtgattgggtgaagcatggacaatctgtatcttaccattaatgcataaactaaaagtcaggaannnnnnnnnnnnnnnnnnnnnnnnnnnnnnnnnnnnnnnnnnnnnnnnnnnnnnnnnnnnnngttatacaatnntcaancacat

SEQ ID NO: 6815 - DNA, 1234 bp, Oryza sativa
  unsure (1)..(1234): unsure at all n locations
ttgctagtatagtatgatgaaaactatatgtcgatgtatttattgtattggagaccatggagaaaaaaccatccacatggggatggaaagtatgtgattatattttggacgaagtctctcgcctgacaccttagaatactaccatcattttggtaacagagttgcaaggcatgttccattggcttaagaatcacagcaataataaccggttaacatgccatctctcctacataaaatgattgattcgattatctggaatagtggtctttatttactatttattgacatggagcaaatgatgcaaatggatcaagacttggatacgccttagcaagagcctggaagatttccaatcaggcgttcattattgataagtaaacaagttgctttacatcaacctctccctatttctatatgatatcagagaagagccgccaaattaatttttagctagtgtatgtgagtaccactaatggctggaaataaaattgtatttctttcgggagaaagaaactcaccaaactgacaccatgtttagatcccaattttttcttcaaactttcaactttttccatcacatcaaactttcctactcacatacacttcaaacttttctgtcacatcgtttcaatttcaaccaaacttctaattttggcgtgaactgttctatgaaactggtgctggtaatgtcctggtgtttgaattcgtgatgcctactgaatccactgttactttctccaggcaacgaatttctgcaccatctctgaatccatcttttgcatctttgtctacttgggggtactgagatacatccatccaaaagaagacataaccgtgcactcttgtactggtgtagttggagattattgtcatataggagtaggagtattagttttgtttgtccgagcttgtccaattcagaggtcatgtgcatctgaattatggcgcctttcacttgtcctgacctctgggattccgccggaccctctgtctgggtccctgtcgtcttcacgtaaactgaaccacttctactgaggacggcattactctgcctggtcggcatgtctgcccattgtcaaaaaaaaaaaagttactactagcatgtagttttgattgagtatttggtttacttttttaaaatggtttatatctccaatcctcgtnnnnnnnnnnnnnnnnnnnnnnnnnnnnnnnnnnctcacgcaggcgcaagtcgattatcattnngacccac

SEQ ID NO: 6816 - DNA, 1724 bp, Oryza sativa
  unsure (1)..(1724): unsure at all n locations
gtgttaatttttgacttgagancggcttgactgcgcccnnnnnnnnnnnnnnnnnnnnnnnnnnnnnnnnttgataaccggttgaatcaacgctactgcatgttagcccttcatgggttttcagtttggaaattgctatgcattctacccaaatgtacaaccagcatacccctagtgtatgttaaggcacagctattgcttgtctggctcgcatggtaagaagcctgagcacggtgaatggtggatgtggcattgtcagatgtaagctgtatgatccagtcatattatagcacgattctttcagttatttgatggttttcatcaaatattattccaactagtaataagtcctttttttcaaacacagtataaatgcatgcgctcaaaatgcgcgtacactcatccatataaatgcatacaaacacaccctattcctatgagcatatccggaaaactggatcgatatattttaagattgacgaagtaaccacggacatctcgttatcgacggtacgtcacctatcactaaatgaataattagccgtaatgcagactagccttgactgcacgcacgtatgggttcgaagcatcccgtgcaaagggaggtgccgtcggtgcagccgtgcagggggagggcaaaggatcgttgcgaatgtgcaactgccgaccagtggcatgtgtgtgggggcggagtcgccggccgaaacgagcggaacttttttctggttcaacggcagttgattcattcatccctcctccagtccagtgtgttattttgggctaatagctgaatggcagaatgatccgaggtaagtaggaataaattattaaccattatatagcaaggtgagtatagcttaactgattatatttatttggtgaaatcagcccatctaatttaacacgaatgctcgcatttatggttatttatatatattttttggataggtgggatgtgcgtgtgcacccacattgtgagcgtcttagtttgcgctgtatatttttttaaaaaaataaatttcaaatagtgtttgagaaaattcatgtgtagaaagtttacaaaagttcacgcagtttgaagctcgggaaagcgcgtatatttttattccgttccggagaaaatgaccactcccggtcacatgtgtagcctctccgcgaaataaaaagtaacatgtctaggtaatgccgtgcacatgattaaggtagacgatcaacatgcacacccaacacatgggattcggatcaaatgcagtagtagtatggactgcaacttaaacagttgtagctgctacgttggatctaaatccaacggtaagtattaggtcggttactgtagcaaaagtaccaaaccataaaatattgttcagggtactgtagcacgagtactgtagcagttgatctgaactgtttatcacaaaaatgaatggctgaaaatgcatgcagtcctgagaattacgactgcacccgatctcaatcccaacacatgcgggggtccatcgttgtctgcacaagatgctaatctgcggtcaagggaaagctgataaacactgctccgtctctgacaccaaggttagattgatgatactcctacagattgttcgccatcatataatttcagatcaaaggcgttctctgtccacttcgcagcatccaaatcaaccacannnnnnnnnnnnnnnnnnnnnnnnnnnnnngtgcattccagggcattcaggnnaactgcg

SEQ ID NO: 6817 - DNA, 3871 bp, Oryza sativa
  unsure (1)..(3871): unsure at all n locations
agtgtttgnnnattgaatgcanatcctatagcacnnnnnnnnnnnnnnnnnnnnnnnnnnnnnnnnnnnnnnnnnnnnnnnnnnnnnattcttatattttgaaacggaggtaataagtttgtgtgaaatgcaaaatacaagtagttcgaattatgtttgattcgactgcaaatctgtattaagatgacacattgcatcaatgtacaaatctgacgatgacagattattgtcgggcacagagcgtagtactagtaataagaaccatagtttaacaatactcaggcagagctcatattgaattcactaaattcaaaaacatttgatgctgcattgtacggagtactacacagtggcagccattgaatttgaaatcaagtccattattacctcctgtggctatttttaattacacgcatattactcctgtcggccaaaatagccatgattagcactaacccagtactgaaactacaaagaagaaatcgccatcaccatgatcatcatcatgcacatcaactatgtgcaggcctaccatcgctaaaaagcaagccaccaaactgcacaggacagtacaaccctttttgcatcattttgccaacccaaaccctaaaaccaatccaaatcaaaccaaccaccttcctgcgttgatgaccactgctgatcctggtgcaatggctatcactctctctctctctctctgtctgcctggcgtgcgtgtccccctcatcaatgacactgtttcgtttcacctttaattaaagattcctatcctctccaatgattctttgctctttttttttctctcattctgatcatgcaaaaatttccattgaattctctgtctccctgctttcagtgaaaactgaatactgaagaagagagataatgcatccatccatgtgtgtgtgtgctgtgttgtgttaagctttcctttacaaagaggaggaccacggtgctttgtcagtgtcactgcctcactgtttgtggtctcaccttttccctatcacgtcctcaacttacactagtctacatgccacctttatcactgtgcttgaaatccatggctattttagtggcctaatgcaagagtactcttcttgaccctggtggtgagtggtgactggtgagctgagctgagcttgcagttttggttcttggggtcttgaggagttgagctgtggtgcttaacacaggcatagctgctgctttctttctttcacaaggtattctttgttttcaaattggcttcattgcttggtcatgttgtatgtctaattatgtgttcctatgttcttggcttttcctgtcaatgtgtactagactactagtgctgttctgctctgcaatatctagtggtcttgctatttgtagaacagaatgtgaaaagaacagcacatttgtttaattttagagtttcagagcagtatgttcttcacctatgaaaaaaaaaactacaatctcctttcttggcagaaaagcagtggcaacaaattgggtaattctattcttctgatctccattctgcatatggcctctccccttacagcttgcaaatgctttcatcctactagcagtgcaatagtgcaatccaaccacgagcaataaataattgggtttttttcttattcttttctattaatgtagtcagctcacatggtgccatcttcttcttccactttggtgcagttgttggcattggctccatgtgatcgatgagctgagagagctcagctcagctcagctcactttcgccactgcagcatcggcgagctagagctgtagatcttgggaagatccagcaatggagaagccggcgtcgtgctgctgctacttcccgctgcggtgggagagcaccggcgaccagtggtggtacgcgtcgccgatcgactgggcggcggcggacggccactacgacatcgtccggcagctgctgcacctcgacccgaacctcctcatcaagctcacctcgctccgccggatccgcaggctcgaggcgctctgggacgacgacgcgcgcttcgccggcgcggcggggcaccgcgcgggcgtcgcccggagcctcctgctggagtgcgagtgcagcaagaacgggggcgccgccgccgccgccgagaacacgctgctccgggcggggtacggcgggtggctgctctactcggcggcgtcggcgggggacatggcgttcgtgcaggagctcatggagagggaccccttgctggtgttcggcgagggcgagtacggcgtcacggacatgttctacgccgccgcgaggggcgggaacgccgaggtgttcaggctgctgctggaccacgccatgtcgccgaggtgctcgacgaattgccccaacggcggggaaggcgcgcgcggcggtggcggtggccgctcctcggtgttccggctggagatgatgagcagggcggtccacgccgccgcgaggggcggcagcgtggagatgctgagggagctcatcgagcgccgctccgacgtgtcggagtatctcgacttccgtggatccaccgtgctgcatgctgctgcagggagagggcagctagaggtgaggcatctacttcttggccattgcttacttcactacttctgcaaaatgcaccatagtgaacttctgtttgtgccaatatgcatggatgacaaggtagatgcccatttcatcaggatgtttgggtgaaaatatttctaaactcgatatctttcaacgttatgaaaccaattttgccttttgatgcgctgcaggttcttacccggtaatcgatttcaacataaatattaaggaacaaattattttcattcgtcctatgtgatgattagtttgagcttggaaggatattgttcagctagaatgctgcgtgtaacccaaggagacattgagatatgtagatagttgtcattaaagaacattttttttatcttatataataagcataccacgcccagatgataaaggctcatttagttaatatcgtcatgctcaactctccagtgtattatgaaccaaagaataattataaagaccatactgatttggcctctttgacatggacttcaagttgtgcaattcatgaccagattttctttaggaattttagttagaagcaacaaaagctccaatcattgatctctctccaataattcgagttgaaaagtggatgtactccttgtcgatccagtttagatgggggtaaaatcacactttttagatatatacgggtcctttctgtctcttgatgttgatattcagccaactttctttctgtttcttgatgctgatattcagccaatatttcttgccacaaatcattgtaatgttaggtgtgcaaagctccagttatatgcaaactagaatggaagtttccttctcccagtattatgcccttatgtatgtaaaacatacctcttgcaggttgtcaagtaccttatggccactttcgacattgtcgattcgactgataatcaagggaacacggcattacatgtagcggcctaccgagggcatctgcctgttgtagaggcattggttgctgcatctccatcaaccatttcagctgtcaacagagctggtgatactttccttcattcagcaattgcaggtttcagaaccccaggcttccgacggcttgaccgccaaatggagcttatgagacacctgatacgtggaagaacatcaaatatccaaaagattatcaacctgaagaatgatgcaggcctcacagtccttcacatggctgtggttggttgtgttcatccagacctcgtcgaactcctgatgacaaccccatcgatcgacctcaatgctgaagatgccaatggcatgactccacttgcattgctgaaacagcagctgcgctctttaacatct

SEQ ID NO: 6818 - DNA, 5465 bp, Oryza sativa
  unsure (1)..(5465): unsure at all n locations
actgagcaacaagnccgtcgagacccggccccgctcaggcagacatcaccaagacgacggcgctgaacaacaagaggaccctcgcggtgaagacctcgactcccagctcggccaccaagaagaagctcaacagcaagctcatccacggcatcatggaggccatgccgcacctggcgtcctcgtctccggcgtccgccttcccgaggtcctccaccccgccgccgccgcagtccggcaagatgaagggcgtctgcctggaactggacgacgagaactcgatgacgacgccggtgttcggcaagctgaaggacatcgtgctgaacaacgacgacgatgatgacgccatgggcgagccgtcgagctcggggtcgtccgtgaacgacgacgcgtcggcggagatgccggcgcggcggcacgggtgcggcaacgggaggctgatcaacatctgcttcggcgcgcagggcctcaccgtggaggactcggccagcgggcagcagaccagcaagatgttcaagcagcagtgcctcagggtgtcctgactcccgagtgactcacacgcgcacacggtataattagcctgcttttctttggttttctgactcgaattgagcttgcagttcaacggaacatatatggtttctgcatgttgaactcgtcgggcttgtgtggattttgttggctgctgcgtgtaaccgtatccttgcgtggcgtgcttggtttctggttgggcttgtgttaacgccttaacggcttacttcgatgcaaatatatttggtgaatgtatcagctagttgtggtgagttagtcgatcgttttgtttaatttaaacaaacaaacagcagttattcacgtttccggaagaatccctgcacaaaacggaatgaggaaagacaagaaatatcttgtgtattgagaatattgaacatccacaacaaacagtcgacaaacatctgacaggagacaacaaattgcgctaaaagacgcatgaattttctttttttttccctgtaaacaagaaaagcagaagctttttcctatttgcccatatgcccagcaaacaactatcgcttcctccactacatcaaaattcgaatttacagcaggaagcaattggacaaaccgaaaactagagaacgaacgaacgaaaaatctataagccgctgggcaacaccttttgccgctgggagctttagcacctggatcactaattcactatgtgcaaagaaccatttggtcctctcattgcttacccaccttgcggcctggccatggcacttcaaagatggctacatacatacacccgacaacagctcggagtaccgcaagtcgcggccattatggctgtgccgtccttcaagcacatatgatgatttgtagggcaggttaccgcgatactccaggcgcataatttacgacatccagcagcatcaaaattgagggccttgttcgagctagtttggaaacagaaggaaggagcgtctaccatatgcacagctaattcagcaactagcccacaagcactgggactagttgatctctccttcctctgcatctttagtgctggggacactgctaggatcttcttcctcttcctcctcatctgctttcatgaagagtcccagctgttccaatggattgcctgatccaggaagaaaactgggcatgccatcctgggaatgctcaggactagtctcatcaacagaactcacaatatgttctgtggttgccgttccaagcatttccaaatcctttagatggaggttgtcattgatttccaccgttctctccatctgcattaagttaaaccactcaaattttagcgggaaaaagaaagctcgacaccagtaaatgcagtttttttcactagcctcctgcagggcctggcgagctttctccctctcaaggtcccgtttacgcttggcttcagcttcagcttcagctcttcgagcttccatagctgcatttccttcagccaacagccttgctttctctgaatacatagataaggcacttctcagggaaaatgtaagaaccatcatttaagagtaaacttcaggtggatatgcctgttaccttccttctggagcttttccagctcctcctgtttgtctccaccctgagctcaccaaatgttcgttccatgtcagaagcagcgcaacaaaagtgaacaaacaaaaccactcgatgaaactaatcacaaacctggctgagaatcccctgtgccttaacaatcacatcagcataacgactcctaaggagggctgctcttaagagcttgtctggggagacttgcctgtcgggttttgaattctcccctaaagtttcatagggaaaggatcagatgatccaatcagcttaatgcactgagaccccttaatggcctcatatgtactgcttgcaaattcatgcttaccctctggggcaggctttgactcgttatcctgctcacggagctccacatcatcagcaggacctgtgattttgaaagttgtaagagcattaagccaaaagctcatccaactgccacatgaaactacaaacttgtgctgctgtgacgattaaggtgcattttgatttctaaaggtaatttttttgtagattttaacccaaaacttggtcaaactacaattacatttagtgcataaaacataccaatagatttatatttcaaagagttctcacactgatattatgcaggtgcttattgttgaatactttttcaaatcaaaataagccttaagaagacgtggggaggtagtagaacagaaagggcacaggaatcttacggatggcatcgactggacttataacatcactcttttcttgctccaccagttgttcagatctcttactttcctaaattatatagatgacaactatttcagtgcaataacacggaagaaaaggaaaagttgtttcgatgagaagaaaaaagcaaccttgacaaaatgattaagagggatagatatcacattcaaaattgagcctaaatttctcaaagtaccacagtaatagattatttaaacgaacatgtctgtttctgaccaaattagacaataagggtatattaaattaatatgagagtcagcttatacagtatgcaggggctgatgtctgattatagatgcatagcaatcaaccggccagaacaaaatattcacaatttttcatcaagcacccaatgacaaatagccaaaataccttcggctttcctgggctaccacctttttcttgttcgctttcactgtcactgcccgactcagaatctgcattattggagtaaatgtgattgaggacacctcaagacaaactcatgataaaggaaggcttatgacaagtgggactagcagaagtccaaacaggaacaattacgcaaacatttagccacacaaacaagatatgatgcatgtattgctattctgaagataagataagattgttgcaaattagcacaagggtaaattgcaggatggtatcctgcttgttcgtcagttaacgatatgaataacagtaaccccagttaaagtttctataatactgataatctagtcccccagaagatcaaagaaagagggaatattgttgaatgcatgagcatgcatactgactagtgggcatctaatggtacagatgcacctacagtgaagtataattgtgcgtacttcttgttcagtgcctcgttagctaaactcaactaaacatctactcaaaagtaattagcttcaagcttaaacgtcacagaagttaatataatgaaatacacaagtgtttgaagtaaccagatcattcttgcaaaaacatatttgtttacaaggacatatatcatactaaagagagtatgtaagcacagaggagcacagaccgctggaagaagatccagagtcactgctggaactacttgggctaccacacttgttaggattgttgtgtgcatctttttctatcaatataggggatgcattcccgcaaatatctacatcctcctcaactggatcaccacctgcagagaaaaagaagttgtaagagtactgtgatgttgcataaaactaagcattagcaaaggaccagggaaaaaaacctttgcagggatttgtagaggagtggctaaggccagatacattagcagcctcattctcagaaggctcagattttgcctgctggctctgctctctctcttgcaaatacttgtcaacatgtttcttcaactcgaatagtaggtcatcactgacagcatggatatcaatctctatctctccatcaccaagctgatctgtgttgttgtcaatgcattgctgcaacaaatcaatgatgtgtgaaggtacctccggatcctcagacaaagatgccaaacagttcccaaatgattctttctcctcgaatgtcatttttggctttacagactctgttggtctaacagactctgttggcctcacacactctgttgacacctcactgcagtccacagggggagtcttcctcctctttgagtcagccctgtcaacctcgacgtgcgcctctgtggcaatggaagccagcttcttttcaattgtcctccatcttgattcaaacatcttgtttagttgaatggcataatcatgcactacatgcccacgaggattgtaagtcatcgcatttgaaaaggtcagccgtacatcggctgcaaattcagatggactcgtgtaggaaccagagtcaagcttattcctgatagttccaagatccatcggtttcttgatgatttgaaaataatctggaatattcagcttaacagcatcaaccggggagtcgaatatgttactacatttctgagtcatcagctttttcagaatagcatcgcattgcttaaaaatcgcatcctcagtcaacaccgtggaagcctcaggtcggggctttgtaggcaagaaacgccccttggcaccacggaccacatggttaccacgctgtcccttcttacctcgaggggcagccgaggacgagagcgcgggagctctattgacagggacagggacagcaaactccggcttcttgaggagattccggaccgaatcaagctctgtgcggaacctcttccggagatgcctcctctcggaggaggacatcttggctgggacgaaaatctcccgcttgacatcgaagccgtcgctgtttaggctgatgcacttgcgcttgggggccgaagagtcctcggagtcaacacgaacggggctgcctgccgcgccctccgactcgccaacggtctccgcgtaaccccgtggcgccgctgacgccatgccccggaacgccatttcatcgtagccccgcttaatctgcctctgctgcccaaactccatcaggaccgtcggtgtcatgtgcccgggcgccagatctgttcaccattgacaaccataagagacccaagattcagtnnnnnnnnnnnnnnnnnnnnnnnnnnnnnnngtggntgtcaggaggtgacttctacacag

SEQ ID NO: 6819 - DNA, 1358 bp, Oryza sativa
  unsure (1)..(1358): unsure at all n locations
tctccctctcgagtcgagccgtctcctgcttatccttttccttcgcgaagcgactcgacttgagccgangccagntgnaaggagcccgangcgangcgnggaagagcgaaagtgnagatccgcgcgggggaagcgagagacccgaaactgggaagcgaagcgatgcgagactgtgacgcgcgaggggcggacgccctcgcgggcggtatttataggcgggggtgaggccgcgggtcggatccgggccgtcggcttcgcggggatcggacggaccaggggttagatctgggcgtgggccccacccgggccgacgtgacgtggagcggggcgcgctttgactttcttcgagaaggtccgcgcgcggacgcggattcctacccgaactgaggatgacgtgtggggcctactatagctcgggaccacctgtcagtgaccttgaggggtcgtgttggggtgggtggtgcggagatcgcccgtcttttatcgagcacgcgggatctgggtacggtttgggcgcgccggggagcgaggtgacttggaggagaaggcttggtgccacgtggaagaaggtgcgtggctgggttattggagggaaggatgtaacgggtacgggttaggtaccgaaagaaaaaaacggaaggttagtcgttcgctccattttccatgcgattttcctttttaataaaagggccatattcggcccaagaaaataagggcctaaattgtaggccttttgtataagaataagtccaccttgactcccttaaaagtgaccgaatctaatccgtgtccctgaaccgcaaaaccagatatcatggccccctcaactgttaaaaccggtgcaacttacctcccttagcagttttggagaatggctttactgatgtggtgtctttgactcgatccaactagctaactcagcttgtgggacctacacgttagtgtcacaattttatctctctcctttctttctttattcctctctttttcccacgctgtctaacagcaaccgaggcggatgcggattggcaacgatagcgccgtcgcggccacacctcacggcgcggggtacggtggccacctcgctgacaccgccgcgggtggcgcttctttctcccgctccgcatggtcggcctcgacctccgcgacagccacctcgcggacacggccatttgctcggcgactggacgtctcgcggcggcggtggcatcgccctcgcctctattttcccccaagcgtgcgtgcgtgtacaccacgtccacggcgcacgtctgcgtcaagaacgtcgcgccagccggggcacccacgtcaacagatgggttcgcttcttcgccgcgtcgagagggttcagcttgaga

SEQ ID NO: 6820 - DNA, 756 bp, Oryza sativa
  unsure (1)..(756): unsure at all n locations
ncactcctcgagcgtgggatcagcagcaaagccgatccgacaccagagatgcgtccggctcaggtatttaagcgcgatgctttcttctccttgcgcttcgctgcacaaccacttttccgcatctctctcctctctctctctctctctctgtctctctcgcaacgtactcatctcaaaagcagtaccggcgaaaggtgcgaggtgagttgtgagattctcctcctcctccatccctaaaccctacgtcctcccaaagcgccgtgagattcttctccctttccttcgatctcgctcttctggtggtgttctccctctcctcctggtggtgtggtttctgcgtgcttgggtgtttgggggcgtcgcggttttttctggttcgatcatgtctttcgctgttgtggcatttgatcgagcagcaaccgcgtcttgacctctctttgaatcttgaggcgtttcgtcatccgaaacttggggcaaggatcacagctgtttgatctttttttccctctcttgtaggcttcccgtaccgtgcttttgttgcttcgatggttttgaagtttgaggtggagtgtggttttctgagttggaggaggaggctgatgagcaccgaagcttcatggtgtattgatcttgctgtgtgtgtctcaaagtctctaccagtgcgtgcgcaaaaaattagaccacgtcaattcgnnnnnnnnnnnnnnnnnnnnnnnnnnnnnnnnnnnngtgtcaggcaggntgtctccgacacct

SEQ ID NO: 6821 - DNA, 678 bp, Oryza sativa
cacgccgtgaacactctatgatcatcgcaggggagctgttctatccatagctaatctattattaacccatgctgacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatacggagcgtcgatccctcgcccacacggtacttaatttttattaatactattaaatacctgtatgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagcttcagaggcgcacactcaggagcagccagaggtcacacctgtacaggcaggacgggttggccgtgccgtacccccagaccgactcacgtactcccaggggcacattaaggcgcagggtaagagggacaagggtaagaggcctcgtcagtagtgttctacctcttcagttcttatgtgaccgtttcttttggcttacaaactttgtaagcagtactaattttg

SEQ ID NO: 6822 - DNA, 1607 bp, Oryza sativa
  unsure (1)..(1607): unsure at all n locations
ctgttctttgtgatcctcnnnnnnnnnnnnnnnnnnnnnnnnnnnnnnnnnnnnnnnnnnnnnnnnnnnnnnnnnnnatgatcatacttacagctaattatttttttagtgacaaacatatctgtcgacagcaaaacacccgtggtgacttcatccacatgtcagtcagtcttctggagataatatatgagtaaagtactgagagatccccttataatttacccaaagcgtgaccatgtgtgaataaattttgagctagtagggttgcaggcacgagtaagtcttcccttgttattgcgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaccggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatnnnnnnnnnnnnnnnnnnnnnnnnnnnnnnnnnnnnnnnnnnnnnnnnnnnnnnnnnnnnnnnngatatcaacaaaggnntcaaancgcccgtcgccc

SEQ ID NO: 6823 - DNA, 794 bp, Oryza sativa
  unsure (1)..(794): unsure at all n locations
cgagtttctgttataccgtgcaagatccgatgtctccgagtcttacttgggataaaaatgacccacgatataaaagggaccccaaggaggggtgcaaggcatcatatctcatcgccaacacacccactgtagtttacgaagtcagagtacgcgaagccaagtcgccgggagatcttgtcgaatacatcgactacgatctttctacttttgttgtaatacgtggttttccatcatcaatctcatataaaaactggactagggctattaacctgacaaggggcctgaaccagtataatccttatcttttgtttgcttgatgtcgtattgcgtagatcatcgttccaatgtaccctagtacccaaatcatctggtctacaagtatcactcgtcgatactaaggtgtcttatgatgggtgagtatcttttacaaaatggtactatcattacaatcactgacacgtaggttccacttttctattgtcatccacgtcaatggctttgtttggatcctccaggctattaaatagccctccggaatcttactatttatgagtattaaacgtagattactaacaaaacccattccataacccctgaactattttgcgagacgaatctaacgaggtatattaatccatgatcaaactattttgtgagacgaatctaacgagatatattaatccatgatttattttgcgagacgaatctaacgaggtatattaaatattaatatacctcgttaaattcgtctcacaaaataaacccagggttatgacgctataccctccgttacn

SEQ ID NO: 6824 - DNA, 4134 bp, Oryza sativa
  unsure (1)..(4134): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgcttaccgaacgatgccaggtatacacacagtaatgcccagatttttctcaccagcacacatcagatctagtgacataccaaacgaacagtaaaaaagacatcaataaactgctgcatacagcagcggtttccactcagcgtgtacttgcgcactagcgcgctcattgggcctcacaagtactacatggaaacacgcggcgtgcgtgcgtccatgagtccatccacgcgcgacgagctgtgtttgtgcttgtgcccaaacattcgagcacagagcagccaatcccttcccttcgcatgcgtgcccaaaaaagttgcacttgtcacgtggggcgatggggtgtcgcgcgcctcgccgccttggattctagccacgcagcgggggaacaaaaccacatgctgggcttagcttagctcccatatgcgcacagcagcacagctcgtgctaaccgacgacggcacacagtagcctcacatgagtcgctcgcggcccaaaagcacacccccaacacaaccacacgcactacctacctgcacccgttcgtgcacgagaaacaggggcaggaaggatggccgttagatctctacttccagcggccaagaatctcctgtgacgccgcaaagaaaacgaatgaaacaaccgaaagtaacttgttcttaacgatttaaaaactaatattaaaaaaaataaaccacgctaaaaaattattgaaataaactttaatatgaagttcaaattttgaatttcaattatggctgataagctactagaggctggagcgatgtagaatgcgaactggatgggagggtgaaaatgatgagcggggattgcgatttttttacttactttttttaacttaaaatcaataatatgtggaaccgctattcagaaaggtcatatgttagtgatcacgttaaaagaaaaagtaaataatacttcctccgtttcacaatgtaagtcattctagcatttctctcacatttatattgatgttaatgaatctggatagatatatatgtctatattcattaacatcaatataaatgtggaaaatgctaaaatgatttacattgtgaaacggaaggagtagaatcctgttgcgatgagcggtgcatcgtcgtggggagaacgtgtggctcgttgatgatcggcggtgccatgttttcagggaccgagcggcaacttttgtgctgatagcgtgcgtcctgccgggcgggcgtgcgtcgttatgtgagggcaaggccgcttatatgctgccgcaattaatcggaagaagctgaccggtgccggccctgaggacgtccacggtgcagacgtgcacacacagtacagtctccgcttgttacagtgaccgccaatcatgagctcaacactctctattcccttcctgattgctgacagctgcagctgacttccttccagctatagcagcagcagtagctgccgtcacttcgccaccacagtgttctcatctccctttcatatcccctgcttcctctccgtccatggaggaggtggcagtagcagctggcatcctcctcctctgatctcctcctcggtcacttcagtgcttacttgccggtgatgaggaggtcttctcaggggaagagctccagcggcggcggcgttggcggcgtacggaggtatgacgtgcacggtggtggtaacttgctggcctgctacgcgaaggcggcgaggccgaggccgtccaagtgggacgacgcgcagaagtggctctcccgggcgggcgacgacgactgcggcggcgaagctacccggcggaggagctcctgcgccagcgccgacgacgggctgctgctgcctcctccgccggcggcgcggaaaggggccggcggctggcgatcgtggagcaacgtggaatgggagggcgcgcccccggcgatggcgccggcgctgaaagccgcgcgcggcgacgagggggtggacaccaaggtggtggacgccgtgcaggcgtacgtgccgcagcggtgcgtggtgtcgctgagggaccgtcggcacggagatgacgcccggcgggagcaaggagccgtcgagggcgaacactccccgcgtcgtcgcgccggcggcgaccgcccgtgtcgtcgcgcggggcacggcttcgcctgggcaatgcgacggcgggtcgcgtgacagcaccgtcgccggcggcgtggtggatctccgggcggctcgcaagcgcgccgatcaggggcacgacgaagtcgcgggcacgatcacggccgtgtcgcccgcgacggcgtggggcgacgcggagcgcgccaagtacatggccaggtgaccgatcgcgttccctgctgctcatcaattttctttcatcttatcgatattaacatcaatataaatataagaaatactagaataacttatattgggaaagggggaagcagttctttgcttgttatccgtctaaaaccagcaaattcgactaaaaatttagttgctcatctcctctctaaatccatggttaaaatcggtttgaactacgaaatcctgctgcaaaaatgcgctaaagctgtgctctgcatgtgcagtcaacagtgcgcagcattttctttcgttagcattttcttttgtcggacagcaccacatcagtgctgaactgtcagctagaagcactgagacaatgacatcctctgaaagcctgaaaccaaaagcaagcagctaccaccactatacttgtctactcacgtttgcatcgtgtgccattgccattttcgctttgtcaggtacaggcgcgaggagatgagaatccaggcgtgggagaaccgggagcggcggaaggcggagctgcagatgcggacggcggaggagaaggccgagcggatgaggctgcgcgcgcaggcgaggacggcggggaagctggcgacggcgcaggcggaggccaaggcgcggcgcgcgcgcgccgaggccgagctggcgctgggcccgcccggaaggcggtgccaagggttggctgctcacgcggagcgcgagctggagcagcggcagcggccgctcgccctcctctctctcgctccggttgccgctgctgtgccgctgagaaaaatccactgccacagtcaaaaggctcgtgatcgatctgagagtttccgctgcttgttgaaggcggtttctgatgtactactagtaccaggcacagaagaattttatctttgtaccatcaatgaagacccgtttagtttcccaaaagtttttcctaaaaacatcacatcaaatttttagacacatacatggagcattaaatatagattaaaagaaaaactaattgcacagttatggaggaaatcacgagacgaattttttgagtctaattaatccataattagccataagtgctacagtaacccacatatgctaatgacggattaattaggcttaaaagattcgtgtcgcggtttctagacgagttatgaaattagttttttcattcgtgtccgaaaatcccttccaacatccgattaaacatccgatatgacacctaaaaatttttatttcacgaactaaacagtcccgaaatataatcttgttacacgaataaatcagattgttttattgtactattcggcatcaatcacggcatgttatggtccgtgccatttttcaattcaagcatgtggtatgtagttggactctttgaccaacctgtcaggtcggccactaccagtccatttccactctcggcgtcggggccccacctgtcatggacccgaatccccccgcgccgcgtacgcgaaggtcggtgggaaaccggcagagcaaaccgcacgataagaacgcggccgacgtggaccacgtggtgcgcggacgctctgcgtgcccgacttggctttctcctcctctctcctcccgcaacccgcgcacgattcggttccccctctcctcgcggccgcctcttcccccctcgaatcccgataagcagaggcggaattctccaccggggcagcaacatgcaacccccagttcgattcggctgcgaggtgaggtcgtccn

SEQ ID NO: 6825 - DNA, 1854 bp, Oryza sativa
  unsure (1)..(1854): unsure at all n locations
cggcctcnnaactaagatctgtggcaancacnnnnnnnnnnnnnnnnnnnnnnnnnnnnnnncttgcctgtcatgagctcactgtctagcataggcgatggacactcgccaatgattttggatgtgtcagttgataaggtacaggagtatgagaagaacaggattgtggatgaggaggaagagggatacccaacaatgagaaacattctgacctcaagatgggcagatgctggcgacgaggaggaaaatgtgtttgtgcccaagaaaaagaagagcgtgtcacctgtcgactcgattgaacgagggtccacaaaaaaggttacaagccctgagtctggagaggtgctggtgtataactcagtgagaagctcctcaaggtcatctgactcgggggtattacagggtagtgcaaaccgggaccttgaagtggagaagggtgacaacatagatgttgaggaggcggctgatgatgattatcctgctggtcatttgctggattctgattttgaaggtgaggactgtaggtctgaaacccctgagtgtacacggtccccacgtaggtgcattaacatgcttcaaggttgtaggagcgttgatgagtttgaaagactcaacacaatcaatgagggtacatatggagttgtatttagggtgagggataagagaactggtgagattgttgcgctgaagaaggtcaagatggagaaggaaagggaaggtttcccactgacttctcttagggaaatgaatatcttgttatccttccaccacccttcgattgtggaagtcaaggaagtagttgttggtagtaatgacagagatattttcatggtgatggagtacatggaacatgatcttaagggtgttatggagacaatgaaacaaccgtatagtcaaagtgaggtcaaatgcttgatgcttcagctattagaaggtgtgaagtatcttcatgacaattgggtacttcataggtaatgattgttaatcactaatttttcttctcctttacacattttctggaattggttttgatgttagattctaataattatgctgttccatagggatctcaagacatctaatcttctcttgaacaaccgcggtgagttgaaaatatgtgattttggactctctcgtcaatatggcagcccgttaaagccttacacccagttggttgtgactttgtggtacaggtaagtcattagacagtctatagtttcatacaatcagtctaactcaaaatttaacttatccatggtcttattacatgctccttatgactgcagggctccagaattacttttaggtgcaaaggattattctactgctattgatatgtggtcattgggttgcattatgggagaactcttatcaaaagggccactgttcaatgggaaaagcgagatagatcaacttgataaggtatatggttttgacttttgtctattccatatctttattttgattaaggaaatcttatgatgaagtgatttccattgcagatatttagaacacttggcacgcctgatgagaatatatggcctggttattctaagttgcctggtgccaccgtcaaatttggcaaacaaacgtaagtgccaactcatttcttgtttctgctggtttatttatttggatcatgcagtttctgtatcatataaagtcttaccactcattcctccctcaggcacaatagattaagggacaagttccgagctgtatcattcactggtgggccgatgttgtcagaagctggatttgatctgctaaatagattactgacatatgaccctgagaaggtaatacacttaatagagtgatccatctgattcttggatcttcattttgtagctg

SEQ ID NO: 6826 - DNA, 3700 bp, Oryza sativa
  unsure (1)..(3700): unsure at all n locations
atcacaaactgatggcgttctttagcaggcatatgaagggggataacatgtctccttatggtccatgctagctattatatcattgcagggttactgggttagctctttctcagacttctggtcacaatctaattcacctgcattataaggtgtgcagatctaacccacctgcatgatctggcctattaacttctatctggtgcaccagttttgcttctgaaatttctgactgtaaagtaccttagtttggtactttgtaaacaatgatcaacaggacctttttttttctgtgcaatgagcacattttcttttgatcttcgcattttgtttgcaagagatggatggagcaaaagagggagggtgcattatgctttttgacgaggaaactggtacatagtaatgcaaaatgtaaggtaatatgctgaggcttattgtgtccactgatgtggtgtataaaaatgaaatgtatctttaatcttttttactgtactttgcaagatcacttcagttgctccctgaagctgcttgaaaactagctaatttatgtaactggtcattataaaaatgatcctccactttctggaaggaaacaatacctgtcagatttttcaatatcacttgcgtgctacaatgatgtattactgactctatctacttctaatcttgtgtaatagaagaaccaatcaatttaatatcatttgcttgctacaatgatttatcagacaataactgactcttgtctacttctaatcttgtacagtataatagaagaaatcaataatctaaggacgtacgattgtattaatttatctttggaccatttgtcttgcatcatttttttgtaacaagtgacagccaggaagagttctttgtttttatttatttatttatattttcttctaatgatctacctttttaatgataggccgctagacttttatcaaccaaatcattattcatgataatggtgaaagatgtgaaatgtttttaactctgaggtgctggcttttccctcatgaaaaggcaatactcactgatctttgattcattttgctatcctgttgccgtatgttcagttcaaatcatttgcttgtgctttacagatgattatagtgaaatcagtgattcttatgatgtccattcttgcacttatcataataaatctacatgtcatattgacttatcactaaagttcttgccagaccagttaatgatgttcctttatgctagtttgaacttgctggagagttgattgggttcactgtaaacaactaagtgttctgtgacacatctgcagcttaagctgtggctataccgagacaggaagcttgatggacgtatctaattgacttatttgtggaaggcttcgagtcttcatctgtgatctgttactgttgtgaattctagtggtcagtctgctatcttatttctcaatatattggtgatcagtatgcttcttgctagtagcttcttttgtagctgtacacctgtttttttttttcaatgacagatatattcttgacatgttatattttcagtcctgcccatccacatatgtgggacatgattttagtacgagttaccagcctagatgtgtggatgaatcaggattttgggcaatccataatttcttgtatctccttgtgtccatgcctgcaagtacagctgtgtgttatcctgcagaacctttcgttcttttgttattctttttcaagtagaatcatgttgaagaattgcttgcatttgataaaataatattgagtctggattctgcaactggaaactcattgtagactggtagaaacaaggaaaactgtgcttttgtaattcatttccacaaatcatttactcttactcctacctttttcctttatgttttagtaagatgcagactgaccaagaacaacgttgaggcgcaggacttgtcatggttgtccagtattttcgaaggttgattctatcaattccgcctgccttttatatatatttacaattacccacattccttgccagttgacaccatgatcctactttttatcttctgctttacaatctttcagtgctgctttgctaattttctactgtgctactatcaaattgcatgctttactggcactattttcactaattatttctcttgcgcacctgtgaaaagtttgatgcccctgtggctaataacttttttagggtcatgggttacttgttttaaacttataagtaaatattctattgagtgaaaggcttgaaaattttgtcaccaagatgcgaacgaccattaaatactcagcacagttaaagcttggaaaataaggttacatgtttagcatgacagtgcgtgaagtagagaaaaaagcgctgtcagcaattatgctttcctgaagcaaatcgatgtttctggtattcgaacttttagggcatacaaaacagtctttatagcaggctcttgggggtaccacctaagctcagttaatatcaactctctgtagactcttagcgccagataatagggaatttcctcgcatgaggctagataaagggaaagaagaataatgataaaaatattttggtggattcatggttagagcttctgttgtctcaattgttataagaggatagtctctaagatgatgtgtattaccaaggaacccatactaggctcaactgttgtacttaccatactacctccgttgtaaataagtgcatttctggtttcctaagtcaaactatcctaattttaaccaaattcatagaaaaaacaatactccaataattactattcaaatgagcatcattagttccattgtgaaatatattcatagttttacttatttgacatggtagacattattactcttatctataaacttatgcatttgatttagtagaaaactacaaacgcacttattttaggatggaggtagtagtagtttgtctaaatgagaaacgtatccatgacagtcacactcacacactttactccatttccttaatacaaagaacaatcttaccaaccatgcttggttctaccagtatcaacactctattcttcttgtcgtgtcatggatctgcactgcatcttttctaatgtctttgcatttacttgttttaactgtccctttgtttgtgtcccctgcaaacctcgtgcaaagcgacaatgggccatactccgagttgcagaggcaacaagttctctacgtctcctatcgtatgtctgaccattttgtaggagcggagttcagggacctttgtcaaggcaggcggccggatttcttgtttccggtgctgcaatatgctcaggcgcgttccttttttcttttttttttggagaacttagccactaggtaaaggttgtaaaatgccgtagcatctgttctctgtaaatacgactgggtgaatacagtgaattggtatgtttcactttcgtcgatttgttggtttgaaccgtgtctgaagttcacaaatctgtacactatcatgctgcatcagtcgaatctctgggaaacggaatggtcatcagacgtcttttgagaatttgagatctccgagcactatgtataagatgtattagaacgtgtcttttttcaggacacacgaacttcattaccactctcatacggcnnnnnnnnnnnnnnnnnnnnnnnnnnnnnnnnnnnnnnnnnggagctaaccagcggttattaaagcatagattacatnacat

SEQ ID NO: 6827 - DNA, 890 bp, Oryza sativa
  unsure (1)..(890): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacactggaattgaaccaatatatcttataactacttaaaaaatctgtaactttccattcttcacatcaatttttcgtcaatgagtccagtcgaacgatggcctccgttcccacacgcgcgagtaatacatcacgtaagatggataaaacacaaattcaaatatagatacaaaatccaatcagacaatccaaagaaagagaaaggaacagaaaaaataataaaaaacacacaaatcttatcttaatcttcgtcatcgcctgatctacccgtggaagccgccgacgccgcctgatccacccatgaaagccacgggaggacgtgccgccgccatcgcacacagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaca

SEQ ID NO: 6828 - DNA, 1272 bp, Oryza sativa
  unsure (1)..(1272): unsure at all n locations
cgcgtccgagcgcaaggtgtttatttttggaggaaccttaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttggcgcccgccgcgccatggccagcgcctttttttttcttctcggctccccccacggtctctaacccccaccgtgtaagagagagatgccgacgacggagatggcggcgccaccgcgggccccctcgccggtacgcgcgtgcaggtgcgcgcgcggccgtcgagtggctcctaggcggcgcctctttgcccctccccccctccgttgccggcgtcggcgacggccggcgacgaggtaagattagggttagggttttcggctcttttgatccgtgcggatcttgtgcttttctttctttggatttcttttcccgaaccgatctaagccctagggttgctctgataccattgttagactttgcactaggatcacctaggttagatctagtcgggtggttctatttgggtttgatgaacgacattgtcgatgaaagggagagggtttagataccgaccggttgaggagttcgaggaggaagaggcgccggacatcgtcgttgtcgtcgcggcttgacgtagatgcggcgccggtgaggtcgacggcgatgacggctgcggcagtggtggtcgtagacgtcccggcgatgaggcgtggcgcggcggtggcgtttcccgtcactggctgccccccctctcgatcggattagggttttgtggggtggagttggcncatgcngtgaacatcgaacacagtgcctggccggtctctacgcgtattttatctggtgcagcgtgacggtggcacacccgccattggggtgggaggcccccatcaagtctgcggtaaggcccccctgatccaacgggcttaaagggagggagaattattttacagcacataccctaacccagatcctcccgatgggaacttgaaaaatcttgtttaaaggggctttt

SEQ ID NO: 6829 - DNA, 13002 bp, Oryza sativa
  unsure (1)..(13002): unsure at all n locations
cgcgtccccnnggtagagcgactgcactgtcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttactggtaaagcaacacaactgcagaatcttatggacatattgtccatggaattttatcttatcattgtttttttaaaaaaaaactttgggacaggtgcattttccgtatttgcaagtacaacaaggatattaaggcattggaggagactgagaaacgcctcaaggaagagtagattaatcacacttacaggtctgccaataacttagacaacacgttttcaatggagcatatggctgttgatttaaaatgtcgactcaacaatcttttcaaaaatcgagatttagtttattggaatccttttactagatagacgttgaagattcttgttttagacttgtgttgatgtatttcaaggagtaggcttagctgagaacctagatcttcacctaataatttggtggtgatgaaacttggacatattcaccattcacctcattcctgtcttgcaaattataaagctaggaaagaaacaaaatcatttccatttcaattcaaaagaatctgatgtttgataaaccatgctggcatgccattgattctgatcaattctgctctgttgttcaaagttaagtaatacaaggggttgcatgaatttttaaatgactttgttattggctgccatgcttgcgaatacggaaatagaattacattgagcactggcattcatttatctttccttcataatcacttgctgcaccaacaattagtctattagacaatgcttaaagattggttccagtaaaggctgaaataccaggtgctagtggtgccatacttatcttgtgtcaagtagatgaatgtgatgttaccatccaactgtgcacaaacttgcaataatttgacatgggaaaattgatggatcgttccttctataatttattgatgcaggtggattttgtgctattcctgtccttcagatgtatgcagatagttatgtgggattcccagtgtatattgttcgccttgaggcaaagaaaatgttacgctgtttcggcacatgattttcagtacgatttctcgtttaattgtaagtcgtccggattctctttttttgtgttttaacttgggatgatgtcagtacgatttctcgtttaattgtaagtcgtccggattctctttttttttgtgttttaacttgggatgatgtctaccaagaatacatgagaaccactgaaccctggtcatccttcaattcaaccgtttgaacatttgcctgcatgttgtctgaacatccatttactggcttcctcgtggtcatcgttgttgaattagtctggtatgtgtttagaattgtacatgggactgctcgatgcatctagtatgtacggcgtcaaggtttctgaacagttgaaccaagactcggtcttaaacctacggtagatatgtactttacgttgcagcttgcaaagggcaaaggtttggagtaccccatgtatcagggcaaatgtttccagctgttttacgtttgccaagcccacggatttattattatctcgtagactctgttatccttttcaccattctgactaattcacggagctttgcaatggaacggcggatgagaaggtatgctattcatgtgcagactgcatatgtccgatgagaacaaactcgctctgtatctgtaaacctcaaactgcagagaaaccacagtagatactctcttacattgcatttggaaggtcttcttacatcgaggcaggtacgaactgtttccgttgtttggggttaggaccgggttgatgtgaaccccttccgaactgcacgacacggcggaggaaagaacagcttgcttagctagctctacctgtttgcacaccagaaagagagcgtacggtggccggaagaaatagaggaaaagacgccgtcgtcttctcgcgaacacgcggtagtcgcgtacccgcgcgctggagaaaccgtgttgccgcggcggacacagcggcagagtcatggactcggactctcatgggaatgagtataaacactggcatgaacaagttctctctgctgcaatttcttcaaaaaaatgccagaaacaaattgccagcacctaacatgaacaggcaaataaacaagtaaaaaatgccacacaaatttctgtagtatgagaatacacgcaacgaagtagttaaaaaggagaaaagaaaaggaatatagcatttttgtttctctaaacgaaacgtttcctctcatatgaaacgcattttgctgcctactccagtcacacaatgcgtgcacgatatggaatagtttatgtggcgcaaaggagcgtgtgacggtgtggagcgtgtcggtcttagttaaaactgaatggcgtttggtccgtgcctacctccatcagagaccaggaattgactggaacaaaacaattcagttgctcaaacataaatatatttataaatcataaaacattcaacctattggacgggcaatcgagtgaaattgaatgttaggtgaattcacctaaatttcggtttccacgtagcaggatagaccgagcatgggaacagagaaaaggggcgcatgaactgaatcctgttgacccctcccggttttgtctaatgaagctaactgttgtctgaagctttggcattttcagtcgtttgaatttgtttgtcctttaacataacttctggcaatctagaatcagcatcagctcttgcaactcttcacttgatatgcttctagagaaagaaaatgcaaacacaaagagatgttcacagaatttaaaagtagcaaatgaattcatacatagccagtcataaagtccactggctatgtacatcctctcatgaatgcagagtccgggtttcataatcctttttttaaaaaaaaaaatccattgttagatatttcctccgtcccaattcagattcatggtaatgatttgatttttttaaagacaaatggtgtatcttccaaaagaaatgctccctaaattgacaaacttagctagcttagttgaatgatcacactgatgtggttaaaaaccataatgaccattactcagtaatctgtaaaacacggattaatgaaacatttcaagtggctgtattaacatgtcaccatgtatttaattgctaaaagaagtcagtgatgtatagcttgtattaactgagttgctttcaggcaatccatagtggtaggaaaagtacagctactgtttggtaagtagggtctaatagcagtacctgtgatttgacctagctaattaccagtataagtttctagagtagctcacttggtttgagttagtcttaaaaattgaagaagttggtgtgagttattcctaggtttgaaaatgcgagatgtccacacatattttaccgccgcctacaaatctacaaccaccagtgattattctgaatgatcggtggtggcattatgaaagctgcagcgatcagctgaattactcagatgaaagaattgcaactgtactccctccggttctataataattgacgttttagataagattgaggtcaaacttttataactttgaccatcaataactttaaaaatatttagtttaaagaaactcgaacaacatatataaatttgtctttcaaaacactataaaaagtaaacatatatttatttattgtgtatattataatagaaaaataaggtcaaagttatattttgtaaaccgtgtcattgtccaaaatatcaattaaaatgaaaccggagggagtatttctcaaaagaaatttcacagccactgcataagatttacttcgacttagccggtattccgagcgaaagttaccgtactgttcgcgcaagtgacgaactgaatacaatggtgacaaaagcaagcagttgcataaacaacgactggactttgaataattctagttttataggatgaaccggtccttttcttgcatgattatagatcccggttagtatcaccttatcctagtcaagaatgtggaaaaaaacaattacaaaattgaaatcaaagtgacacacaaaatcaattaattattccacatgccatttggtatgaactcatgaaccataaaaaactggacctatgtatgaactacattcacacaggatcataaactcctaaatccttcaaatttaaaagaagaaaaaaaaagaatacggcgtacggttaagttcattatggtggaaccaacccacccaaattttaatcatagacttaacactgatgatcatacttacagctaattatttttttagtgacaaacatatctgtcgacagcaaaacacccgtggtgacttcatccacatgtcagtcagtcttctggagataatatatgagtaaagtatacatgtgcgttcatatgggtgaatatatgcgtgatatgagcacctatgtctatattattttctcattcaatgctttcttcgtaaaaaaaacatattgacggagggagtactacctcctttctaaattagtggtcgttttgactttcttcttgcaatgtttgattatttgttttatttgaaaaattagtgcaaatataaaaaagataagttatacttaaagtacttttgataataaagcaagtcacaaataaaataaataataattctataattttttgaataagataaatgatcaaacattacgaacaaaaactcacaacaacaaatattttgggacggaggtagtaatacataagaagaagaagaaatgaatgtgagttggcatttactttctccgtcccaaaaataagtgtacttttacactgttcacgtctaacgtttaaccgctgatcttatttaaaaaaaatttatgattagtatttttgttgttattagatgataaaacatgaatagtattttatgtgagacttacttttttttattttttttcaaataagacggatggtcaaataaataatatttctataatttttgaataacataaatgatcaaacattataaacaaaaactcacaacgataaatattttgagacggatacagtagtacataagaagaagaagaaatgaatgccgagctggcatttacttagctaaagcacagcgtttattaactcggtagccgttccgaccgtttcctcccctccctctcccgcggtttgcaaggacgccctctcgttcaaacgttcgtctgttcaaacgtcaacctttccaattcaaacaatcaaacccctttacccttctcccaacctcctcctatttgaacccttcccaccacctccagtctcccgtattgaactcttctcagctcaaagccttacaccacaacacgcagctgttctcgctgggcttctcttcttgcgctgcggtgatcgatcgagagcttgggatggcgctgctggcgcggagggcgcggaaggcggtgatggcgaaggcgccggcgccgctgctgcagaagaggggtggcggcgcggcggcggagctggcgatcccggcgcacttccggtgcccgatctcgctggacctgatgcgcgacccggtgacggcgccgacggggatcacgtacgacagggaggggatcgaggcgtggctggacaccgggcgcgcggtgtgccccgtcacccacgcgccgctccggcacgaggacctcgtccccaaccacgccatccgccgcgtcatccaggactggtgcgtcgccaaccggtcccgcggcgtggagcgcatccccacgcccaagatccccgtcacgcccgtgcaggcctccgagctgctgttcgacgtcgcggagtcggcggcgcggcgcggcgcggcggggcgcgccgccggggcggtcgccagggtccgggcgctcgcgagggacagcgagcggaaccggcggtgcttcgtgtccgtcggcacggggcgcgtgctggccgcggcgttcgagtctctcgccgccgccggggaggcgggcgttctcgaggacgtcctggcggcattggtctgcatgatgccgttggacgaggaggcggccagggtcttggcctcgtctagctcgatgggttcactcgtcgccattgccaagcacgggagcttggccggaaggctgaacgctgtgctggcgatcaaggaggccgtgtcgcgggacggagcgttcgtggacctggcggatgacaaggtcgacaaggtcgtcgacgcgctggtcgtgatcatcaaggctccgatctgcccgcaggccaccaaggctgccatggtcgccacctaccacctggcgagctccgacgagcgcgtcgcggcgagggtagcatccacggggctcgtcccaacgctcatcgaggccctcgtagacgccgacaagagcgtgtccgagaaggccctggcggtgctcgacgcaatgctcgcctcgaaggaagtccgcgcgagcgcgcggggccacgccctcgcaatgccggccctcgtaaagaagatgttccgcgtgtccgacgtggccaccgagctcgccgtgtcggcgatgtggcggctcggctgcaaggcctcctccggcgacgagaaggccgccgcgacggggtgcctggtcgaggcgctgcgtgtgggcgcgttccagaagcttctcctcctcctgcaggtgggctgcagggacgcgaccaaggagaaggccactgagctgctcaagatgctcaacaagcacaaagggttgggggagtgtgtcgacgctgtggatttcagagggctcaataggctgtcatgaattgagatcagtgttcagaatcattgtaaaaatagttgcgagcagctaggaaatgcagattgtaaaaatagttgatggggatttttgcggatgtgctttccatgctagattgtaaatctaattgcaaaaacaagtttcctactttcctcactgtaaatattttgcatgtaaattccttcttttactgcccatttgacttttgcacgatttttttaaaatatatctgtcgttgtttttgtggatgagatttttcacatttcgagccaacaacaatcaaatttgatgcataacgttcatttgtcctagtgtaaccaacaccaaccggatcgccgttttcaattaaaaaatgaatttgagtttttattatccactaaaatcaacattccagtcgtaagaagaatcttaaacgttgaacacctgttcctccaacccaacctgcatgaggcaggtacaagttctcagttctcacctttgaaaacttcggttcaagcttggacgaaagcggctgtggtcggtcgatccgagcgtgacgacccggttgacctccacggctcatccaccgcgcgcagcgctcagcctctcggtcaggaccgcgcgacaccatccagaattttgacctctcctcccaacctcgagcacgcgctatgcatctgcacgtgaaaccgtgatatttcacgccgcggcgcgccgcactatgctcctcgacctcgacggctggctaagccgcgttcaccgatctgctctcctcggccggcgcggcgctagtgtgtgcagcgtactcctcgacagttgtggtggtggattgggtggataagctcatacgcacgtacgcaacgtgaaacacgaccccgggggggggggggggggggggagtgttgccggcctgaacgtccctctcggcacacgcggcggctctccccgggaaattattctaatccctcgaggggatgttccctcgtttgctcaaaaaccatctaaacagttatgaaaaacttgataacattcatacaacacacacatatatatatgtaggtaaattaactggtgctacatggagtatgggctccaagattcaaattgagtatatacccaatttgaatgagtatgaatttttttttgtaaatgtttagatatgaacattaacttctttactaacaagttcaaacaagtttgaactaagtttaaactttttttttgttagattttggttctagatatataacatccaaacatataattcattaggtatgtaataatgaattgtgaaataaagttgagtttgagttgttttgttgttaggtatttgtatgaatcaatttcatatacctaggtatatactcacaatttgaaaatttttaaaaatttgagagaatttgtgtgttttataccttggcccgggcaccatggagtcccatatgggtatcatatatatatatatatatatatatatatatatatatatatatatatatatatatatatatatatatatatatataactccataaaatcttaagtccaaactcaactcacacgtcgacatataaaaaagacaaattcagcatatgaataatatcgtactgtttatatttaaatttgcctttttttttctcgatgtgtagatcaaatttgaatataaattttggtggactagtaggtatcattatactttacattgccaattttttatagaaattttcatagctatttatattaaatttgaaaaaaaaaattatgtacgagggatgtcccttcaagagattagaatccactcccggctctccccaccgcgccgcccgcgctccagccagccgaaccgcggagcggagtctggtcgaccgcgagtagaccgcccgtcgccattctcccacgacgcggtcgccggtggccgtttgggccgcgtctcggatctgagtcagaatgggcctaatggagagatgggctgtacggagatggacgttcgactcggtctagttagactgggccgcaggtcaataaaaccttttgcctagttgtagtccggtattcgtccgaagaaaaagaggtaaattgcagtattgcaccaagactactagagtaataataacgtaattacagatcaaggttgggattttgtaattacgtccaaggttgaaaatcccaaccatattcccgtgaggcgttgctaccggaattcttccaattttacttgctgcattcaatgttttaatacaaaaaaaaaacttatgtgcactcaaggttttaataaaaaaaacttatgtgcactcaaggtgtatgataaagtagatttacatgagtagaacagaaggccacagctctttttatcaacaactcaacaacaattccaaaataaacagctctaacttgtcgtctcagagagctgaacccaaccaaaagaacaagcgcccgcaggcccagcccgtttagcccacaagaaaaagcaaaagacaaaactagaaaaaaaaaagagaaaaaaaagaggaagagtgaagaaaagaaaagttcatctcctcctctccttatcccttcccttcaccaaaacccccccgacaccgagcccctcctcctcgacctcgccgcaaatcctccgccgctcctccgccgctagggcataaccgcccgcctctcgccggcatccgcatctcccggtaagcattccgtccgagtctccacgtggtcctcgcggccgccgccctgcgccctgtccaaattgggtcggggtttctgatttgattggttggtccatgtgttaggggaagggaagggaagggaagggaaggaaggaaggtgagggcggatatgtcggcggcgccgataccccgcgagtgggtggggctgcagcagtttccggcggctacccagaccaagctgcacgagctcctcggcaagctcaaggaggaggtattacacgcctatgcaaacgcttcttttatggactggttaatggattggcgatgattatatatatcccgctcttgttttacgttgttagtaactggtggtaattgtgtgttttgttactccgtctgtgatgtgattgtatgttttactgctttgtttgtgatgaagaatgtgagcacattgacaattctggtgatggggaagggcggggtggggaagtcatccaccgtcaactccatcgttggcgagagggtcgctactgtcagcgccttccaggtaatgcttcttccaggtctgatttctattgagcccataaccgaagttgcgtacttatgggtgtgttgatgaatgttttcctgtacagtccgagggtctcaggccgatgatgtgttctcgcaccagggcaggcttcaccttgaacattattgacactcctgggctcattgaaggtggatacatcaatgagcaggctgttgagatcataaaaaggtaccaatcttgagttatagcgatacttgtctttaatcaatacagttgcttgcatgtaccacaacatcttgtttaggatttgagatggtactataaccatactaaggttgccattttgacctagggtcaagggcggatcgatctgtagtatattttcttggaattaggagcttttatgtactgaaatcggcatcatatttatgggcgacacatctcagaaacattgttttagtttgtgtttccactttgccatcctgtggtgtaagaacgagacaggaggtgattttatattattcttgattttacaaacagaatctagggtgctgtctgaagagtcttgatccaatattcatgttaaactgtttttttgtgcactatactcacattactctgaagataacctgttggctttgtaattttgttatttttttaatatttgtatgattttctggatattccagtttctgtaaggctcccatcagatggcctaataagccaaagaaaaagccaaaatttgaattttcaagcttaattttgagattgattttgagatattttcaacgtagtttctttttcaacattggcttttaagtcacaaagaacacatttataaaagttttacccacaaattcatttttatttcctaataagccgttttggcttattaggaaataagccaaacgatggggacctaagggtataatagtctctaggagcaaaccctgatggttgattggttaactactgttgactgcacatcaatgcaaaagggaaatggatgactagtaatggaggcgaaaaatagaagtgcaactcacaatgttagagagagtgaatcaggttgcaaggagtgacaaaaggaaaattctcttaattattaacaataactattatgaatcaacacaacttttctttaggttgctgctcataaatttgaccttcgcgaagttttcattatgctgtcttcaaaagttctattcctatacaagtcatatgtgttatctactgtatcgcaggtttcttctgggcaagactattgatgtcctcctttatgtggatcgattggatgcatacagaatggacacgttggatgatcaagttattagagctgtcaccaattcatttggaaaggccatttggcgaagaacattggttgtattaacacatgctcagctctcaccacctgatggacttgactataacgatttctttacaaaaagatctgagtcacttttgcgatacattcgtgctggtgcaggagtcagcaaacgagaacttggggtaatgtatacctcacttgtcttttatatgggtattatcggcatatcaagattttttttttttttttgcaatttatctgcagcttcctctgtctaaactaatattttttcttcatgtgtattatttgacatgctctttcagaacaattattcattttctgtcctgtgttgttgctgtttctttgctgatctggaataatagaacacatagtaatctgtcatttcccttctccttgggtctatttattttgctgtgtaactaacacactctcttcagttcatctgtaggttatgtatttatgtgttaatattattctatgaatcaaattatcttttgaagtcactgattttgcatgctaaccgacgtccaatgtttttttaccttgaaatttagtattcatgttatgaacctgaacctccgcttgttttggttacttatagtgtctcagtcaatgatactccctcatgggtctactgttgcttcaaccttctgggttcttgagtggctagctttaaattgtacactttcttatgtttccaacttgtctgtttgcaaaatgctacaacaatatggctgtttgggtgctaagtttctggggaaacgtggtactttccagtttgcactctccaacacgagatatgcatatgtcacattgcatatggcaagtatacaaaattacagatggagttgaactctgcagaaaaaagaaaattctcatcactagctaaatgtgcatcagtcttaggttacacaaacatctttttctccaacctgcctttttgctttctggcatgctctcagctaaatgtatatggtgcatcactcttaggttacacaaacatctttttctccaacctgcctttttgctttctggcatgctctttcattgcaaatggttgcagaattaacctgaactttttatttctctgtgtactacagaatctgtttggaaatatattatttcctcaggtgtcacaaacagttgtgcttttaaaatctatagtcctttttctatactaatgttaattgtaataacattctgctccttttaggattttcccttgccaattgcattggtggagaacagtggaaggtgcaaaactaatgagaatggagagaaggtttgactatctcatcatcatgtttggcttgtatttgaacatgtctagcttctaggtaattgaggatgccatacaactgtatcacaggttctccctgatggaactccatggattccgaacttgatgaaagagattactactgttgtctcaaacgggagcaaatccattcatgttgatcaaaagctaatagatggtccaaatcccaacaatcgctggaagatgttcataccgctcatccttatggtggaggttagctcctttaaaacaaaacagttnnnnnnnnnnnnnnnnnnnnnnnnnnnnnnnnnnnnnnnnnacgagccgtactcaaaaggcacgcg

SEQ ID NO: 6830 - DNA, 3991 bp, Oryza sativa
  unsure (1)..(3991): unsure at all n locations
ggaaagatgttcataccgctcatccttatggtgaaggttagctcctttaaacaaaacaagttctaaatctaagcacagcattttcatcttttgcctcaacataatgcctcacttatgtttaccatgctcttctccagtactttttggttgtaaaaggcatcgaagggccattcatgctgacatatcaaacgggaagctagatgactgggaacagcgttacagagacttggttggaagcaaggacccggtagaccagaaaggttcatcatccggcaaccccaaggcttgagctgaagaatgataccgcatgcatcgtgacccattcaattctctgtgcttttctttttgcgctctattccagtgatctatttgggaagctttatagagttatctgggacaatttgagcaaatttgctcttgtttttagttgctaaaaaaactgtactgaatttttttgtgctgtcgcaattttgcaaatgttgttgatcgaaacttcagttatttgagttccttgtgatgttccatagtggccgcctgaccatctggcacctatgtattgttgtgggcttatagcaacatggcagatccaacttcgaagcagaggtgggcttccattgcatgctctacaacgaggtgtttccaaacttccaatggaggttggctcaggcaagttagcccgtgcaggtactggactactggttaatgctgagtggtatcacaatataagcaagcaaaattgactgtaatcacaatatacgcaagcaaaaattaggagttcacttcaagaaacacagtgatcgccaacaaatctagtcaggtactcggggtcgtatgggcaactatgtgctttatattgctatcaatatcgattttaaaactgtatttcggcataaagaatggccaaagaactagcttcaaattgaaaccataaagcattgcaagatgttagctaaagcttacaaaatgattcaaaagtcaagtgggttcatcctacctgatccaaatacccaaaatgataatatgcaaatataggggcatactccagatcaggaaagaaatactttcccgaaacccaagtctttctaatgcaatattacaagtatcagcataagcaaaggcctactgcggtggcttttgtatttgatatgagttacaaaagtcttggtatggcttgaaatcgttttgccatgctaaaaattgcttcttcaagcatttatatactttttcctcagcaggctgtatgtctatagctggagactcaaatttcatcctcactgggctgaaatcaaacaaattggatgcagcttgctcaggtccagaatgaggaattccagctcttccacaaacaaatgtcataaagttttcatccataggtggtgctgtaggagcatgcaaacatgaagggtcatctagcttctgtgtttgtttatccttctttctagcagcctcatcaagagtgggcctatcagtctgaggctcataaacaaaatatggtttatcatctttcacctcttgtgaagcagaccatccattacagttatctgtattagcaattgatatttcaggaacaaaggcttcaataacttctctgcaccgatggcttactgagctggaatcttcccgagaagggctgtctatacccttgttgctatcttccatcgcgagcagaacaggtatggggagtactggaccaacaagagaatttccagattttgctttgctcgtcagattccaactaatgcttgaagattttgccaacaggtaaggccgaagtttattactatttgggaaacatgcaggaacttccagatattcatatatgcgctttttattggtgcttgcaagcatgtccttgtatttggagaaggcaacaagaaggatatctgaagatagtctgctcaatatgctttgacatgcaatttcgaaaatgttcatgggcgcactagcattgcataggaaatctgaaactgactgagaacaagacgcagagttatcctttgcaaatactgatacatcttcactaataataatatggcgggaacgtttgttgacatcagaatcatgattctccaatgagctgcgcagattgcccttcagaaatttagataggtaatgcaacttcagaaactcatatctttcagaaaaattttctccgtgagtgtcaagagaaatggatgagctagaacccacagacttatgttgtgattcatcacaaatggcatcatcatgtaaatctccagaggcacggaacctttgcatctctaacttccccgatgatgttaaacggatcaaagcaaagccagtgaatgatgactccaacattgtgttcggaagcacgtggtaaccaatgatgtagttcctaattagttgagatgcagagccatgtcctggaacgacccccttgaacacctcttccataagtccaatgctgcagctgcagtgctgacctatcaaagaaatccgtgatggaagatcccaagcatataggggagcattttctgtagcgtcttgctccttagggccacaaaagaatagattaannnnnnnnnnnnnnnnnnnnccaaccagaatggcaaagcctgaatttgatgcccactcatgctccttagaaggcctcagttcagataatcgaaacatagcaatatgatttgggttatcaagcccatgctgccaagccaacacgggtatcaaaggccgtctgatatcaaagaccatcaggtgacgctctgtcaccaccgatataagaaaatcatcaaacggagccttgcagaatgcaaggtaacattgagtcttgacaaaaggatcagtttcaaacaacccttccatcccaactcttgctaaaaccttgtattcaccatgatccccaaatctcatatcaaccaaaaggatggccgccgtgctcgcaacgatcactgtccacggttgcgccccgtactcgcagcttagccagtcccccaggtcatccttgctgccaaaaccaaccttcatcttgcctccacgccgtgtatccagatcgaaccagcacagctgcccattttccagcagcactacacactccgactgcaaatgcttgctccagcacgcgtgcacaacagcagcgtcgaacgcctgcttggccgcgggcacgagcgcgggggagccagaaccccgcgactcaaccttgaaccaattcaccgagtacaacgtcgcagcaagaagaaacccctcgatagagctgtcgcgtgaccgcgacggccacgaggaccaggacgccgtggtggcaagctgctggatgcggtgcctggggtgcatgaacccatcgctctgcacggagtgggagagcggcgtggtggggtcggcgacggggtcgagggtaacgtaggagacctgctccgcgttctcgccggaagggaagaagacgacgagggaccgcgaggaggagggggcgcggaggacggcgagcaggttggagggcgccgggaagggcggggacggcgcggtgagcagcgcccccgagagggggtcgaggtcggcgaaggggaggaaggaaggtggagcggacgaagtggcggaggaggtggcggaggccgcgccgggaggggtgcggcggctggaagggggaagggagggcgaggagcgtggcgtgcggcgggagcggggagaagaggaggggcccgtatgatgcggcggcggcggaggacgtggcgagggacggcggcgcgaagacggaggagacggggaagaggaagcgccagtcgtccgagaggttcattgccggcggcgccggcggacacggccgcgcgcgcgcagcgcttcgaagggatgcaggcgagtgagtccgggaggtcttctgtggggactgtttaaatttgaaccaacgggagaattttcacagagagagaattacagagattttgctannnnnnnnnnnnnnnnnnnnnnnnnnnnnnnnnnnnnnnnnnnnnnnnnnnnnnnnnnnnnnnntgtatatcaattccaaaggganggcgcg

SEQ ID NO: 6831 - DNA, 28053 bp, Oryza sativa
  unsure (1)..(28053): unsure at all n locations
agacgacaagggcccgccaagaagaagggggcccgaagaccgccaacaaggttggaggcccccgggaaaggccggggaccgccccggtaaacaccgccccccaaaagggggttgaggttcgcaaaagggaagaaaggaggtggaccggaccaattgtcgaagaaggttccgaagcccgccccggaaggggttccgcggcttgaaaggggaaaggaaggcaaagagcgtggcgtgccgcgggagcggggaaaaaagaaggggcccgtatgatgcggcggcggcgaagaacgtggcaagggacgccggcgcgaaaacggaggagacggggaagaggaagcgccagtcgtccgagaggttcattgccggcggcgccggcggacacggccgcgcgcgcgcagcgcttcgaagggatgcaggcgagtgagtccggaaggtcttctgtggggagttggggagaaaacgacggcgacggcggcgcgggagaaagatggggaaggttttgggcggtgcctcggtcgatcgccgccaactctacaatatcgttaataaataaaaaaaaaaaagtaaagtccatcaccggtccctaagcttgtaccgttgtgtcatcctggtccctaaactcgcaaatcaaccgttcagttcctcaaacttattcgattatgttattctggtccctaaacttgcaaatcactcgtttaggtcctacaatttgttcagttgtctcatcccggtccctaaacaggacggtctaaaaactttatatcgaaaaataattcaaaactttttcatgtgaactctagtgaagataaactttatatcaaaattgtagccctcgacgtgacctacaactttgtagttgaaaagtttttgaattaaaactgtttagggtcccaaaatattgttgcatgtttatagattttgaaattttaattttaatattacattttgggacaaaaaatgacttaaaataaaaaaaattcaactacaaagttgtagatcgcgtcgagggctacaagtttgatataaagtttgtcttcattagagttcacatgaaaaagttatgaattatttttaaatataaagtctttagaccgtcctatttgatctagatgatattcaaatccaagttaaggaccggggtaacacaactgaataagttggtggacctaaacgaccgatctgcaagtttagggacccggatgacacaatcgaacaagtttgaggacctgaacggtcgatttgcgagtttagagaccgggataacacagcggtacaagtttagggaccagtgatcactggactttactcaaaaaaaaaaaactctacaatagcgatgaaaagttgaaaatggttagaaaaatcacgagatttcgtgaaccggttcgaaaattgatcctgaggggattttcgaatggttttccataaatttgaattcgaaaaggaaaattcgaatgaaatttgattgaaatatgtaaaaaaaaattagttcagttttcttgtgaaatatgtaaaaaattagttcagtttttttgttgcggttgaatttcgatgtagtgatacttgtgaaccctcacgctaatgaaaagtttgtggttttaagacgccagaaacaattttggtttgtacacgacactttatatgtaatgtttttatctttgtactataaaaagtgcccgtgcgttgcaacgaaaaaaactaatgttatgataataattatggatattttatagtttcatgggaattatatgggatactcctagacataaacaatgaattaaatctatacctaattctgattctatatcatgaaaaatgaataattacattatttgttgactccatttagctagaaataatttttttgacccccttcgcaagcgacaacggcagggcccttccccaccgtgagcggcggcggtggcggcgccctccccaatgcaagcgacggcggcggcggcggcgccctctcttaacatgagcggcagcagtgccctccctcaacatgagcggcggcggtggcggcgccatctcccactgtgtgcgacggcggtggcacgtcctctcgcggctttcataggtggcacaggcagcgtcggcagcttcccataggcggatctggtggccacggcggtgtcggcaccctctcccactgtgtgcgatggcggcggcacgtcctcccgtggctttcatgggtggatcaggcggcgtcggcggcttccacgggtagatcaggcgatgacgaagattaagataagatttgtgtgttttttattattttttctgttcctttctctttctttggattgtctgattggattttgtatctatatttgaatttgtgttttatccatcttacgtgatgtattactcgcgcgtgtgggaacggaggccatcgttcgactggactcattgacgaaaaattgatgtgaagaatggaaagttacagattttttaagtagttataagatatattggttcaattccagtgttgataggttaattagtcacggttcattagtagagtcattagcgtctagattaccaaaagtaattagtgttttcttgattagccttttccttagtatgtttcgagtccgaaccaagttagagggaaaaattgctaaacatctcccgcgtgattttttttcttggcatttgacgtttttttagccacatgatctttgcgccaagatttgtgcagcaattgccgtggatgaggtcgacagggagttaaggtgtgttattcttgtcgtgtgaataaaatacgtgaagtatgtaattttcatatgtctaattaagaaatatctctatgttaatttacatgtcaaattaagtactaatcgatacaacaaatttaacatatcttaaacatctaaataaaaattgatttctttaaccattgaaaaattaagacatttgaaactaaaataaaaaataaaaaaaataaaattacagccctatataactaaaattgcatttgtaaatttaattgatttgacatataagtgcactgtaatttttgataaaaataatgtgtaagtaaatatgtacttattattttctttaaaatataaaattatattttaaaattacagtcctatataactaaaattacatttgtaaatttagttgatttgacatgtaagtgtactgtaattttgataaaaataatgtgtaagttaatatgtatttgttatttttcttttgtagtccgttggatataaataaagggtaaaaaaaattgggtgattttttttattagaaatcacccgacaaatagatacatgctggtaaaagaaatactttgaattccacgtataattgcagaccatctgttatatggtctctgtataacctgcatacgtagcaaatggtgggccgtgcaactggcttcgtgggctgtgtcttgggccatgatcgttgctgccacaaaccgatccaattaattttacaaaatggctttgttagttttactcggaaatcctgatccgactacgaagcgtttgaaaatggggaatcggatgaacctgatgaatgatgaaggggggcgacggacgaaatcagtggcaaaaacatcttaaatttttataatactaaaaaaaataccggtgcgttgcaacgggtaaatacattttttatgatacaacaacaactattaagagctaagtcattggaatcactatacactataattaaaaaattaatgaatttttttcttggttttaaaccgaaagcacaatattttttctttgttagtcctaacccagtccactaaaacctttgttagtcctaatccagtccgctacctccctccattcgccccgcctttcttcggtcgtcaagctccaaaaggtaatcccgggcttgtacaatgccaaattcagttgaattattctcgatctcccaaaattaaattggttgaggattttttgatccaccaaatctccttttttccttgtttttccccaaaatcgaagcgaatcaaagcttgttgacctgccatgatcaacgacttttaaatagggattaaattcagtaaattaaagtccaggatatggaaaatgatgatggaggaatgtgaaatcgatttttgcaatcagttagagtagaaaacatacgggaggtagatcgaacgtggcagtggcgctagggttcggcccagaccagacgagatcgaaaaaagacaaaaaaaaaccggacttactgcgtgcgaagaaaaaaaaccatttcgcgtgcaaaaaaagcaaaaaaaataaaccgctcagaccaaggaaagcggaagcttggcggctcaggcggggcacgctaagcgcgtgcggatcggatcagagatcaggaaaaagacaaaaaaaaaaaagaaaaagaaaaaaaagggacttcccgcatacgcggagaaaaaaccttttcgcgtgaaaataaagggtgacaaaaaaataaactgcactgaccaagaaaaccgcacgattggcggctgaggcggggcgtgctatgcgcatgcaaataagagcagagaacggaaaaaaaagacaaaaaaaaaaggacttaccctgcgcgggaaaaatcccgttccgcgtgaagaaaaaacggcgacaaaaataataaccggacgaaccaaactaaaaccggatactctttttttttattcgatcatcataggcaaaaaccgaggtaggtaaagtagacttattccttccccttaagttgacagcccatattatcagtttggccagctttctacagcccaattagatttgcacacataaaggaatttttttttatttttaattttttttattaaaagttttacaaaaataattttccattttgaaaattgacggaagtagtcgcctaccgccctctgggagggcgatttttaaaaatcgccatcccagagggcggcgaaaatgacgtggcagacggccgttcgctctcgggcgacggccgtcaacgaaatttgcaagcggcccccttgccgccctctgctagggcgattttgtactgtgcggggggccgcctgcaaatgggcggcgagggggcatggaattttgcaggcggcccccttgccgccctgggggagggcgattttttcctccccctataaagcccagtcccccctctctgaaatttcattatattcactaaaaatccaaaaaaaaacgaaagagagagaggggagggcagcagaaggggagcggcgaagccctgctggttcgctcacttcatcacatgtttgctcccatacatcttttgcatttgtactaatatgttatgtttgagtatatatgttgcgtttttgttttagttccatatattttagcatatctgtagcacacagcacatatgtgtagatccagagcatagaatataatagtatgaattgagacatagacaatagtgttaattgtaagatatagtttagtttgatctagagaatgtaacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggcatcgataggcctgcggagagaacattacagtcaatttatagttggttgttgagaggatttagaatagaccaagaagtctacacaatgtcagtatcagttgtagtgagtcgtgcaacagaaggttatttttgggaactaatgccgatggacatcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcaatgcaaaatgagaaaaatcaaccaagggaggagcaggccatgggcatggcggatgagggggagagagtcggtataattgttgatgaaatggagagggaagattcggataatgaggaagcagacgacgacgcatcatccgatgaggaaggtgatgtaatggccactgattgggcaaatgaggacttctctggacttgttatatcagagggtgatcatgtaccctgggagtataaggagaacgaggtaattgacggtgcaaggtatgctcataaggatgagatgaaggaggcagtgaagcattgggcagtttccttgcagagagagtttagggtggtcaagtcaacaaattatgtgtatgaagtgaggtgcatgaaggaagattgtccgtggcgtgtccatgcatataagggtaaatgtaatgattattggaaagttagcattgtgaccgagcacaagtgctacttacaaggggtggagaagtatcatcgaaacatcacttcagcttttgtggcaagtgagatgtacagcagcgttgttggtaacattggctttgaaccaaaatcaattattaggcacatcgagaacaaattcaagtacaccataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattggatgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattacagtggtgcgtatgaggcccaacgtttgccttatacatgatcgtcatgcgggtatgttgcgggctattgactacctgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcagagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcaaaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacatagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacatgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttacattccagatccatctaagttaagggtgaaaaagggtcgacgccaaactagacgcatcagaaatgatatggatgagtcagaagcaggtgggaggactttacgctgcagcaagtgtgatctgcgtggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctatcgatttaggaaataaaatgctgttgtgatgtgatgagtgttcggactaaatacttctatcgtgtaatttcaattgaatgttgttgtaatgagtacctccgactattgttgtactagtagtattgcgaactattcggtgttgtatcataatgttaccgtgatgagtgttcggactaagtactcatatcgtgtaactgcagttattgttgtaatcagaaatattccgtatggtgacacttttgtttgtttgtactcttgtttaatatgtgttagtaattcgcttatgaacatttattagttatgttgaactaattatttatatgtttctgatcaatctatttgatgcaggcatgacgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctctggtagaccgctggagacctgagacgcacatgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgatcaacagagtgttttgtactaacatttcattcttaattgtaggcggaccttctgcaccctgacgctgatgataactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgaggttacccggacttcgtgttcgagtttgacggtctccagccgagcgacgtcatctgggagccgtacacagaagaggccgtcgctgcgagagcaccgctaggactttcgtcgttgtgcacacgcgaccaggcttactggctcaccatcctgtcgatggggttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactactgtgactaccttcgctggtaccttcctcgcactcgtgcgcgtgtgaccttcactccagacgccccagagccgcacgttgccgctgtgacggacgcgtatcccacgcaccgtgactgagactacttcgtgggggtacgtcgaatttgtattagttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggtacctgtttcgcacggtactgctcagcccagaggtttcttaagttttgtttctgtttttgtacgaaaacatcaccccgtcgtaacttgatgttccatcctcgcaggacctcgtttgccttcgagcgcccctagcttcggagcagtgcgacctacagcaccggtttcgcacggtacagttcagcccagagattagttcatttttgtttcagcttttgcacgaatatgtcaccatgttttaacggcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtacttaatttttattaatactattaaatacctgtatgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccagaccgactcacgtactcccaggggcacattagggcgcagggtaggagggacaggggtaagaggcctcgtcagtagtgttctacctcttcagttcttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcagcagctcgagttgtcactatcaactttcggcgctgcctgttgacataaagtgaatcacgcccacgcgtgatcgtcttgtcacatctaatgaataatgtatctcattgagttcacatatattgcagtgaaaatgacgctatataattgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggcggaaggatgagcatgaacgtcgaattgctgctgaggctttagaatggcacgtaaatcccctaggactccccacgtggcgtgagcgtccggagtgtcgttgtggtgaccgctgtcaggtcataaggtccgtaaggcaccgaactcgaggacaaaggtgtttcgtgtgtccaaacattgtcgacgatgatttcgtggtaattacaactattcttttcatcactcctcagtactatcattaactcaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccctaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgttccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggcagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttctgtcaattttcaaaatggaaaattatttttgtaaaacttttaataaaaaaaattaaaaataaaaaaaaatccacataaagcaagaaaagaatcctcgtcttcacatagctcgattcaattttcatattcagtccgagcgagcgaacggcggctgagtcgaaaccgttacgacaatggaaatcggacgaggattctttatatatatatatatatatatatgaaaatgcttctatacacccaggtgtacatactcctagtttcatccaccatccgttcgcaactagcagagatcgagtctgctagcggatccacataccgcgacccattttgatttttgcgaggaaaaaaatcatcgtaatatttttatcccgcacatatcgggagcatactgaatgctcacataaatatctcgttctcacgtagtgctaaaccgaacagaaaatcaacagaccgatccgatataagggcaatttggaggtgacggcgaggcgatacatcggcaagggtggctggcttgggccacggcggcgagtagcagacaacgacggcgatgcgcgcgatccaccggcaaggccgcaaggatggctcaggccacggcggcgagtagcggacaacgacacagcagaaatccatcatcgtcaagcccatgcagctcgtccgcctgccggagtgccggcggcgtgattccatcgacatgatcggcttttgcaccaccattatttggatattcccaggtgattgattctggtatgtccatcccgttttctctcgttttgtatttcttgcagattgatcaaggattctctctttctttttcttgcagatcgatcgaggtataagccagcatgaaggtcgccagctgcctcgtgatccatcggcgactcgatcgtcatcaatggcggcgatttgatcgtgatcgatggccacggccatgttgcgtcgacaatgcaggcgcgcagcccatcggcaaagccggaggcgacgaccaatctattggctcactgaaatcatacgggaacggaaaaaagcggcgctggagacatcagacagcacagcaccaagccaccaaccgaagatcatggcatccaacgaatgtatacatcagattatagtaatcacagtatatatgtgcacatcagctcatgtatcgatctggttgcctgcatatacatctctcttcttaattatactccattgaatctcttcctgattatatactactacaagatcaactaatttcatattatttgtcagtattacatactactgtgaaaagcgcatatatatgcaacagttaggaattaataaacccaacgagtatagtcgagtatggctagttttggaaatacatgccgcttttctgaatctttgaaaaaagcatgtattttatactactgatacttttgcatcatcaaatcatgaatgcagccagtagcccagtagtctgtactgctacagtgtaaaatcaaaatgttagactttgcactaggatcacctaggttagatctagtcgggtggttctatttgggtttgatgaacgacattgtcgatgaaagggagagggtttagataccgaccggttgaggagttcgaggaggaagaggcgccggacatcgtcgttgtcgtcgcggcttgacgtagatgcggcgccggtgaggtcgacggcgatgacggctgcggcagtggtggtcgtagacgtcccggcgatgaggcgtggcgcggcggtggcgtttcccgtcactggctgccccccctctcgatcggattagggttttgtggggtggagttggcggcggcggtgaacttcgtacccagtgccgtgccggcctccacccctcttttatatggcgcagtgtgacaggggcccaccagccattgggctgggcgcccccgatcagggcgcggtcaaggcccccttgagccgttgggctcaaggggagggagatctatctaacattctcccccttgatctcactttttcttttagctttttctattccatcacagatttgtaaatagagcatgtttcatcgtcacggtcaatcaccgatggattcgacagccactatacacaactctattcagaaacagatactttacttttgggccctgtagtccaggattcataaggcttcccttaaacccatgccggctacatgttccttgaacacgttgggtggtaggcctttcgtgagcgcatccgcgagcatcctttctgttttaatgtgctcgagactgattgtttgatcccggactttgtccttcacaacatagtactttatgtcaatgtgtttggcagcaccacttgactgattgttgtgagcgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagatagcatgaggccttttgttccctgcaaataacgcaagactttctttaccaatttccagtgctctaggcctggattactctgaaatctgccaagtaacccggtaacgaatgccaagtcaggtcgtgtgcagacttgcgcgtactgtaggcttcctacagctgacgcatatggctttgttttcatttcattgagctcatactgatttctgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctctttaaacccaaatttctttattgtcccatcaaacttcaagtaccactgtctcgaagcttgctttaatccataaatggatctctttagacgacatcccatattttcgtttcctttcatgacaaaacctttcggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggctgttgcagctcctcctctggtgtggcaaccatttctgttgaatcctgtataacaggttcttcactctcattcattggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcagctgactgttttggggtccaacttcccaatatttgggttaaatactttggcctctgcaggactcccccacacacggaggtgagttagcgagggtactctccctgtccatagctcatacggtgttttgggcaccgatttgcttggaactctgttgagaatatgaatggcggtttttaacgcctccatccataaaccgagtggtagtgtggagtagctcatcatgctgcgcaccatatccataagcgtacggttgcgcctttcagctaccccattctgttgaggttcgcccggtgttgaatactgggctactattccattctctagcaagaaccttgcaaaaggtccagggacttgcccataaggcgtatgtcgaccatagtactctcccccacggtcagatcttactactttaatctttatatcaagctgattttcaacttcagctttgaatatcttaaatttatccattgcttctgatcgctctttaattggataaatataaccatagcgggagtaatcatctgtgaatgttatgaacgagtcatagccatccacgctttttacaggaaatggaccacaaatatctgtatgaatgatctctaaaattcctgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgatagtgccataatttcgatgagacatcgggagttcgctttcttttcttgttttcttttgtcaatgaggacacaacattcacattctcagaaagagataacaaataaagctcgtctcgcaacacggcaagaccaatacatgcattattatgccatagttcacatttgccacttccaaagcggcaatcatatccatcaaaatccaactttgatacacttattaagtttctttgcaaagaaggaacataaaagacatctcgaagtaaaagtatgaagccattcgcgagctctagaggaagatctccaacagcttcaactttttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaacttggaagccatgttgctcattctaagtatgtggtctctaacaccacctccatggtacctttctgtcacaagctgcttgatcagctgtgtagcataagtctttgaagagtcagtaaactgactctttattctttcaaggtactctgagacagcgtcacactctgggatcgagcccaatatggtaggctcaatcgtattctttaccacagccaaacatttcttgttggctaagaaccatttcttttgttcaatgtcatacgacatgacgagaggagcattgtccctctgtctcttttgccagtcagcatctgactcattttcacctctgacaagttcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacatcaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaattacatctatttgcagcggaaaactataaaaatcatatgaacagtagcaaaatctctgtaattctctctctgtgaaaattctcccgttggttcaaatttaaacagaggtaaaacatgcaaaaaactattcaaaattctattgaaatttgcatgaaaattgacaaaataaaatggaaaatttctactgttctcttttattcattttcggcccccgagggacctaatttgaacttttgccggcggcccacggcccttttggcacgggcgggcgccccctttccccaagccgcaacctgggcctgggccaggaaaaccgccccccgcgcgcgccttcttgggccgatttcggcccggccggcgtcgaccgtccgatcagctagggtttcgatcggacggccgggcgccgagatcggaggatcaaaacccccctctcccggccggccgccgaaaaaccctagattctcttctcttctctctctcacgcgaccgcgtggacggcgtcgccatcgccggcgaccttcgcgcccgccgcgccatggccagcgccttttctcttcttctccgctccccccaccgtctctaacccccaccgtgtgagagagagatggcgacgacggagatggcggcgccgccgcgggccccctcgccggtacgcgcgtgcaggtgcgcgcgcgcccgtcgagtggctcctaggcggcgcctttttgcccctccccccctccgttgccggcgtcggcgacggccggcgacgaggtaagattagggttagggttttcggctcttttgatccgtgcggatcttgtgcttttctttctttggatttcttttcccgaaccgatctaagccctagggttgctctgataccattgttagactttgcactaggatcacctaggttagatctagtcgggtggttctatttgggtttgatgaacgacattgtcgatgaaagggagagggtttagataccgaccggttgaggagttcgaggaggaagaggcgccggacatcgtcgttgtcgtcgcggcttgacgtagatgcggcgccggtgaggtcgacggcgatgacggctgcggcagtggtggtcgtagacgtcccggcgatgaggcgtggcgcggcggtggcgtttcccgtcactggctgcccccctctcgatcggattagggttttgtggggtggagttggcggcggcggtgaacttcgtacccagtgccgtgccggcctccacccctcttttatatggcgcagtgtgacgggggcccaccagccattgggctgggcgcccccgatcagggcgcggtcaaggcccccttgagccgttgggctcaaggggagggagatctatctaacacaaaatagataacaaagtatataccgctagtaacttaaaaaatatgttaaaaaaggcatataccgatactaactataaaaaacagtatataccgatactaacttaaaaaaaaaagataccgacactagcttaaaaagtagcatatactactactaactgaaaatgtagtatatacatgatcagtatatactactatactactaacaaaaaaaaacagtacatactactactaacaaaaaaaggtatattctccttcaatgagtatacttaaaaaatgagatatatacatctctgatgattattgtagtatatatagtacttattaactaaaaaatagcagataatacttatattaactaaaaaaggtatatacttccaaacaaaaaaaatagtatatatcaaacaaaaaaagtatatactgaccaaattaaaaaatagtatgtgcagtatatatcaaaaacttagtatgtctactgaccaaacaaaaaaacagtatatactcattcagtacggacgtaatatatgctggaaagaaaattaaaaatttgaaagcaaatgcataccaacgttatcgtttgagtgagcaccaaatccggtgtcagctgtgcacatgcatacggtggtttcaaattaataatttcactttaatttggatgctaatggatcatccattaataagggggagtacatacatctaggtgtacagaagagtcgtcatgtatatatatatatatgtgtgtatatatatatatatgtgtatatatatgtgtgtatatatatatgtacatgtatatatgtacatgtgtatatatatatatatatatgtatatgtatatgtacatgtgtatatatatatacatgtgtgtgtatatatatatacatgtgtgtgtgtgtgtgtatatatatatatatatatatatatatatatatatatatatatatatatatatatatatatatatataatgcccgtgtgttgcaccgggtaatatcacggtggataaagttcaactaaacgatttacgtagtctagtacataattttgtttggacaatattaactcgatctacgagtaggatattcaattctcgcattgcaagcatgtgtcttactttcaaaatcatatatggactccgcgtagagatttactcaaagtctcttggtggccacgcgtgctttctcactatgtcaaaactcgcgttgcaatcatgtgctctcgttttcaaaatcatgtgtaatttttaatccttatgtcaaatctttaattttttacaatcggttttttatgtcaaacaaatattaattgtgggaatatattgatttttctatatattgtatttgcgagagttgatggcacatgtgtatcataaaaatcgatgtctttttgaggtattatgttttatttctaaatttcatttatgtcaaatatcaataaatataccggggcataaatggaaaccgaacagacatggaggaaaaatagaaaaattaaattgaaagctgaaccgactggaggtgggaaaaaaaaagaaagcagaagtttctcgtttcttcagggctgtttggcacagctccagctccacccctcctggagctggagctcagccaaacagttttagctccaccaaaactgggagtggagttgggtggagctctctcacaaaatgaactagagttgtggagctgggtttaggtagctctacaactccactccagacccaactcctagagctaaatttagaaattggagctctctctctcctcagcctatctttctcccccagtcccccgtgcttatcctttttacttcacactttctccatccttagcagctcccctcctcccacatactctagggccatgtttggcaaatgggacagagaaatgatttcccactcaccataagacatctttaaatcctaaccattcattctcccccttccatttaatcctaatcattcattcatttcccaatcccaatcccaccccttatttcctattatccaaacacaccctaggccctagctgctgatgctggacatggaagtgaaggggtcagaggaggatctggaccccctctccggcgacctccctccccaagcggcagtgtccggatcgcgagccatcggcggagggccccatcgtctctctgccccccgctcgcacggatctaccgccggcgacgacgggaggggcggagcctccaagctgccgttgctgctcgcgtggatccgccgtcgacggggatgggagtggcggatccgacgaattcttcccctcccgcatggatcctgtcgtctcttcggccccctctcgtgcggatcaactgtcgacggcgatgggaggggcggatccggcgacctcttcccctcccgcacatatccccgtcttctctccacccgtctctcgcgcggatccgtaggcggcggcgacgggaggggtggttccggcgacctcttcccctctcgcacggatcccatcgtctcttcgcgccggcgacgacaggaggggcggaagcggcagcctccccactgctgtcagttccggccactgccgcacaggtactttattttctctaagacaatatatcatgttttttatgtgaaatcttgggttcattttgcataggagcaatcctgcagggggttgataatgtgccgatgcttcagctacatatagtttggtgctattttgtgcttcgtgatgtatcacgctgtattttttgtacgcgctgcttaggtggtgtttgatccagggacttaactttagtccctgtctttagacactaatttagagtattaaatatagactacttacaaaactaattacataaataaaagctaattcacgagacaatttttttaagcctaattaatctataattagagaatgtttactgtagcatcacatagtctaatcatggattagttaggctcaatagattcgtctcgcgaattagtccaagattatggatgagttttattaatagtctacgtttaatatttataattaatattcaaacatccgatgtgatagggacttaaaagttttagtcccatctgaacagggccttactctcactaccctataggaaaattggatatggaactgcaagtgaggctttggcctgcaagctgcagtttatttttgtccgcagagattattttaatgaagagccattcttgcggattttacttgaggttgaatcatttctaatcaaattatgctaggaataacctatgtgcagctgtgcgtaaagtgtcgccatgtcccattctatttcagcactaccagagcagtattgaaatgaccagaagggagttccttaatgggtactggaaactttatctactccgtgctctcacacttgaaccatgctatgatggtccaacaaatggtggtgaggtaatttttcaactgatttcccaggttattgcataagttcatccgaacgggccaaagttcacaatatttatgtggttaatgcaataacattttattaaatgaaaaggatagatgaagtcactgacgcatggcttattagtcttattataattagcgtatgtttgtgcttatctggctggagtggtaaaagataggtcattcaaagataggaattgcaaaatggaccgaagtgctctctctgtgtttttttttcttataccatctcaaataccctatttagagattcagtggtggtagcatgaaaaacatagattttccaagtatagatgatcgtagtacgctttggagttcttgaaccttctgtgcatgttttatctgacaatatcagtacttttatgtgattctattggccatattacttcaaaacttgatgttggctgtgatttgagaatgttgctaaacgtgcatttcctcagttgtatgttagttttaatttcttttctaattttgtcatgaagatatgagctcggtaggcacttcaatgtcttttcatgattaatgttctgcattcatgtgaatgtctgaatcgaaggacctgtctagaacatccatgttgctatgtgccactgaacaactgaaaaatatgcctggttctaactggctatctgttctgcatcgacaggaaaaagaattagatacatattggtagatgcgtcgacacaactgcattgcccttcacaggtgaaacgaatctagacaatcttaccactatatgttaattaattagatggtactgttagttcattcataagctgccttagaagtatttacaattgaaattctattaggatatttttattattaatggaagtgcttctgttagtaattgttcaaggaccttggggtagttatattcaatattaatcccataaatctgatgaaattgaaattgcatccagggaagagcctgggatccacattgattggaggtggctaaatgccctagaggaagagccttacgatctatattttcttttgtgcttctattatttctattgcctgtgattgtatttgtgtattttggcctgcgacagaaatatgtaaaaacacgttagtgggcgtgctagctaaaaatagcggaaagaaaagtgggatagaatctaactcggatagagtcgagatagaatctgacttctgccgtgggctggctaaactggagtaggaaacggtgtgagcggcgaaccaacctgactcctgcgattttttttttgtatgtgatcttttttttttggcgtgaacctggactcatgccttttttttctttgtgtatatgtgatatttatttttgggtgaaggcttgtagattgaaactacctagaattctggaagcagtctgggcttgtgggcttgtggatgtctggaaggtttgtgggcttgtagattgacctgtaatcctttttgttggatgaaactggagcatgggcttgtcaatggacctagaattctggaagcggtttgggcttgtggacatgtggatgtatctgatcggataaaaaaaaattaccgcgatgacggacgaaaacgcggaccgaaaagaagctgacgactggaaaaatccgaatatatatatatatatatatatatatataacgactcttctgtactcccaggtgtacatactccctcttccatattggatcatctaataggatccaattaggacctgcttagccggtgggaaattttttttgaaattcctatttttcagccgaacagggaataagccaagtaaaaaaaattaacttgaaaaatttccatgcatgtcggcttgggattggttgcacgcctgcatctacgaatttgaaatgtagtatttgtgcaccttgctgtagcatggaaattcgtgacttatatactgttttattttacattagctatatacttattttttaggaacccatatatactatatctctgtttgaaagagtatatactttttatttgaggatccagtatatactaaaagctggtttgagaagtatatactacttaatttaagactattcgtatataccgttatctctagagtctattagtatatgtaaaggtagtaccagtaaatactttttttaagttagtaacagtacatactttttctatttattagtagtagcagtacatactgtcttttatcgtagtgtggtagtatactgttatttggtcagtacatactatttttgttggtttagtagcattatatactgttttcagtttagtagcggtatatactattatttggttagcgttaagtacatactatttttgttagtttagtagcagtatatactgtttttcagtttagtatagcagtatatactgtttcttttagttagtagtaaagtagtaatacatactaagtaacagtacatactttttgtgtatcgagaagtggtattatcaaataaatgggcatatatatgctcaccgattcattctttgtataagcgtacaagattaattcttaagaaaagtgagtagtatattgcccaattctgagtgtcgtgcaacaggtagatctgccggagccccggtgtagaagatgaataatcgcactgaccgcagcggccgcgcacccctttgcgatcgaggccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6832 - DNA, 1118 bp, Oryza sativa
  unsure (1)..(1118): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcagtgtcggagccatctccccacagggaaggtggaacatgtgcgtctcaggtctccagcggtctaccagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgtcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcgattggcgctttccgttcttgtcatgactcctggctcggcgtcggtggcggagcggatagctcctcaagcggttaaggtttccacgatagggttaacaggaagaattgggaaaggtagaaaggaggaatgtaaagccctgtgtggtctttgaggt

SEQ ID NO: 6833 - DNA, 2382 bp, Oryza sativa
  unsure (1)..(2382): unsure at all n locations
ccgtgtgnttacgagatgcaagcatgtgccnnnnnnnnnnnnnnnnnnnnnnnnnnnnnnnnnnnnnnnnnntggtgttatgatttgtgtcagtaaagcttatatggcgttcttacaaaaccttgtatgcattttgttcacagtaatattttattttaattattctttgcttgattcttgtataagatataagattaatgtgcaaaatactgcagcattgcaactgaagattgatactctcatgttatatgtctcaaaaatgcatttaggggccctgataaatagcgtcatatcatgttatgtctagttgactccttttcgtgtttttaccaaagctcttatgtatttaattgatctgtagtgttttgtaattgtattcactttactctttctccatatttgtcaataaagttattgtatatttgtattcatgttattaattttcagcaaaacaaaggtctgctatgggtaacagccttcctgtagaatcaaagttcactgatgaaaaagagaatgacagaattaagtatgttgtgtcgtctatgcaaggatggggtgagaaaatggaagatgctgtgagtaaacttgcagccttttgtatgacaaaaaaaaggatagttctgcaaaaatttcttactgatctgtaagtaattgtgtaaaatactgtgactgacatatgccctctatattctctagcatgcagctattctaaatcttgatgataccatgacgtcattctttggcgtttatgatggccatggaggtttgatcttcattctctctcttttttttttttttttggtttcaaatcctccaaatcgtcggcataactggttacatcatgctttgtttgactttgaatgacatgtgtttatctgcgcgcatgttttgaaaactttactgtttatgctgaaacttttacctgtgaattctcaaataaatattaggctacagttctggataatgaaccaagtttgctaattagtactaatcacctttgtgcggggtgctttctaggataacatgaactgcttaaacagaaatattattttacgagggataaaacactgcatggttgtgagttaatattaacagtcatgataattaaaaggatagccactgatgaacatgttggttaatttatgtgtggtgctatttttcttatgatacctatgaagtgctgatctgctgtgttcatcacattgttttgctttataagcttctatatgcacataggagtaatcttgagccaccattctgagttgtttattttctatctcaggagctgaagtagcatcatattgtgcaaaacgatttcatattgagctttgcaatcatgaagactacgacagcaatctaagtaatgcgatgaggagtgcgttttacaggttattttcgcctagtctatatcattttgttgcactgaatgatgctgcacttgcaaatttggaatatcattgttcctgtgtaatttctgcagcatggatgaggacctgcaactgtccgatgcttggagggagttagttattcctcgtaataatggatggatgtattttatcaaggctggtgtctgtgctaacctttcgcctttcccgcaggtagtgatcctttaacccctaaacatcttataatatccatatgttgaagaagttactcaaaactgtatttgttggacagtgcttattgtatctatgaaaaaggaaatggaagaatgtgtgtgatatcgagactattgttctttcttgagatgtactttggagttggaagagatatgtttaaccctaacctcaactaattgcgcctgtaaaaaaaggtccagttagttacttatcagttgcctggtttggtgagttggacgcctgacaggttattaagttcttattgcaccttggttcttgtcatagtatggcactaccctaaactgaggtattgtttgcggcatctcttctatggttatctctttcatatacactggtttggctttcagaaatgcttttctttgtctggttgcttttgtgagctatttcttggttaacctgtatctctactatgttggaattctctattatgtcctttagtttctttcttctttttccaggcaacatatactgcgccatcatatgaagggagcacagcatgtgtggttgtcatcagaggtgaccaattgattgttgggcatgctggtgattctcgttgtgtactctcaagaaatggtcaggtatagtgactatttccttatcgaatttcttgttggtacctaatttgcatgctcacttattttcgtgcctaacatttgnnnnnnnnnnnnnnnnnnnnnnnnnnnnnnnnnnnnnnnnnnnnnnnnnnnnnngcataaggatattcattcacatgggggggcgc

SEQ ID NO: 6834 - DNA, 1532 bp, Oryza sativa
  unsure (1)..(1532): unsure at all n locations
gactgcgctttgattgatccaactgaaagcccnnnnnnnnnnnnnnnnnnnnnnnnnnnnnnnnnnnnnnnnnnnnnnnnnnnnnnaaggagtagttcgtttccacttgatttttgtctagcaagtcgaaaatgatgtgtgatgatgcatgcaggatgatacttatcgtaggtggtagtagcactgtgcattgataggagtagtttgtttctgctaccttgatgatgtgtgatgatgcatgcaggatgatacttatcataggtggtagtagcactgtgcattgataggagtagtttgtttctgctacctttggtttgtggtttttgcctgctgctttgcataggagattaagattttgcttgtcagactcagataacttcaattaactgtctacgaaatctcgctcactggtttttgagttgtgaaggtgattgatctagtgatgctttttgttgttgttcattttgaatatctgtacatactgctgggttatgacttgccccgtttctgaatacttagcttttaaccaaattttctcttcattcttctagttatcttgaatatgtaatcagtaatgtgcttggtttaacggggaagtctatttgtccctgaaggacaattccttctgctgcatgccacccaaaaactcatcaaaaagtttgaaaaaaagaaaaggacgagatagatcgaataaataatatcactccacaaatatgcaagcttaaatttgacacatataagtagaattagaactaagtaatttgattgtgaataatacgaaaaacttttttttatgtcaaagacaaaaagctagggcgaattctcattgaatctcggttgttcatgatagtgatgaccatccattcaaatcttcaggtagcacccccaaatcttcaacaaggcggaaagttcgtgtgttaaaattgttgttttttgttttgtatatgttgaatttgaacttacatgtctgttgagtaatatattactcctacatgttaatttatctttaaaatctttaatgaattttcggatgacatacatacataaataaaaccggagacaaatccacctctttggttaagttagctctgttgcctgctgagaccggctctgaatccggcccatggggaccgtatctgaatccggcccatgggctgttaggccgtagcgggccgcactcctctttcatcagttcggcaacagcaacagactcggcatcactcacccacccaacccagtacccaagccccaacctcgcctcgcctcgtctcgagccgacctaaccgcgaacccccaactccgacgagaacgacatggacgccggcggcgaggaggcgaagcaagagcgccacctggtgctggcccacaagctttttcttcttttccaccccgacctcgacgacctcgccaaggtcgccctccgctccgacgccctcgacgccgtcaagtccgatggcatggcgccgctgtcgagtcgcttgcccgccggggcgttctggagcccgacgacgcgcttttcgccgagatgcgcn

SEQ ID NO: 6835 - DNA, 2864 bp, Oryza sativa
  unsure (1)..(2864): unsure at all n locations
tggtgccttttgttgactgacctnctcgcnnnnnnnnnnnnnnnnnnnnnnnnnnnnnnnnnnnnnnnnnnnnnnnnnnnnnnagtaaatgcagtttttttcactagcctcctgcagggcctggcgagctttctccctctcaaggtcccgttcctcgcctcgtctcgagccgacctaaccgcgaacccccaactccgacgagaacgacatggacgccggcggcgaggaggcgaagcaggagcgccacctggtgctggcccacaagctcttcctcctctcccaccccgacctcgacgacctcgccaaggtcgccctccgctccgacgccctcgacgccgtcaagtccgatggcatggcgccgctgttcgagtcgctggccgccgcgggcgtcctggagccggacgacgcgctgctcgccgagatgcgcgcgcggatcgacgaggaggtccgcaagctcgacgagaagtgagtggattcttcctctcttctgattttattttactagcaaatatgcccgtgcgttgcaacgggtgaaaaaacataatgataatatacatttttcatgcataaccatgtcgattacaatcagaaaattagaactacgaaactttattttctagcgcgttttcttttgtgcttttttctgacatttttccctcacgtgtttttttaaaccgtttttattttctcgcgcattttttccttttttaatatactgtagaaacttctctttttatagttagattagattagattagagataaagaagatatataaatggactaaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttcccctttttttggatcggacagatttttttttgcccggtttatttcgcccgatcgattttttttaccgcgtcacatataattccttttactttggatttttttcgccctttttttaccgcgtcgacggagtcggattcgttttgattttttttctccctttactttggaattttttcgccctgttttcaccacgtcgacggagtcggattcgttttgatttttcccctttttggctttttttggataggacagatttgtttttttttcgccccgtttttttatcggacttttatcttttttttcgcatggtttttttattttttttaccgcgtcacatataattcctttttctttatcggaaagttttttttcgcctttttttaccgcgtcgatggagtcagattcttttcagctttttccttttcttttatcggacaaattttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttcttttttttttttgctccacgatacatataattcatttttctttggaataggacagttttctttttatttttttaaactctttttaccgcgtcgatgtagtcggattcgtttcggtattttttccttttttttcctttttttttgtcggacatatttgtttttttttcgcccggttttttttcgccaggtttttttatcggacttttctttttttttttcgctcggttttttctcccgttttttgacggacgacagaagcacctagagaagtgttttttttcttttctccaatccaatacagatcggatctcttccagggaaatcagattttttttctccagggaatcggactctttttttttcgctttttttattcattaaacgggttgtctctcggactttttttttccctttttaagggatcgggtgtttttttgccagggaatcggacatctttttttttcctgtttttttcgctgtttttatttatttgtgacggacgatggaagcacctcttattttttaagtagtagtagatttttagccccccaaaaattaggccgccccttgctgtgttgcgtatgcgataagttttgcgataactcaggtgttgatatggtccgtttgccttagctaacctagcttactctgtgttgcgagatgtagatgctaaaactggtagatagcttgcatttgattcggtagttgtaatttatgaattatgtttagggccaattaattcacctctatgcaaatctatactacataataataaactttttccacatttttgttttagattcatgtacatattcatgattttgtacattttctctgcaatgtgtaatttagcatgtagagaagtaattgagattgttaaggatcacaatacgcaacttctcgagacaaaataccagtgtaaactaatgtgaaggaagaccggcatgttgaaatttgttagaaatagtttccttgagaagttgaggttccagtcaagatatgtccttttggtgatttgcatgtttcattgtttctactttctgannnnnnnnnnnnnnnnnnnnnnnnnnnnnnnnnnnnnnnnnnnnnnnnnnnnnagcagtagatcatcaatngacac

SEQ ID NO: 6836 - DNA, 3093 bp, Oryza sativa
aaagtttgataagaatcattgggttcctctggaagtaactaagtaattatgtttcatgtatgaagaattgctgatgctgaagagaatttgggtgagagcgaagtgcgtgaggcccatctggcgaaatccttgtacttcatgagggttggagagaaggtataaacttgtgtgcttctatactttacattaagtgtgtgcttgagatttagctatttgcattctttgaaatcaatattgcaggaaaaagcactggagcagcttaaagttactgaagggaaaactgtagctgttggccagaaaatggatcttgtgttctacactttgcaaataggccttttccacatggactttgatctcatctcaaaatccattgacaaggcaaagaagtaagttatagctttgattgtgcctttgtgaagttccattctgccatctatactggagcaatgacatctgactatttattgtgttgattgaagcctgtttgaggaaggaggcgactgggagagaaagaaccgattgaaagtatatgaaggcctatacttcatggcaacgagaaacttcaagaaagctgccagcttatttttagattccatctcaactttcacaacttacgagttgtttccatatgatacttttgtcttctatacagtcatcacaagcataatcacattggatcgtgtatctctaaaacaaaaggtaatttcacttcttacactctcttttctttttcttaattgactcactaacaagaaatatggcaggtggtagatgcaccagaaattttggcagtgattggcaaagtacctcatctatctgagtttctgaactccctttacaattgccagtacaagtcattttttgttgcattctgtaagtgtaaagtatcttgataagctgtctatagttttactgttacagtctgtacggctgggctatatgaatatatggtctaaacttcttttcagctggcatgacggagcagattaagttggatcgctatcttcagcctcatttccgctactatatgagggaagtgcggaccgttgtctattcacagtttttggagtcatacaagagtgtgacaatggaagcgatggccgcagcatttggtgtgactgttgatttcatagaccagtaagtgctgtcacccatccgcattagttttatgtttgtgattcctgtgtaggacaaaacattcttttctgttcctgtgctgtggagataatatctccctttcatttgttccagggaattgtcgcggttcattgcagctgggaagcttcactgcaagatcgataaggttgctggtgttctggagacaaaccgacctgacgctaggaatgccttctaccaagcgaccatcaagcaaggggacttcttgctgaaccgcatccagaaactgtcacgagtcattgacttgtaaattcaatggtctacgttggacgttggaggtgtgatccttctagatccctgcaaagctccccatggacataaaccgtactgaaattgctgttctacttgtactcctaggctcatgagaacatgatctttatctcggtttgattttattgcggacagcaaaaaggttttaaagagaacctccgtgtgcaatttcagtaagtgtgctttagatttgtagaacgagaagagtgcatgtctttctgagatgaatctgttcgttcatttcaagtcttgtggcgatgtctttttggggttccgcactgtttgatcttatgggtctctatatgcttgaaatagcctgacatgctagtctcaaaagagaactgcaaaatagaaccaagcgtaattccttttgttctgagcctgttttcagatgcaacatttcagaaaacagataaacagcattcggtcatacgcaatcgcgcgcacacactgtacagccactgtaactcatcagaaacgaggtcaatatacaacagtaattttcgccgttccataagtccataaaataccgatttctaatatcccaggagactctagctgcagatttagtaaggaagaacaaagcaagttactcagagtcacaggcaagctacacattgtttgttgcaaaaaaactcgaagtattgaggaactacacagagctaatctgggacagggaaatgagcacactggaaaattacagccggctgttcacttgacgatctctggtatgctgcgctttacaatcagctctccgtttctgcagatcagaaatggtaaccatgcaggcaggtcagaacgtctgtgtttgatggctatacaaaggcctagagattcacacaagcaaaatcacaggaagcagtaatgtagtttagtgtaggagcattgtctctctttacttactgatcccctgcttctggttctgcttctccttctgtttccgcttcctctcgtttcgcctcttcacccagggcttctcttcctccactggcgcttctgcctctgcgctgacagatcctgtaatctgcgcaaacgactctttggcgccagaggttacgtcgccgaagaagtccttcaccttgtcaaccacagttttgagctcttctttctttgggagctgggataatcaaaacattttactgttagtgacttgctacctttgctcaagacatgcttactgaaaacatggtcatttgtacatttactataagaaatgcctaccatcctcacttaactgcatagaagttcttttccaggacaacattttctgagctactatctagtactaggccaaaataatttgaaggttgtgctctagaaaatgtcagcctaggataaagcaagatacaagtctgaaatgtacattttcagagatttcagctctaatgttcatgagaaattgctactcctacataacttgcagagaattccacagggagaggagataaaaggcgctagcgaaacgtacttcgatcacattacttgtcgtcagcgcagacctcaggttcccattcttctgctcacccaaatgagacaggtaaattgcaattctcaattttttcgagtgcaacaacatacaatcacgcacagaagatgaggactgagaaaattaccacaactttgtagccatatcgaaactcattgtcg

SEQ ID NO: 6837 - DNA, 1904 bp, Oryza sativa
  unsure (1)..(1904): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgagatggtttcgtgctctcggcatacgtggcgtggttacggacagctgaaataaaggcacagtagcagtcgcgtggcttctcccggggacgccacgttgcacatggaacggcctcccagtttatatgttggaacacatcaaatttacaaaattcttgcaaaaagataagtttaacagattactcgttggattattgttactgccgattatatatttgatttatgaatgaattaatgttttaaaagtaaactttataaatggcttcgaacaagtgatctatagaaaacatatttaagagacctagagtaaataatctgtgacaataatccaataaagtagctaaaaagcccgtttaatccctaaaatttacttatatgaaaactatctgttctaaaaggaggcctaaaaggctaaaacggagtgtaaacaaagctagaaagatgtaattattatgtttaaatttaaatggtattatttgtagacaatgaaaagcatttttttccgaaataaaattttagaagtaagcaaatacacgtcatcgagaaattgaacttacgacgtttccaaacatctcatttcacatttcaattaaaaaaaacttacgtacagatgctaagctacaattacatgcaccaccttttttacgggcgaacaaggcgttcgtcggccaagagaaatttactaagatcaaattaatggttacaaagaggtttaccacaatcaacaacatcgttgatgaaacctcacacgtttgcaacggacttctgcttgtagcatcgaaatgccggcaatttttttcccttccagatcaaccccttcttttttctgctacctgattctcttgactctcctagctaatcgtcgatcccctatatactatgaattaattaaaccccttacgatgatcacattaagactaagggcaccacaagtctgcaaggaagcaacaggtagtcaatggcgaatctgctcttcatctcgtcgtaacccggccacaatgacgccatctcatgcacgtcgtacatctcctccatgcagcgtgccaggtacacgacgctgtatcccgtcaccgcctccagcccgtcgtcctcccacggcagcggcggcggcagcccggcatctgccagggtggtggccgcgtaccgcgcgaggtacaccgccgacgccgccacgacggacggcgggatcctcaggctccggcggtcgagcagcgtgaggtcggcgaggtggtgcgccacggcgtgcacggcgtcgccgccggagtagccgtacctggcgagaaagtggtcggcgaaggtgtgcgcggtggggcggcccagcctgtacccgagcgcgtcgagcaggtcgagctccctgtcgagcacctcgctcctggcgatggcgagcccgccggcgccggcgccggcggcggcgtcgccggcgctcagcctctcctcggggaggtcgccctcgtacttggccgcgacgaagacggccgtggcgccgagcagcgcgagcaggcggtggctcaccgcctccaggggcgggttcaaaatcaataaccttgnntnggnnntnntnnnggngtttcaagggntcccaggataacgatncacag

SEQ ID NO: 6838 - DNA, 2399 bp, Oryza sativa
  unsure (1)..(2399): unsure at all n locations
ttgtgcctttgatagctgatcctcnnnnnnnnnnnnnnnnnnnnnnnnnnnnnnnnnnnnnnnnnnnnnnnnnnnnnnntcatagaggtgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgggtgtattatagatctgacgatctagtttgtgtcatcatgccccctagagggcctcctgcccaccttatatagggtggggggcaggattacaagatagaaaccttaaccaatacggtatcggtttcctaaatctactttacaatattatcaaaccaggactttaggccgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgggtgatataccaactgctttgtaaaatatgatgagtgatatagcaaaatagctataaagaagcttgaatgctgtgaataaagaaatttccaaagtattgggcatacgccatgcgcacactgctttaacagatgtgcttaagtccctaaaagacacatggtttcaccacacctggaaatatatggcatatgtggtataacatccgagtaagtaaactcataaaggatttaccaaccgcctgacaaatgaccataatatataatcagcctaagccataatattggtcaataaaaatgcacacttacgtggcaaaaagcaatgatattgtatccaatcaattgcttgataaacccaaacagcaccttgactatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgataccctttaaaggatgacgcatgtaacatgctcccgggtaacaaatcttctgggtaatatagaccaagtgtagctcatatgaatagcttctgatctgaatgattatcccttatgggatactccaaaataaatataataattgaatcccgactggcgcaagtattcggttgatagcctttacggggaataataattggtccagtctttgagcatagaagatagactcatgactatgaatccatgtggaatgtatccggaacaagtcccaattggagatataatcctcacgcttgagttgatgagcccctgagcatatagcttgtcattttgtcatagtcaaaattgtctattggcaatagctgacgcagtcggcatggagatgaaatgaccaacatgaagacgaaattgctcatcagaagtaacggaagatgtcagtggtagtaaaaaacagtgacaccaatcaaaggtaatgaagttgcataaccatggaggcgaagaaacagtcggtgttgacaaaagcaaaccgacgatgaagacgtagacgcgcatcaacagtgatggcgaaatccactaatcatgaagatgaagaaaatagttgacgacgacaaacgcaaccgacatgatgaagatgacgatgtcggtgatccagccaatagcagtgtagcaaccaatgataatgacaaagacgctcatcagcatttgcatagtaggtcaaccgtcaaggtgaaataataagtcggcgaaaacataatcatccattagcaacagcagagatgtcagggtcgatgaagcagaggtgctggtgatgatgttagtgacaataatccatcaaattaatgttatagctgttgtagatgcttcaggggtgccgaatacatcgagtgtacaagagcgtaggttctagcgttntcagnntcaacac

SEQ ID NO: 6839 - DNA, 789 bp, Oryza sativa
ttgtggtggtgaagtagtaaacttgcgagtaacacaatagattttgcaatgcgaaaataataaaatgaagtcgctccaccatgatgacaaagttgcatcgccgtgatgaagtgaacacgagtcggcggcaacagaagcaaactggtagcgaagacgcgcagttgtgaagataaaagcactagtcggcggcggcataaccagtcggcaacggaagacgatgatgtccatcagtagtggtagctgtataaaccagacgtagaggcgagggcactagtcagcagcagacgagacgaaaggcgatgaagatggtaaggccaatcaacactggcagaatcatgcagccatggaagtgaagaaaccagtcggcagccatggcaaacgtaggcagcttgtgttgaagatactgatgcctataagtagtgacagcgatgtagccagccgtgaagaagatagcatcagttggcgttataacaggccagccgtgcaagcgatgacaccagtcagcggcggatgcggcggccggtcggtgaagacgtagacgcccaacaacggcagcataataggccagccgtgcaggcggaagtaccagtcggcggcggacgaggcggccggtcggtgaagacgtagacgcccaacaacggcagcatactaggccagccgtgcaggcggaaacaccagtcggcggcggacgaggcggccggtcggtgaagacgtagacgcccaacaacggcgacataaagggcagccgtgcaggcggaaacaccagtcggcggcggcgaaggcaagcct

SEQ ID NO: 6840 - DNA, 963 bp, Oryza sativa
  unsure (1)..(963): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctacgtcttcaccgaccggccgccgcatccgccgctgactggtgtcatcgcttgcacggctggcctgttataacgccaactgatgctatcttcttcacggctggctacatcgctgtcactacttataggcatcagtatcttcaacacaagctgcctacgtttgccatggctgccgactggtttcttcacttccatggctgcatgattctgccagtgttgattggccttaccatcttcatcgcctttcgtctcgtctgctgctgactagtgccctcgcctctacgtctggtttatacagctaccactactgatggacatcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntt

SEQ ID NO: 6841 - DNA, 850 bp, Oryza sativa
  unsure (1)..(850): unsure at all n locations
cgccgccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgtgtgtgtgtgtgtgtatatatatatatatatatatatatatatatatatatatatatatatatatatatatatatatatataatgcccgtgtgttgcaccgggtaatatcacggtggataaagttcaactaaacgatttacgtagtctagtacataattttgtttggacaatattaactcgatctacgagtaggatattcaattctcgcattgcaagcatgtgtcttactttcaaaatcatatatggactccgcgtagagatttactcaaagtctcttggtggccacgcgtgctttctcactatgtcaaaactcgcgttgcaatcatgtgctctcgttttcaaaatcatgtgtaatttttaatccttatgtcaaatctttaattttttacaatcggttttttatgtcaaacaaatattaattgtgggaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggc

SEQ ID NO: 6842 - DNA, 1613 bp, Oryza sativa
  unsure (1)..(1613): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtataccgtattcacaaataagggatacgccggaaaaaattgggcaaaagccgcaaaggccggaccgtaaaaggcgcgtgttgggttttatatagtccgccccgtgaggtacaaaattgacctaagtaaggtggaaccgacggattaaaaacagggttcctgaagtctgggcgtttgtccactgcgtacgaactgtcctttctttgagagggttttaatacctcggttactggg

SEQ ID NO: 6843 - DNA, 893 bp, Oryza sativa
  unsure (1)..(893): unsure at all n locations
cggttcccnanggtaggacnnnnnnnnnnnnnnnnnnnnnnnnnnnnnnnnnnnnnnnnnnnnnccgaacgagcagctcagagcgttttgatatcatgctgctaatcgccctgatgcttcaactaacatgttggcttgcgggcgttcatgctcagaaacaagggtgggacaagcacttccaggctaacacagtcagaaattgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagagcttgtcggctcaggcggggcacgctaagcgcgtgcggatcggatcagagatcaggaaaaagacaaaaaaataaaagaaaaagaaaaaaaagggacttcccgcatacgcggagaaaaaaccttttcgcgtgaaaataaagggtgacaaaaaaataaactgcactgaccaagaaaaccgcacgattggcggctgaggcggggcgtgctatgcgcatgcaaataagagcagagaacggaaaaaaaagacaaaaaaaaaaggacttaccctgcgcgggaaaaatcccgttccgcgtgaagaaaaatcggcgacaaaaataatagccggacgaaccaagctaaaaccggatactctttttttttattcgatcatcataggcaaaagccgaggtaggtaaagtagactattccttccccttaagttgacaaaaaaaaaataagtttggccagctttctacagcccaattagatttgccacataaggggggtccacttctcaatctngnnggttgaagcgntgcgtcattccnngcagcgc

SEQ ID NO: 6844 - DNA, 991 bp, Oryza sativa
  unsure (1)..(991): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattctttcaaggtactctgagacagcgtcacactctgggatcgagcccaatatggtaggctcaatcgtattctttaccacagccaaacatttcttgttggctaagaaccatttcttttgttcaatgtcatacgacatgacgagaggagcattgtccctctgtctcttttgccagtcagcatctgactcattttcacctctgacaagttcagcaggttctataggacatggggtagtcaatacccagtccacctctcccaagataaaagcaaggtcgagttttcttttccattctgcgtagttatctccttttagggtcggaatatctttaatgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6845 - DNA, 967 bp, Oryza sativa
  unsure (1)..(967): unsure at all n locations
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctgcgcaccatatccataagcgtacggttgcgcctttcagctaccccattctgttgaggttcgcccggtgttgaatactgggctactattccattctctagcaagaaccttgcaaaaggtccagggacttgcccataaggcgtatgtcgaccatagtactctcccccacggtcagatcttactactttaatctttatatcaagctgattttcaacttcagctttgaatatcttaaatttatccattgcttctgatcgctctttaattggataaatataaccatagcgggagtaatcatctgtgaatgttatgaacgagtcatagccatccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6846 - DNA, 1272 bp, Oryza sativa
  unsure (1)..(1272): unsure at all n locations
ctgattatatactactacaagatcaactaatttcatattatttgtcagtattacatactactgtgaaaagcgcatatatatgcaacagttaggaattaataaacccaacgagtatagtcgagtatggctagttttggaaatgcatgccgcttttctgaatctttgaaaaaagcatgtattttatactactgatacttttgcatcatcaaatcatgaatgcagccagtagcccagtagtctgtactgctacagtgtaaaatcaaaatgttagactttgcactaggatcacctaggttagatctagtcgggtggttctatttgggtttgatgaacgacattgtcgatgaaagggagagggtttagataccgaccggttgaggagttcgaggaggaagaggcgccggacatcgtcgttgtcgtcgcggcttgacgtaaatgcggcgccggtgaggtcgacggcgatgacggctgcggcagtggtggtcgtagacgtcccggcgatgaggcgtggcgcggcggtggcgtttcccgtcactggctgccccccctctcgatcggattagggttttgtggggtgaagttgtcgccgccggtgaacttcgtacccagtgccgtgccggcctccacccctcttttatatggcgcagtgtgacaggggcccaccagccattgggctgggcgcccccgatcagggcgcggtcaaggcccccttgagccgttgggctcaaggggagggagatctatctaacattctcccccttgatctcactttttcttttagctttttctattccatcacagatttgtaaatagagcatgtttcatcgtcacggtcaatcaccgatggattcgacagccactatacacaactctattcagaaacagatactttacttttgggccctgtagtccaggattcataaggcttcccttaaacccatgccggctacatgttccttgaacacgttgggtggtggtggcattatgaaagctgcagcgatcagctgaattactcagatgaaagaattgcaactgtactccctccggttctataataattgacgttttagataagattgaggtcaaacttttataactttgaccatcaataactttaaaaatatttagtttaaagaaactcgaacaacatatataaatttgtctttcaaaacactataaaaagtaaacatatatttatttatnnnnnnnnnnnnnnnnnnnnnnnnnnnnnnnnnnnnnnnnnnnnnnnnnnnnnnnnnnnnnnnnnnnnnn

SEQ ID NO: 6847 - DNA, 5637 bp, Oryza sativa
  unsure (1)..(5637): unsure at all n locations
cgcgtgctacgaaaactacgagcacttgcangnnnccaaggggtgggaggccctccgaatccaacttattgattttgaaccccggaccagttgtgtcggggccggatttaacttttccaccacggagctctggtattgccgccccggcgacaaccactgggtgaggctccatcagcatccgtaccagcacagcaacactgagcaccgtgacgtcatcatcaggtttttacgccagtttacggcgatcgacggcaagttctacagcgaactcctcatcggcgatgacgggcttgtcggcgtcctcgagttctcgccggagctgacgctcaccaagatcgccgtacacggcgtcgacgacgacaggagaccaacggtgtacaagaaacgcaccacttgcttcgtggaatcaaacggggagctgcactccgttgtcttctctcacccgatcggatgtgaccggattgtcgcgcgtgtaggcgtttacaggttgagcattaatctgacgacaacgcaggggcaaagatcagcagcgtgggtgaaggtggattcgctaggtggcagagcgttcttcgttaagataggcagttttggagcgtcacttgatacggagggaacgggcttgagagggaactgcgtctactactcggggttcaatgggaaagtgttgtgtgtatacgacatggaacgaggaactacggttgtaatcgatcccggcacaaatcttccgtatcaccagtcgcctcaagtattgatgccaacattttctggatatcatggcggaacaactcgaagtgttgaaaatatctatcaggtagggccaacaattatggaaaatgcttatgaggcaaaagacactaaggtgagtaaggtgaagagggttgttcgatttttcgaggatggttgtacctgtttgccgattcctattcagaatacgagagtgacaaagcagaaagattagttaataaatcagaagaagagtaagcggtctacggctggaagacctccttatcgaggcgaaggggcaagcagccctgaaacgaagaactcataccatggttgtggctttcccttggagccgctcaaacgtcttctaggtatgaagaagtaggagcgcactacatggaggatcgaacttgaatttttatgccaactcaatgagggctttttaattaactcattctttcaaaatttgcagtaatgatagctcggctatatcatgtctattaatttcattaagttttgttctctactatgtgattgggagcactttttctttgaaactttatgaaaccttctcgcgttgcattaagagaatgatttggtaaattttctttgacaaaataagttataaaatattaaaattaattttgaatttttgctttttccaaatatttgtgaatttggtgtttatttattcaaatttagtaaaaaaaatgtgttaaaatttcaaaatattttgttcggaatggtgcctaccgaattttttttgctttccgaaaagaaaccctgcttatacctggttttagaattgggcgacgcgattgaaactctacctcgtacataagggacgtggagagaactttttcgaactgaaaagcatttcgtggctgaaaccggcccatggcctctttcagttcggctcggcagtcggcaacagcaagagagtgagagactcgttgttctcaaaaaaaaaaaatgttctgaaaaaagtgagagactcgtcagtgaccggcacgacatggacgccggcggcgaggaggcgaagcatgagcgccacctggttgctcgtgccggcccgcaagctcttcctcctctcccatcccgacgccgacgacgacctcgccggccatggtcgccctccgctccgacgtcctccacgccgtcaaatccgccgtctctctccatctatccatcggccggctccccgcctgcacgccgcggtcgagtcgctggccgccggactacgcgcgcgcggatcgacgaggaggtccgcaagctcgacgggaagtgagtgggttcttcctcccctcaattatggcatcatgttactcttattgagtattgcccagaaaantanggttgcccgntgctggtcttatagctggaggctggagcactctctatgtgcggataaaatntgtgaccactcaagtctttgctacgatacgttttcctcaacgaaccttagggttaggtaattaggttactttggggaacttgtcgatcacttgcatttgactggatatatgtaatttatgaattatttttcagaatggggtcggtatgtattgtatgaggttcctcttgagagagtttgcataccaagtgcctaattctgtcttcagtatattgccagtgttcgtgtatcttgattccaggctcacagatgtgcatcaatgcatgctttggttcattgttacaagatgtaattgggcttgtagaaaagcaatatagattcctaaggatcacaattcacaacttcccaaccaatataaaagtaatttatgcaccctcctcaccaaggaaaaaaacccaatgtaaactaatgtgaaggaaaatcaagatatataacttcactagagcataaatagtataattgtggttccagtcatcaacacatccccttttagctggtcacatatatcttccgttctgctctccgcatttgttctgtatctaatgtttcagttactagcaagtttgacaagaatcattgcttcctctgaaagtaattttttttcatgtatcaaggattgctgacgctgaagagaatttgggtgggattgaagtgcgtgaggcccatctagctgaatccttgtacttcataagtgtcaggcagaaggtataaatctgtatttttctatactttaccctgtggtctggttgacatagtacatgctcgaaatttagctacttcagggacaggggacctcctgtcctgttgcaggtccttggagggaagtcttagaatcaggacacttctgaattgttcacactggtatgaaagaggaggttccatctagatcatgtcaagttaaatacttaaatcaggaaaatctcgtaaatggggtcttggaaaagctaaagatttgcagtcggagtggtcaaaaaatagatttcctttgtatgcttttggtttatgctgctgcttttatgctcccactcatgcaatgatatgataaaagatcacatggtaatatggtatcgatttgctcagtcgctactttgttgtcctaggtaaattgtatgcatgcttggcgtctgtatgaagtgcatgacaatgcatccggaagcatcagctgttgccacagctattcttgatacaataagatctgggtactccaagcctaaacagacatttcctgtgttaaggaactttattagttaggtacaattttgacattaacttttgtttcaacagagctgtttcacaacatcctgaagcatatgtcagaaggtctatgtgttgtttgcaacttcttgcaaattgatagcgctgcacctgatgtatgtctcatcagttcttatagaaagaaatcaggacattccaactggtttggaattgatatgcatatgggctcttcatgttgcagaagctgatcctgatacataatgcatatcagtaagtattctggtcactatggggggatatatctgttatggatcactagtttgtattttgttcgtcaacgtagagagcaattatggtattggctgagcgcacaatattaatagggtcatttttcaaccaacaaagaaatacaggtgttcagcgtaaacgttatacaatatctcattttcatctactttgattttagcctgaaagaagagcaattttactgcgagatgatttcactatctgaaaataaagagcaaataactcccacattatgtttggcccctttgtatcgcaggaatggaaaaacggaggaataggaaaaacgtaggattctgacaggaatgcaggtgtaaaacagaggattggaaaatacaggaaaaacacaggaataaccgtttgattggaccacaggaaaaacgcaagaatcggatgagagagatagactcaaagaaatttttccaagaggttggacctcttgctaactttccttcaaaatctctataggattagccattccataggaattttgaaggatagtataggattcaatcctttgtttcaaaggctttcataggaattttttccaaagggttgaaatctttcaaattttgaacacttttcctacaaatcaaaggcaaaggggcccttagtttcctgtaacgtacttactctatcattccttttttactcataaagagagcccatttcagtaagctccttttttactcataaagagagcccatttcagtaagctggaaattcagtaacctctcacaattcaatctaactcctccattggcttgtttgtctctttgcaggccaacatgaccagtttgcagctctattccgagatcttcagaaatcacgagcactggaatcggtggatcacaattcataccaaggccaggccagcagcagcagcagcaggtctctgccttgtaagctttgataccatcatacattcgcgaacttgatgatcaatgtactggattagaaatataaattcgatcaatgtatgataatttgatcaacgaatatatagttttgtgataatttgatcagtttccctctcacacccctccctctctaatagttgggtcccactgatttttttaaaaaaatattgatttgattgtcacgtaggaacaaagccactccggcttctgcactatgtgaggttggtggcgtgggtggcggcccgcctgtcagaaagcggcagctcgcgtcggtggcgcggagagagaggcctatgcgtcgagaagaagagacagaagcgagactgtgggccccacatgtcagctgtgggatgtgcataacggacaccacagctatagttgcaaatgcaatgtgggtcatgcagggcgagaggaggagggcgcgtgctccgtggggaccaccagacacgggcggtgcactcctcgagcgttggatcagccgcgagagacgatccgacagccgagatgcgtccggttcaggtatttaagcgcgatgctttcttctccttgcgcttcgctgcacaaccacttttccgcatctctctcctctctctctctctctctctgtctctctcgcaacgtactcatctcaagagcagtagcggcgaaaggtgcgaggtgagttgtgagattctcctcctcctccatccctaaaccctacgtcctcccaaagcgccgtgagatcactgtctgagatatgtaacctgtttggttgttccaggtaaatgcaacaagaagttagtatttcagataaagttccagaaaaaaaaatggcgctatcaagttagttactctaacactaggcaaagttccagagaaaatgacgccaaagtaaacgaatctaaaaaagagcaaaagagatacagaagtttcagtcaaagaatctgaaattcagcaaaagtttcagagattgtgcccaagtggtgactctgaaattcaccaaaagtttcaatgaatgacttgaaattagcaaatgatccacttattgactgaaaatcaacaaaatttcacgtaaataaattt

SEQ ID NO: 6848 - DNA, 740 bp, Oryza sativa
  unsure (1)..(740): unsure at all n locations
atgcgcctttgatgactgatgatccnattcgaannnnnnnnnnnnnnnnnnnnnnnnnnnnnnnnnnnnnnnnnnnnnnnnnnnntaattttttgcgccgatagattatttctgtaaatattaaaagaaaaaaattaaaaatgaaaaaaattccttgcccggagatggtctccacggagtcgccggcccagctagctgcagcccaaggccggagcaggccggcccacaggccgtatccctcggcccagtacgggatcaagtcggacttgcgggccaggtcaactccaattcggactcttgagctcgtcgcatcgcagtgatcatgtcggagtcaacgggttcatcatcatatccgtggcgctataaatttgcagcgagcacgtcgtctcccttttatcacatctttcaagaatccatcaccgagctcgcggcctagctccgcgcccagagcgcgccatggattatctctatctggatgatgccgacgccgacgtcgaggctatgcttcgggagatcgcggncgccgtcgccgccaatggtcccggcgagcagcttgctgcgacaagacggacggnagctactgccccgcaagagatccgccttgccgggttggacttacgacgccgacctgtacgccaagcctccggccattgaaatggcccccgccgagcggtctttcccgactactgaccccgggcaacgcggccggtctaccttggacccccgcgtcttcgtggctg

SEQ ID NO: 6849 - DNA, 1616 bp, Oryza sativa
agcatgcgcggtggcccacaacggtggcctctcatcatgtcgtcgacgccgccgtcgcccaccctcgttggcgttggcgttggcgccagcagcgctctcttcggcacgctgtaaaggaacgtggcgtcgccgtggccgccgaacagcagcagaggagcaagcttgggatccagagcggcagatgcgtcgactgcctcctccatgatttcaacggacggctggccgatcgatctttcggtaattaatccttcgtaggagacggccggtcaatctgtgctatgctttataaacgaggagagtttgtggcagcccgatttaagtgttgtctcgtgatttctgttcgaaatcatccgagaggctttgagaactagtatatatatatattggcatataggaaagagaaacgaagaaatctgcacgcctaaatctgcagcgcccatgtaagtaaatcaggaaaaggaaacatgaattcctacacgtacggcatcaaaattcaaaccaattataatctgcaccgccggtaaatcagttttttggcacggcatagagacggatcctccacattactatgcaaccgacaaaaaccaaccgggtggggtacaaactattacaagcggaagctgacctatatgtgatgcgagtccggtggaaacacgtttccgaagaagcagtgcagcacagaacgcagcacgccatgcaggtcacacgcgtgcccgaactctcgagattctccaatctccaatcacagagggcggccgctgcgacgacggcggcgcagctgggacaactgccggactggtcgtctcttccgtggacatgctcgtgctcgtcctgggtcgagccacccgagcttcgtgtatgatcagtatcatccgtcgcatgcagatgcagtgcatcatcacacatcatctccgtcttggacatcaaaattgagtggaactgtagtgaaccggggacctcctcctgaatcatgaatcatgcatctacgggctgtcgtcaggagccgtgccctcgtcatcagctaaacttagtcatcagctgagtgactaagtttgcatgtttccgctgacagagatcgattcagcgcggctaaggattcaagatgccgttcctatcaatcaaggcggcggcggcggcacagagagagcaagcgagcgacaagctacggcaggaaggagagaagaattctagcacccggtgttagtatgagtggaagagggaaggacatggcttaacgatgccaaggggcgccgtggcgagatgacggtcgttcggcctcggcgtgaaccaaggagtggcgccacgggcaccggggtcggagaagaggaaagcaaaagcggcgagcttgctctggtttggcggcaaaacggtcgcggcggacagaggggtgacgcgcgcgcgggggaaacggcgagcggcgcggcggtggagcgggagcgccgtccccgtccgcaccggcacatgcgcgacgcgtgcggttgctgggccgtgaccgagcgctgggctgggtcgacatagaaaggaaaaagtacaccgaaggtccctcaacttgtcatccagttacaaaatcatccacccacccgaaaaccagatataacacaaccccctacttataa

SEQ ID NO: 6850 - DNA, 845 bp, Oryza sativa
ccgcttccccacgcgcgcgtgcaggagaccgtcgccgccagctacgacaaccttgtcgccgcggcgcacgggttcctcgcccgggagggccacatcaacttcagtgtctccgccgcgttccccgcctctccccatcaacttcgaagtcattagtcgccgcttcgagctcaaccaaagaaaatgatctgtatgctggaatgcccagagcttccaatttcactgtctgagatatgtaacctgtttggttgttccaggtaaatgcaacaagaagttagtatttcagataaagttccagaaaaaaaaatggcgctatcaagttagttactctaacactaggcaaagttccagagaaaatgacgccaaagtaaacgaatctaaaaaagagcaaaagagatacagaagtttcagtcaaagaatctgaaattcagcaaaagtttcagagattgtgccaagttggtgactctgaaattcagcaaaagtttcaatgaatgactgaaatttagcaaatgatccagctaatgactgaaattcaacaaattttcagttaataaatctgaaattctaggaccaagttacgctgacagggacaagtgaagcaccgagtggaagatcagcacaagaagataactctgaacagacaggactttttgcaagcttgcaaagtgcagatgccaatcctcatgacatctattcttctttggttagagaaggcctgtttgatactggtgatgagattctgtctatggatacaggggaatctgctgatactcctatttcaggcctagcgtcaggtttagcaaatcttggcactgctgatccagctgaaaggggctacttaatataca

SEQ ID NO: 6851 - DNA, 904 bp, Oryza sativa
  unsure (1)..(904): unsure at all n locations
cggggttctggacccgttcggtcgaatcaggaaactttcttctctcaacctgttaatgtggggcttccaatccttgtcattgaggtacaaatgaataagagtaaaaaccttgtaatcagaattccaccaaaaatggttgccaccccagagaagaagctccaccaccctcaaatagataatgtgccagtacagaagactcatcaagagcctcaggtacagaatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatgaaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccgaaaggttatatggctttgttttcatttcattgagctcatactgatttctgggacattgcgatgccccatacttttcgcctttcattataggagcaggtgtagcannnnnnnnnnnnnnnnnnnnnnnnnnnnnnnnnnnnnnnnnnacatggagcgagctctacgagtgactaatnngcgcgcn

SEQ ID NO: 6852 - DNA, 684 bp, Oryza sativa
  unsure (1)..(684): unsure at all n locations
cgcggcatgaatgcnttcgcctcgnnnnnnnnnnnnnnnnnnnnnnnnnnnnnnnnnnnnnnntctaagtatgtggtctctaacaccacctccatggtacctttctgtcacaagctgcttgatcagctgtgtagcataagtctttgaagagtcagtaaactgactctttattctttcaaggtactctgagacagcgtcacactctgggatcgagcccaatatggtaggctcaatcgtattctttaccacagccaaacatttcttgttggctaagaaccatttcttttgttcaatgtcatacgacatgacgagaggagcattgtccctctgtctcttttgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6853 - DNA, 644 bp, Oryza sativa
  unsure (1)..(644): unsure at all n locations
tccgggacccgtganctttganccctctagacncttcgaaacncncangctnctntagactcnaggaattctgtaccccaaagaagttcataccttgtttattgtggctgtcagtattgagaaaccactaaagttatactgcgacagcgaacccgcagtaatgtacgctcacaacaatcagtcaagtggtgctgccaaacacattgacataaagtactatgttgtgaaggacaaagtccgggatcaaacaatcagtctcgagcacattaaaacagaaaggatgctcgcggatgcgctcacgaaaggcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcg

SEQ ID NO: 6854 - DNA, 1707 bp, Oryza sativa
  unsure (1)..(1707): unsure at all n locations
cgagccaaaccagcggggaactcgccgccgggggcgcagtccgggggatcaacggcgacggcggcgctagagatcagaggacacaacagctaggttagacgggagattattgacattggattaaccaattcaattaagaaggaaaccggattatcggcgacgcgagggcgacaatggcggggacgacgacggcagcggtgcggcagctcgggcggcagcgcgtcagcgggctagggcggcgcacaactaggagaggaaaaagaaagaaaaacagggggaaaacacttatataggggtggataggattaggaaaggaggagtcctagagggagtaggactaggagggagggagggagaccgactcggcaaggggtggggaggcgcgcatggcaggggggaaggtggctcggccggctggggagagggggagggaaaaaggaaaaatgagggtagtaggactttcccgaaaaggaaaaacaatgtggtgccattttagtaaaggaaaggaaacggtcccatgaactgacgcagatacggttcgtcaagcaaaacaaaaccgctgactgagaggggagtgaattgggcacaattcacgaccaaaggcaaaggaaatataattaacttgccacttttaacttagcaacattgcccccggtgatctgatatttactctttaagtcctgttaagagcaaagagattttgaaaaaaattctcccagacaattctgattattaaatgcattgttaactggggttttctcctggttaaccaaagcaaattcttgaagccatttattagtgatttggaacctaagggaagagaaaactccgggtgtgatagacagtcaagcgatagacatagggttgtcaacgagccgagctcgagcgtgcttgtctgtgtaagctcgagctcagtagagactcgagccgagctcgaactgagcctcatcattctccgagcttagaggtaagcttgtactcggctcgtccaagcctcgagctttcacgagcttgagaggtataataggttgaaaacaaaaaattgtgcacaaaactaatggttctagtactaagaagttgtgccatgcacacctttatgggaagaagtattagttgttggtaacagagcattgatggcgatgtagaaaacttcacaccatagtagtatagctgcacaggcttttgtagggcagtagtataggctatatggtactgtgctacagtagtataggatagtagtaggtactagtagcacttgagcatacatgaggctttgttgtgacgtgtgttaggtagcatagcatttagacaaataaaaaaaatttaagccaagtagcagaagggtctataggactaatgctaccatgcatgagtgctgatctcgacgagctattcaagctcggctcggtgaggcttgcgaatcttacagaagggcttcggggncctttcggggggccctttccgggttttgggggtttggggggaaaaaaaaaaaaggggccccccctttttttctttggggggggaagttgagctttggttgagccaagctcgaacagtttgtgagcttcgagcttttttgacagccttagataaacattctatttcctgtgatcatttggccaaaagaaatacatgcctatagaaaccctatttcctttgcagcttgtatttggagaggcatattttgtgaaaaatgtttgtttn

SEQ ID NO: 6855 - DNA, 2289 bp, Oryza sativa
  unsure (1)..(2289): unsure at all n locations
cgcgattgtacgttnnnnnnnnnnnnnnnnnnnnnnnnnnnnnnnnnnnnnnnnnnnnnnnnnnnnnnnnnnnnnnnnnnnntgaatctttatctttatctttatatactactttaaaaatccgtagtggtgatgttaaagccagcgtaaacataaccgcgcctccccctctcacgcgcccacaccgacgcatcgctccgctgcccctcccgccacaagccgcccacaccgccgcccatccacgatccttaatcaccgtatggttccgccccgatccaagcccccaccaacgctgctgcactacggtgctcactgatgacgacctcctccacctcagcttccccaccaccctcgtctccaggcgctggctccgtcactcctccaacctggctttcctctgctgtttccgcgcccgcaacccaccccgcctcctcggcttctaccacacggcacgccaggatgagcagccagccccagccgtcgaagctcgccgacgtgctccgccaccgcggcagattcacgtttggcggtgcgtccagcgctaacgactccgtcgtgatcttcgactgccgctcacagctccaagccacacactgcgcagcccccctctctcgctcaccggccgcgtcgctccattcgtccagcctcaaacaacgccttcatcaggctttgcaacaacctccacctgcaattaacggttcgttcagtctctgctcctctccagttcactccttttctatattaagcgctatggatgcatgtattgtaatgtgcccagtaggtttttgttaaatgccgttgagggatggatggattggtaatatcatataggtgcaatggtgaaggtaatttggttctcaaaaaaaaagttactgtccctcttcgcagtgcgccactgtcatctttgactctcttgccatttgcttatcgaagaacttgcacagggagaggacattgtattaattgttccctgctatttgttgttgcatcttgtcctagtgacaaacgtgcaacttgacctgaagattttttctatggtcatcaatgatgctcgttacaatcgctctcattactgcgacaacagaagctatttgatccttagtgccaactccctgagatgcctctcattcctatcatgtagttctatccttgctagtatgggagtgcacatactgttgtaatccacgagcttgaccaacactttgtctagttctgaaacaagagtcgagtatatggaggcacatatatagatcatgaaccatattattattatgttcccctcaaaaaattattattattacgttcatcataccacaacaagtacaaagatgtgaggacaaaccaacagaaaataaattggaacatacatttacctagaatggaagaacatgagacatgaatgcatatacatccatgcttgtctttttttttgttgagggaaaatccatgcttatgttttagatatatatgaaaataaatgaagtgaaaggcacatctggtgtgtgctgatattgttttgtatacatgactccaacctattaactagtgttgaaaactagctagaactcataactataacacatatgtacatttgaataaaaatctcgcggaattcatgttgtagtccatctaattggcttgggtacattaagagtgcttgtgttgtcttgtcttccatgtagagaaaactacagtgctcgccaagtttgtacattcacatccattactttacatgaagacatatgatattcctttgagtaaacttcacttaatcctatgtattgtgttctaagctgcacaaaaccaaaagtctaaaaccatagaggttttagcacatgacacttaacccgacatattatggctgtaaagtctcacaaaaccacactattgatctttttgactttgttctaactaacgcatttgcataaattattttttcaacttgtaccataatcgataaatatggttttatgaaatttgctatttttttctattggggatgccttttgcatatgcaagctaacagttatatagtacactcatatttcaatttgagttgaatatcgttttattttcttgttgaaacatacatttccttgaaaaatcatgtattccacctagtatatatttccttcaaaaaacaatgtaatcctgttgaatggtggcgttgggcagttgggccttcgttagaacaagttggatggctgttctttgaactttcgtccccaaataacattgggtaccgagctagaattcggcctgtatgcatcnggtngtcaatcaatccat

SEQ ID NO: 6856 - DNA, 46030 bp, Oryza sativa
  unsure (1)..(46030): unsure at all n locations
atggnttatttgatcatcnnnnnnnnnnnnnnnnnnnnnnnnnnnnnnnnnnnnctgggatgctatatgagggggtaaatggcagcaatgggtgaagtagtgcttgggaaataatgtgaggcagccatataggtgatgacgacgactatattttgttgaaaaaataaaggccatcagaccctgcttttcattgatagtcacaatggtttttactaggataccaggctaccaactaccgcaagagtttgtaagcacaaattgagcctgttaagtaaccttgatggactgtggctgcagctataccaacagtaactacaacaatagcggtacatgagtgctattaccgttaaggctatgttcggtatccccttttcctaacacctctccctcgttttttgcgcgcatgcttttcaaactgctaaacggttcgttttgtaaaaagtttctatatgaaagttgcttaaaaaaaatcaaaataatctattttttttaaaaaaatagctagtacttaattaatcacgtgctaatggatcgctccgtttccgtgattactgatccagatgggaacaaggttgtgcgaacacagcctaagggcctgtttggggagctttagattataagaagcatctgtttggtagtcagcttctgagaatctggaaaagctctgaaacccagcttctccagcttctggcttcttagttcatttttcagaatctgtaactacaaattctcagaatctgtaactacagattctcagaagctgtggactgtttggggcagcttctagcagaagcagcttttggaaaaagctacaactgggacaagctcccctaaactgggcctaagtgcagttgcagcaacaggaggtaccgagtagccccatcaactggccacaccctagccaaccaagtgaaacatcattactagaacctatggttaaactaatactgattacaagtcatacggcgcatattagcaataaaaaaatttataagtaaaacttttatatgagtcctaaacgatttaacagctcacattggaaaacaaaatgggatgaaaagaattcaaaatcaacatcagaacgaggttttaaattttaattctaagcagctgttataggctgtagggcaaattattgcagctctaaactatggcagaaccatctctagaaatacttagccaaaactccaagggatgactgcttgacgtttgtttctggacattactgttgccacggaagttgcagtctagaattgacacatcattctcctggctaacaggctcgggcttcctagctctatgacttgtaattgtcacttaggataaatccattgcgaagacacctgacggccgtcggcctaaacattagctgtacaggctatatgacacgtatatatgctcgtatcctataggtcgctagctatattgatgcaatttgcaaacctatcttgcacggaggatactagaagcacctgcaagaatgatgacgtagattcctgctattgtttgttttatcaacccatcgatacactatctgacagagtaaatttctgcagagattatctactcattaccgcacaaggatatctcgttcgatcattccaattcccaggtgcctatcattaccaaccaccgttccatcatatctactccttcagtcccataatataagggattttgagtttttattcgtaacgtttgaccatttgtcttattcaaattcttttttgcaaatataaaaaacaaaaagttgtggttaaagtactatagataataaagtaagtcacaaataaaataaataataatttcaaaatattttgaataaaacgagtagtcaaacgttgcaagcaaaaactcaaaattccttatattatgggacggagggagtaggttttttgaggagtatgtatggtggctccattgtagattttttttttggttgttgttgttgcaatggttccatcaaactagtatgggagtgtaatatttgtaaacacaaggctgatcgagcagcactcggttgaggtctgaaacaagttgaaatgtggagggatgcatatacatggatcacaaaccatttttttaaagtaaatttcagaaaactgcaactttaatgacaaaattatcagtttattgcaatattagcggcatgtttcagtttgctgcaataatagcgtgggaattatcacaaaactataacttttacgtcatatggtgctacatttgtcatctatatgtactgtagcaacatataacgtaaaagttacggtttagtgataaattctcacgctattgttacagtaaactgaagcatgtcgctaatgttgcagcaaactgatagttttgtcacgaaagttgcagttttctgaaatttactttttctttttacatatcttaacatggaaatatgcgaggatatagacataaattttcatatacaaaattttactagactggtagggggacaaggcacattaaagttccacgcatatatatacaccaacacaagattttcttttggatatgtataaaaataaattgatcaagaagcatgtttggcagttaaactatggatatatgatttcaccaatcaacttttaaccataaatattttaaattgctatccacaattagcattgtttttgtaggatccaatcacaagaattaagctaaccagaggggggtgaatggttggtatatctaaaaaccgaaaaacttttagcggaaataaaagttaccctcgaaatcgacggaagtcggtctgaccgagattgatctgccggtctgaccgagtggatgctgccggtctgaccggtgttgaatctccggtctgaccgccgaagtcgcctgccgcgcctgccgccgctgccggtctgaccgccgtgctcccgccagtctgaccgccgccttgccgccggtctgaccgcctgtgagttgccggttagaccgccgaaacccggtgaaacacaaatcgaagaactctcaaagtagatgacaactttattgcttctctctgtgtttacaaagtgcaacaacagcactccttacaaaaatctcgactaaactcgaaaccctaactaaactagcaactcaattgctctcaaaagcaatacaaaagcgataccggaaagcctcacgctccccctctatttatacatgacgtaggcagcctaaagccacgaaccaaactcatactaagagtcctaaacaccttaggaaaccctctggtacaagaaacaaactttacataaccaatcataccaaatttgaactccttccaaattcgactctgcatcccatacgcacacaatacctccattgtatgccatatggaatctccatcaaccacgtgcatcaactctagtcttagtatccctcatgatatctgaccaccacggacatcgtcttaccaccaaaccgactcccggtccatcaccgcaaatactctcccgaggcatcgagtcacctacgcatgaaacaaacaaagaaactatattccgagatcaagctatccccaacttgactcattgttaacaaacaacagtattacatatgtatagtatccatctagaagccataactctgaaacaatcacggatatctaaagaaacaacccgaaaccaaaaccgacacagcgtcggccggtcagatagcgggccggccggtccgaccgcacacatagcgccggtctgaccagcaacctccgcccggtcgtaccggacacataaaataacagtgaatccgatcatcacctgaaaattgattatctccaaaaccacttcgacgataatctccaaatatcaaaaccaataatcacagaataagaatcaaaacacactttgatcttacagttttgataagattttcaggcttacatattttatttaagttatttgtttgtcaagcgtgcatgcattaaaaggtcacgctgatggttcatacgcatccttgcaatgaaaaaaaaaaagacactcacgaagtttgtaaatacatgtaatttataatattggtttatggcatttttgtggcatgaaccatttgccacattttaaatgcgcacatggttttaacatgaatccactatttagtactccgttactcgtagatttacacgtcacttgtaaaatcaaatcatactgtgaggcatttccacacttgtaacctcgaactcagtggaaatgcctaacaaagcaggtattcggtgcagaggctgtaacaaacgcctaacgaagcagaagtctgtcacaaactcctaacaaaagcagagtctgaggttccactgagttgaaggtcataaaaaataacatcaaattaagcactatcccttacaaacttactgggagtagataacaaatttatgatattttaagattaccttgcattaatttttcttaactgttggtgatataccctagaggcaatcatagagatgattgtatcacataatatgtttacatatttattcgacattgttccttgaaatagataactaattattagttaatgaatatgtgattctttcatgagactctttatgtttaatgaatatgtgattctttcatgagactctttatgttgtatgttgctatttctaaatgatccctaatcaaatatcatatgtggaacaaacatgtttagttgatcagtatatgtattaattgattatcatgtctcatggatcatggtatagagataccaaattaataatgtggacatatgttggggaacatgttgttggatagacccaacatgagacactgcaagagtcatatgcgttgtatcatcagtaatttcatttagtgttggtattgaatccttggacctgagattatcatggttcccaacatgtgtagtagcttgcttagggattgctaaacgctactccgtaattgggtagttataaaagtagttttcgggtatgctatgaaacatgtagtgggatatgaataatcaagatgggatttgcccctcctatggagagatatatctgggcccctcgatgttatagattatggaagtgcatggccatgccaaaggtgattgaggagtcaatcacaagttatataatctatcacaagttcgagtgaatgattaatctattagaggatggcacatatctagccttaagcttaatccatgtcgtgaggcagaggggttcatacaagtatacactagaggttcaaccgatatgatctttgtgtatgctcggtcggtcaatacgttccgctaggggccactgttgacacgtggaccgaaaaggaattttcgggttacaaccgagtgtacatgaaactgcagggtcccacgtttaaagggccggaataaggggattggatggagacccaatatgagcttaactcggatagggatccgaataggagtcctacgggcgttgaaggcccgaatcatgtatcctatatattcgtaaggggtgtgaccggcggaggcattgcatcacgcgaggaaccctagccaccactcccctccccgagcaaaaccctagcagtgcatgggtgctagcatatctgcgcgtggcgtttcgtccctgtacatgtagataccggcagaggcgcgctgctttgcggtgctgatcggcgtgggagtacggcgaggagaacgcacgaggaggagaagatcgagccggtgcgatcaactacttcctctacatcgacgcgctacatcacgaaggttccttcgccttcttagcgctttctttcgctgcgcaacgcatcgagtggtaaccatctatgatataacactttgcatggtttctggtttacgtggtagaaaatgttaatttatgctatcgtagcctacgcatatcccaatataccttgcattaatttttctcaactgtaagaaacattttcacatcttccatatatcccgaatccgtagctagacaaatccactaaaaaggtgcgtactatgcaaatgtgcagttgacagggtggtgctccgattccatgggttgatccccaagtgccagaggcccagagctattgacattcagtaagaaaaagagctaattgcgttccccaagaatggacatttggaagatatatgtaagacgtggaaatgtttccacatcttccatacatcttacatcgttccacactattgtgatttctgaaagacatttcagttaacagtacttcataatcttaagagttaagagctccattatggtgctctttactggtagtattctgctagtagtataaacaatctaagctatcgatttagaagcaggttataaacgtattttatctctctataccaggggcatttcatcattgacatatttcttccaaaatatctgattagatctatacggtgcctaaagagatttcatttgttgggacctcccaccgatgtatcagccatcactgtagtgtgcaaaaatatggcttgtgatgaagaaaacaaaacatatggatataagaatgaagccctcctcctctctcataacccacttaattaaggagatcctttgtttctcaatgctctgttcccgtttcagtttgagacattctgaatgcaccccaagtgtgcgccgccctgctgaaacaagctgtcatcttgccgttgcggcgtcgtctttttgattcatctgatcgggaacgagacatgcctcgccccacttgtgaattttgaaccggagggacaaatattttgattctccatatacccttctctattggactattgcacccttgctagtttctactaccactaatgaaggtgatagtataaatagagctagttcatcggatagaaaaaggtctacgatatagattaatatctactaatagcacaatagccaagcccccttcttaaacactcggtaaatacccaaatacattttacacttcaatccatttcagtatttcaatctatttcaggccccttttgattcaaaggaaattcgtaggaatcttagaggatttcatttctataggaatttctcctatatagccctttgaatcaaagtaatgaatcctatggaatcctataaaattcctatggaatacctaatgccatgcatgtttttagaggaaaattaacattaggttctacttcatggaaacttttctttgagtctttatctctcctctaaatcctatctttttcctacggtccaatcaaacgctcattcctgtgtttttcaatcatctattttacacaattacacttacaaccgtatcaaaatcctatgtttttcttattcctgcgtttactcaatcctgcaattcaaagaagccctcagtcttctagcagtgggccctcagtcttctagcagtgggattgggtgctcatggagcttgtattcacggacactcaacatccttcaaagtgcaattgtttaatgctgtcatccgccaactttggcagaaatatacatgaccaaatcattgtaattaaccaatgttacaaaaactaaatatttgagagaaaaggaaaaggaaaaggtttatagtgttcgcgaaaaaacattctaagcacaggcaccaaattaatagcatatgcttttccaaaacaaaatagtagaaaattattgtggaaagccaagatgctgccagagtgccagtagcaaaatgtgactccaatgcaaaccaaagccatacatgtggttactcatatcggtagtgcactatcggtagggcactaagattcaaccctactcgtcagaacaattaacttcctgatgcatcatcttcctgtattttggattacttggattacagttcgagtgctgaaaagatgaacagctacaagggaactcacaatattatattgtatcatttgtcgcaaatttctcatggatctgagattagtcatatgttgatctttgcttgcaaactccatgaagtaatgaaggtgcagcaatacatatagacggcgtaaacgaagtagtaaagctgttgcaatatatgtagacagcgaagtagtaggtaagttataaagatggcgagcaatggtatatactactaccaccatttcaaaatgtttgacgccgttgacttttttaaaaatgtttgaccgttcgtcttattcaaaaaatttaagtaattgtaattctttttctatcatttgatttattggtaaatatacttttatgtatacatatagttttacatatatcacaaaagtttttgaataagacgaacggttaaacatgtttaaaaaagtcaacggtgtcaaacatttagggaaggaggtagtatatattatgactttcagtctttcaatacatgcagatcatacgaaaaaatgaaatatttttttagtgaaataaaacattattgtgtttcatggggcatgaattactaaggaacaacaaatagattttattgctttatcagagacggttaacaacgatcttacatcttctgcccttaaaaatctttatgcttgaagagattttttttttctgcattgtaaacctcctacggagcgatctggtggtatgtgattaatttagaaacttttcatattggtttaattgatgagggtgatttttatataaagtttcatatttgtaataaattaaataagtttaaatgagctttagattttgtgtatgattggcacaaaatgaatctaaggaacaattttttactgaattagttcatatgtgtagtcatgaaaccttaccaattattattggtggtgactttaatatattacgcagctctgcggaaaagaataatgataattttgataatagatgacattttctttttagtgctattattgatgatcttagtcttagagatctatcaatgtcttgtaaaaattataattgggcaaataaattaccaatgtcaacttatggaaaattagatagagatgtctcggatcatgctcctttactcttaaatacaaattcatcttctatttgtaatagtcatcaaaacttatcttctgtttgtaatagtcaacaaaactttaattttgagttagatcggttattaagagatggttttgtagatatggttcaggaaatctggtcaaatgttgttagataaaaaagttaaatctggtcaaaggaaaagaaggacttgctgaaaatttagattttgttagataaaaaaagttgaattaactctattgagtgaggatgagattgatacaagacgttttttaggaatatgttagctagtttgcttagagaagaggaaattaaaaggtatcagcgagctaagactaaagatattttggaaggtgactcaaatacctaatattttgcttagagaagagctttttttgtcttcgtgaagcttcttcttaaactttgtatgaaagccagataagtgatatcccccaagtgtctcaattagaaaacaattctttagtagatgaatttacggaaaatgaaattaaagatgcaatttctcaaatggaacataataaagctacgggtccagatggattttctgctaagttttatcaagtgttttggaatgttatcaaacctggtttggtagatttatttaaggattttcatagaagtctaaatctttaatcactcaactttggtactattattttacttcctaagtgcaaggaggctattaagattcaacaatataggcctatttgcttacttaatgccaattttaaaatttttactaaagttgctacaaatacaatttctggagtagctcagaaagttattagtcctacataaataccatttatacctgggagaaacattacgaaaggggttgttatcctccatgaaacagttcatgaattacatcagaaaaaaaatgaatggtaagtttttaagattgattttgagaaagcctatgataaagtggaatggtcttcctggtcaaaaaaaaaaaagtggaatggtcttatgttcaacaaactttgagaatgatgggttttttgcaaaaatggtgtgattggattgcttctttcattcaagggggtcatattggtattaaagtaaataatcaagtgggggcaatttttcaaactcttgtacatttggtggatgattgtttatctattttacaatatactgatggtactattatttttcatgagcatgatttagagaaagcgaagaatatgaagttgttactaactgcttttgaaaaattatctggcctaaatataaattttcacaagagtgaattattttgctttggtcagttaaaagaatgttatgagcactattcaaatattttcggatgtaaaataggagagtttcatgttagatatcttggtatcgctatgcattataaaatgcttagtaataattattggttaacaattgagcaaagaattgagaacaaaaacaaacgagttggaaaggtaaacatatgtctgttggacagagatttgttttgattaattttgtgttatcaagtttagttatgtttatgatatctaagtctaagaggttcttcaacaaattaattttgatagatcccgcttcttttggcacggtgatgagcataaaaaaaagaaatatagactgactagatcggacattataagtcagccaaaagatcagggtggacttggtatcaatatttagaaatccaaaaccagtgtttattgagcaaatgattgtttaaattaataaatgaacaaggtgtgtggcaagacttgttgaataggaaatatcttagtagtaaatcaataatctaggtcgaaagaaaacaaggggattcccattttttgtctggtcttatgaaggttaagagtttatttctaagtatggattcctggataattaataatcgtgagcaagtcagattctgggaggataagtggttagggaatttttctttaaatgacaaatacccgtcgttgtattctatagttagaaggaaaagttcttcaattgcaagtgcgctatgcgttctgttccgctcaatgttttcttcatgagagctttagttgatcagaatttggtcaactggcataatttgtgtgcttcaattgtgcatattaattgaacagtggaggatgatatatttagattgaactttcatcaaaatagtcattttttttgttagatcaatgtatttagccataattaataatgggtatatagagaggaataagatcatttggaagcttacgatgcccttaagattaaaatttttatatggtatttccttaaaggaattgtgttaacaaatgataattcggcaaagaggaattagaatggtagtttgagatgttttttttatgaaaaatgaaaaaatttaccatcttttcctatattgtcatttttctagatttctttggagatcaattcaattatcatttggttatacccaccacatagtgtttctcatatgtttgggaattggctggtgggtgttaataaaaagttaagaaacctattcctgtaggtgcttccaccgtatgttgggttctttggtttattagaaatgatatagtttttgataaaactccatcaaaatcttatttgcagttacttttcaaggcaacaaattagcttcgggtatgaactcatctacaacggcatgatgatgatatcaagctaataaatgatgcaagtcaaaacttgagtcaatgattatgcacctttttgccaacttcgaatggagattctcgaatagaattcagtaattcagcgttcttttatcttgtgttggtgtcttttagtttatgttttctttatatcatgtcagtgtgttttgaatttgtttatgtgtggactgtgtaatcattagctttagctcgttgaccaaatgacggaatgttattccattatttaaagaaatggtgcatggagtatattgagcccaaagagtaagttttgacgggtacagtaggaaaacacacaaatgcacaaaaagggacggcaccatatgtaccggaaaatccaaaactaacatatataatgcttttccagtctgaacgcgcgtcgacgaagcaccatttgggaaaacgacacctacgtgaggacataggtgctggaaaaactgacacctataagtttgtcatgttatatatgcattttaaaataaagtgtcacatataataaatttaggtgttgtttttttaaaaaaaaacaaaacatatatagatgaacagaccaagccaagctactcattgggctcatccttatctcctcctcctcctcctcctcctcctccctctcgagacttcttctactctctatctgtatgtgtgtgtgtgtctctctctctagctcgcgcatcggtgctcgaccctcaacagcgctcgctcctcagccaccttttattcaacggaagcccccctctctaaacattccttccacctgctagatgcggcagtggctggcgaagatggtgtctcagcagaagaagggaggtgcgatgacggaggaggtggctacagctaccggcgtggtggtgggagaccgccggatctagcagcctggaggtcgagggccaccagatctagatgactccgaccttcatggtgatggtttgggaggtatgatggtgttggcgggttggagctgcgacaccatcagcggctggcggatgcgcatcttcccctccctcattcaattcttgtgattattgatgtttattcatgttatctagggtcttcatcttgaggatctggatgtgttgtttgtttggagtttattgattgtagttaatgtgttcatggatttggggcattattttgggtgatttgaggcatcatttgggatccggggtatttcaaggatatgcaaccttgatgtatcagcttgaatgcaccgagccgatttttttaagctcgtgtgcacctcaaaggtgtcatttgtgaaactggcaccaataaccagggttcatcagcgccgcatcggtcatgcgttttctataatagtgagagtcttttgtctataaatgaatgcacattttaactttcttaaaaaaaaggtgaagtacacagtctctaaagttgtacggtgtgtcatggcatgttacacttactacaatacatagtaggtgccaccatggtacgctacgtccacgcacaaagcgagttggggcctgtttgaacctgtataatattcagaataataagtttgaggattcgaaaaatacattttgagattatatggacgacacaatacaagcttaattgatccaataagagtacctaatttcccggaaaaaaaacaataagagtacctaattatcatagtttcacatttaatttttgtgctgttcgttacaagggaacatcatatattatattgttcattcataacgtatcctggttctaataatatcataaccccaaagagaaaaaaaatgatacgagaaggacctgatcagcaatatttttttctgtattttcgtaatgctaagttcctttccataaaaaaaatctctaaaccatgttcggctaatccccgtgagagagggattagagaggattattttcatgcctaaataggtataaaatcatttctctctaaatccttctcaatcatcttttggatggtattaaccgaacaaggcctaaggagttttatggatttttctgaatgtttattaacttagtgtgaaccaacgaataggcctgagcaattgcattacatattgctaagtacaaaaataattaaatttgagattgtacaaatatattgtacactgtaacgtatacaaatacgtactgtataattgcataagcaaagcaacatgcacatttgtagagaccacaagctagatatataggccaacagtagcagatccagaaaatcgattcattggtgtcataacgtgtctatcggtgtcatagtatgctaattatgcttagaatatgatgctataatatatgaataagtagttttgctataggttttaccgaaagtcatcggtgtcgcctgacaccgatgactatactgtagatccgcccctgtaggccaatataatccgaacgaagtaaaatatggagctattcaattcgagtacaagacgaaccctgaatcatcacacgctgagcacgcacctatacatagatttggcttcagagttcagacgattcagtaacacacactagaatgcaaaaatctgcataaacgctcacgaaacgttgctacattagtactatagtactaccggcatcggtagatcttcaagcaacccctctgcggcaagttggacctccctggcacgcacgaccgagcgcacacgggctgattcggaatgaagcctttgtaggtgaggccgttcggcgccgccgcggccatgctgccggccgtgagcacggccgccattgccaccaccaccgccaccgccacgccgaagacaaagcggatggcaacgcggaagcggccaatctgccgctccggcgccattgatggatatcaaaccggtcattctggtgcagactagatgtctagattcttggttatttatgcgatgatgggcagcggttggtgggaagagggtggccaacagtattgctatggtatgtacatgcttatcatttacttcctccgtcctgtaaaagccaatataatattggatgtgacgtattttagtactataaaatggatatatatatgtctagatttattgtatcagaacgtgtcatatataattttagattcgtttttttagacagagggagtgctggtcactgagttcatggaagcttgcgttgctacgtacgagagggtgttcagggtgcgtagcgcaatgtttgccatcatcccaatcatgttgtacggctagttgactagttttgttttgccttatgtttggtgcttgcaggagacaagagaggccctcgtgatcaacagtacacaacttgacagcttggctcggctgctttggtcggtgagctgctgagatatgtgggtttacatcgtccggttggaaatatttgatggttgtgataacatttggctaaagtcttcaaatatttgatggttgtgataacatttggctaaagtcttctagaccatcaataattttgcaaacgtctagtaaaaaagatacggtatggatatatatgttccaaagaatactattaattataatgttatagcataataattgatgttttgaatattcgaccaaatcgtgtgaaatggactcctcttggcattagtagaagtaacgttaagagttccgaagctagatcgcattgatatggtgtatcataatgcatgcatgatatgtgctgttgggaaattttgacctagccagtagcatataaacagggccagcccaggggggtcgagcggtacgaccgctttggccccccaaatcgcaggggccctcacccaacaccaccccccctccccccgcccccgccccacccaggcctagcatcaaggcgaacagacgcgccgtgcgcagaagccggaagcggaaggcgaacaaaatgcgatcccgcgattgccgccgctcttctaatcttttcctcctcacggcaccaaaatcgcgcggcgcaatggcgcaaggccacgcatcggcgcgccggtggccggcttcccctttttcttccgctgctccgtacgacggtcgacggcagtagggtacgaggtgcagtgcagctgtgactccgtgagcgcctggcggatgcagccgctgccgcctgccacctcttgaatcttgattcaggtattactattagctaggatcctatgtgcctgtgcatttacatggtagcagctggattagcttcgtctggttcagttatgtatagtcgtcagattaaagaatttgctatacaagctttggctgttaaccgatcgtcaaataaaaaattgaaatttactattgtgatttttatctattaatatgtaaataagcatttattgatgtatagtcgtatgttaggtttattcagttgttccaatagttagacatgacgaagacactagtgtgtatttctgactcacttgcggtgtgcatctagacgcttgtgatcaactaattggtacgattttaaattttgatttgtaattttgatttgtaattttgttatgtaatttatatgagttaaactactatattttttttgaattatcaggccatgtcgtcgagaaagtatgcaacgggtagtgagagaaaagggaaaaaaagaaaagggtggatgatatgatagaatcgcagaagaaacttttaaggtaacatgtgcattattgtctatttaaatattatttctaaatattgggggggcgccacccaaaaaaaaaattttttttttttttttaaaaaaaaaaaaattttggggtttttttaaattaaaggttatttaaatttcaagtatatgtaactattgataatagtatggtaagggtctctaaatttagtttcccaccaggaccctaaaaagtcaggaccggccctgcatgtaaaccaggagatcacatatggtcgttctcacccattacatgtgggatccacatatcagtttccataattacaaattacatgtattggtcggtataaccaacgccttccaatacaggtggtgtcgctctgtcatcatcttctcctcgagacactaaaccgatatagcatatatctctggactactaaattggtggttttgtatggtggtcatgttgactatttgacttgatgttcattccttgtgacgtctacatgacaattaggtgatattagaagaaaactaaaacatagaaaactcaaatggacctgcatatcaatcggtaaaaagaattgaaaacgtgggctcatatattagtctgccctcaagtgtgctcgcttgcgctgcatgcctctcccgccggcgttggcgtcgatgtccctgcggccagccacagcggttccagtggttcacgcggagttcctccactcgctcatcgcctccaagggctgcgcacttgcgcacccatcgttatccgcctcactcaccctctctcgttgtgttttgctcgatcgtacgggggttcatggcgatcgctcgagtgttggattgagccagacggggatcgagtcagtcggtggtcatggaggaatgcacgccgcattacttggcacgtggtggggttcacgtgagccacacactgagtgcacccacaagggctgactgcactgtagagaggatgacccttgtcaccaccgtcatgtacgaggctgctccaccactgcctcactcgccaccagcgtctcccgccgcgtgcaatacaagaagaaacatcgaacggtcatataaggtaagacccactaccgatttaacctatccttcccacaatctaatccactcatttctcctcccacgatcttattctctcatttctcctcactatttttgcatttgtaggaaacacaatgacaccgtcgaagaaagctggtggagcaccgtagccagcaatcaccaaaacacagaggggaggaggtcggcagcggccatgcggacggcgacgagacaacgtgacgcaaagagggaggaggacgttggcgatcatgctggtgttggcggaggaggtcactggccacgcggatgacagcggggcagcgcaacacaaaaaggggggaggatgccggcgaccacgctagtgaccatgaagcaagatgatgtgaaagggaggaccggacgagggttggacctctgctgccgacatgaagagcgtgatgtgtagaaggagatgttagaccagatgccgacgcaactagccctggcaaggtcacccgactgatatcgctgcttgcccttgtcctcatgtacacaatcagcttgcttatctctcccatactggtcgtttgtttcccgtggccgaaatagaagaagacagaggtaggttttgttagagaattttagtggtattgtagcctatttgtaattttgttgtactttattgtattaatcaataaaggtgtttcattctattttgactcaatgttgaatccattgatctcttggtgttgcactcagtatgttagaatattacattccgttgaaacaatcttggttaagggttggaacatttttatctgttcgtgaaacatccgtaatattttcgttgaaacaatttttatcgacagcaccgtccaacaatttacaccaatttggacgtgtgatacatagcagtccccaagtgaaactgaccaccagttgaaaggtatacaaagtgaacttattcatctaaaagaccgcagagatgggccgtgggccgtggcctgcgaaacgcagcgttcaggcccatgagcatttattttttaaaaaaatatttcacaacaaaaaagagaacggataaaatccatcgaaaaaaaaaactttcctacgcatcctctcctatctccatccacggcgagcactcatccaaaccgtccatccacgcgcacagtacacacacatagttatcgtctctccccccgatgagtcaccacccgtgtcttcgagaaacgcctcgcccgacaccgtacgtggcgccaccgccgcgcctgccgcctggacacgtccggctcctctccacgccgcgctggccaccgtccaccggctcccgcacacgtctccctgtctccctccacccatgccgtggcaatcgagctcatctcctcgcctcctccggcttataaatggcggccaccaccttcacctgcttgcacaccacagcaagagctaagtgagctagccactgatcagaagaacacctcgatctccgagagttttttttcagctttagcttaagcaggatggagcaccaggggcagcacggccacgtgaccagccgcgtcgacgagtacggcaacccggtcggcaccggcgccggacacggccagatgggcaccgccggcatggggacgcacggcaccaccggcggcatgggaacgcacggcaccaccggcggcatggggacgcacggcaccaccggcaccggcggcggccagttccagccgatgagggaggagcacaagaccggcggcgtcctgcaacgctccggcagctccagctcaagctcggtacaaacattttgcccccaattctttacccccccagtaaaaccttgcgtacaaattcgttgaaaaattttaatgtctttgtgacagtctgaggatgatggaatgggagggaggaggaagaaggggatcaaggagaagatcaaggagaagctccccggcggcaacaagggcgagcagcagcatgccatgggcggcaccggcggcgcctacgggcagcagggccacggcaccgggatgaccaccggcaccaccggcgcacacggcaccaccaccaccgacaccggcgagaagaagggcatcatggacaagatcaaggagaagctgcccggccagcactgagctcgacacaccaccacaccatgtgtctgcgccgccggcgacggccgccacgtcaccttcctgaataataagatgagctagccgagcgcaataaaaggaaaaaaaaaatgttactgtcgtgtgatgagtgtgaatgtgtgatggcgttctccagtacggaccgtgtctgcgtgttgtttgtactgtgaaagtacgctgtgtatgtacgtcgtatgtgtacaattccgctttgttgaaatacgtataaatatatactgtgtgtacattatacggtgtatatctcatcgtgcatatgtacacaacgttttggtgatcgttataatgttcatttttttccttattctgatcaatctggatcataggctcgagaaattgctatagatcaacggccggaaattgcagaacaagaaagtgatcctattgagtattagaaatgattgatcgttactaccttataagaagggccccggacttttgttctcgaataagtaaaaaaaaaacgaaatgattgcgcgtcatcccgatagaagggcaaatactccgtaattgtcctcgccgtaaccttaaaaaaaggcactcactgtggaatgaatgtacaaaattagtttattatagcatccaaagtttcgagtcttccccggtcggctatctttcctaaaaaatcataacttgcatatgcatttaaaacaaaatcaatctgttcaaattgaagacatgaattcaggtaagcatgtttaaccataaaaggatattgcatcgcgcgttgagcacaggtacgatcggtctatccctttctatatttgatgagtaattttacccttttctaaggaggtaccactttttcctttttttatacctctcgatatatatttaataaggaggtaccattttttctattataaatttgatatctcttaatatattaatatatatttgatgttctattataaatttgatatctctcgatatatatttaataaggaggtaccattttttctattataaatttgatacctcttaatatattaatatatatttgatgagtaattttaccgttacgaggaggtaccaaattttttattactagaaaaaatatccattgtaacgggtgaagcctattttatcttattattgttatttggtttagaaaaaaatatccattgtaactggtgaagtatattttatcttattattgttatatggtttattattattatatggtttagttaagatgcgatttactgtagcagttcgcttgggatatatttttagaaaatcatgagctacagttaagagtccgatcatctcaaattagcatacgagtttttttaaacatatttcttatatgatttcttatgtattatcaaagtgaatgctcttaaaaaccgactcaaatatggagatatatttccaaaagcaaatgaacttaaaaactgacttatacacggatgacgtaccaaaataccggcaaaagcatcttcaatttttatatttatagtagtagagatagagaagagatatagattaccgactcaaatacgaatatgtatttccaaatggaaacgaacttaaaaaccgactcatacacggatgacgtatcaaaataccagcaaaaacatttttaatttttataatagtagagaagagatatagactaaaacaaaaacataaaattaaaaccaactcaaatatggatgacgaatcacagaaacatctttaatttttataatcgactcaaacatagatgacggactgcataaacattttcaatttttataatagtagagataaatttgatacccctcggtaccgagattttatgaggtatcaaattttggtatctcatgttaccaatggtacctcttcacgctagaattgctcattttttattggtttttgctagacttgatccgtttcccgttttgtagattttgtcgttttgttaccatcatgcacatatgtggtcctagactagagagtgtaaaggaacggcctaatatcttttctcttttttttatttttatgacatttttctaatctggtttaaaaattttatgcatagagtttctatacctaataatttctatttaagaactagggtagccctcgtattcgtgtaggcatgcatattagtttgtcttgtaaataggtttaacaaaataaatccaaattaaatgaggcatttttcctttttaactgaatgttttctcttgtaaataggcttaacaaaaataaatccaaattaaatgaggcatttttcgtttttaactgaatgttcatcgtcactcttttttaaatctcttcgagaaacttttattgctattcctctctttaattgattaatgcatggatgtgaattaataaaaatagcaaagttctttaaaattatattttttttattttgaatttagtgagtgagtgattttaatttcattttttttatttttttataaatttattttgtgggatttcaaaattgtattgtgttgtgttgtatttttgttcttcttttaaaacttattttattatttcgaatttcaaatatttatatatattctacatggactcttattatatttttatttacaattttagtgaagattttattttatcttttaatgcttcttttaatttttttctgaaattaattacaaattcctcgtagtagatctaccatcgttgtttacctccgaaattttagatagtaaatagctcagcgctgaattgaatggcgttgactccttctgacctggccaatttttgctagctcggatgaaatatcagcgttaatatgtatggcgctaaaacgttacacctctgagtcaacggcctatttttataataagtttttggcatggtctattcttaaaataagttttctcaaagggtcaatttgtcaaaattacggtattcatctcacagataatctcgctgacatcctcatcgctgagcctctttcaatgcattggctatgatgtgatgaagcatagcacggagataaagtcgtcttctggtctttgtcgaacacgctgaacgcctccatcgaggagtccttgtccttttatctaatcatcgaatgcgccattagggccacaaactctgatggaaatcgatgttgccactgtcgtcggtgtccaccttgttgatcatgtcctgcagcctcgcctccgccggattctggccgtggcagagctcgacaatggagatgaagccggcttctggtttttgttgaagacatggaaccattcctgcagctcttcctcggagtccttggccatctaatcatcttgaatgctattaggctcaggaactctcctagaagccgatgttgccggcatccgcttccactttgctaatcgtccagatctgcctccgtcgggttctatcctagagtacctaacatggtttcgaggtctttgctggtggtagaacctggactatggactcaaatatttaaattcggctattgcttttaaaatacaaattttgttctcaaatttattacagtgtcacgtgtagcttaggagcgtttgcaggattttatgtcttaaattgttgagctaattataaataaaataatggtccatacatgcatattcataattgaatatacaacttaaaacatatgggacttaatttaaatggagggcactacgcgtcgggcgcccgatcttgggtgggaaaaatcggacgctcacgtcagctgacgtcagcacgcatgcatgcatgcatgcaaaactattttaactattttttcttttaaattattttaaccaaattataatccgattgcaccattaaattcgttgcaattaaatctttaaaacaagactgcacatggatatattccgatgaaaatttttttagcttattattgaattatttttaaatatttcacgttgtttcaccaagtatatcagaattgtttcactaagtagatcgaaaatgtttcaatcgtttaaatcgaccgttgtttcaccttatataaaaacaatgttttagcaaatagcgaaaaaatgcttgaattcactacaacatttaatctatatatatttaaacatcacgagtacactaggtgaaacatttttggtgcaacaaaggatgaaacagattttcttaatagagggtttccataatatgtgtgtgatttgttgaaaaaaaagtttcaattcactgcaacattttattcatacatagtgaaacattatgagtgcactaggtgaaacatttttagtgaaacaaaaaataaaacgaattcccttaatagagtgtttccaaaatatgtgggtgatttgttgcaatggagtatgtggtggagacacgtggcagggggtaggggcactggtggggcccaggaggcagagcccgtcgcggggggagggagcgcccaatttttctccctcccccgagcgaccgacgcaaaggattattgaatttaaattttgattgtttctttgtttgagtttatcctagaaaattagaaggaaaagagaggcagaggccggtacgtatgtgtgttcaattcttcatcgcacggggattgatgtgcctgataggatggggtactttgggttactttgagtttctatttaaatagatttaatctaatagtataaaattataggaccatttatttaactgaaaatcaatgattatatcaataacctttttgcttcttgtaacttataggacttgctctaatttattagtgtgccaaatgacggcttaagagcgtttaaataaagtttaataaactttgtataataaatataatatatgattgttaatagacttaacgttttgttttttctaatattttttctatagaaaattatttaaaaaattcatactgatctatttttatatgttaactaatacataattaattatatgctaatctatctcatcgatttacgtgccatgtgccagaagatatacgtttctaacttatggtctgtttagttcgcgaaatgaaaattttttagctatcacatcggatgtttgatcggatgtcagaagagattttcggacacgaataaaaaatcgcctgaaaaccacgggacgaatctttttagcctaattaattcgtcattagtacatgtgggttactgtagcacttatagctaatcatgaacgaattaggctcaaaagattcttctcgcgatttctcttctaactgtgcaattagtttttttaatttaagtatgtatttaatgttctatgtattaaagatttgtgcaatggttttgagaaaaaaattttgggaactttaaacctggcctcagtcatacctcaaaacacatccttgtcgacgagtcgtcgtccttccccgatgcggcgatagtccaccgggcatccgtgaactccgtatcatcacgatcgctcgttcccccaccggccacaacagatatcgaacacgtgcatgtcttcttatccatctctatccatctgcatggatatgatggtatgcatgcagcacgcgcggtcatctcccccacacagataacaaagtgtccagaagaacccaacggaaacacagtacgtggcagcaggttgccgcgtggcaccaccgacacaacgcgctactgcaggcagctcgtacacgtccctcctccgcctttattccctcgatattgccagctccgcctcccggctcacccatgcgtcacacgtacccccatcttccacggcctccttcctgatgaccaaattaagcttccatttttttttaactccagtagagagatcacacgtacacaacccacagtctcgccgcggtataaatggcagggcaccccggccagctgctttgctgcatcgatcgacggctttgacacaagtcatcttactgatagcaacaacactagctggaacacttgggtacacgagttcagggatctagccagagctaattaagcggagagttattagcttttaatttgcttgagaggatggacaactaccaggggcagcacggctacggcgccgaccgcgtcgacgtgtacggcaacccggtcggcgccggccagtacggcggcggcgccaccgcgcccggcggaggccacggagcgatggggatgggaggtcatgccggcgccggcgccggcggccagttccagccggcgagggaggaccacaagaccggcggcatcctccaccgctccggcagctcaagctccagctcggtacgttcactgtcgtccattcataaatctaattaatcgcctcgcttctgaattcctttatttaatttgagttgtactcgtgtgcgtttgtgcagtcgtctgaggacgacgggatgggagggaggaggaagaagggaatcaaggagaagatcaaggagaagctgcccggcggcaacaagggcaacaaccaccagcagcagcagatgatggggaacactggcggcgcgtacgggcagcagggccacgccgggatgaccggcgccggcaccggcgtgcacggtgcggagtacggcaacgccggcgagaagaagggattcatggacaagatcaaggagaagctgcccggccagcactaaattaataagcttatataattgacagccggggcaacacgtcgtcatgtgtgtagtagtatctatcgttttaatctgcggaataaatgacgtgcactgcagtgtatagcgtcctcgaagagaatagtactactgtttgggcgttcgcacgtgttgggttgtacctatagcttgtgatgccattgcaagctttgtatggtgtgtgtgtacacaggtttttagtgaagtgtgtgactttgttttggaattttcatgtgaatttcgtaatattctacggtacgccatgcttcgagtcatcctttttgattggaactcccatgtgtaagtgtttcttgattataagattaatttggagcctatcactgtgctctctactactcttttctggtagtagaaattaagcaaaatgaactgtcgatttcgtctgattagatcatttgtactatctcttatactaacccaattagcaataacatgggtattattggaaaaggaaagtagtagaaatatggagggtattattgaaaaaagaaaatacgaaagggtataatcgctatttcgttatttatgtagtaactaaacctttttccctctctttttgcttttccgatgattttgcgatgaaatatgagtgatgctaaccatcatagaatcatagtgccaacacatctaccatagtttacacgaagctaaatctgtcgggagatctcgtcgatccctctcgataaggatctcgtcggtatcgcggctttatatgttctctttgtactctcatataaactggattagtgctattaccttacgtgggatctgaaccaatataatatctatttttctcggttttgatgtcgtatcgtgtagatcctcgtatcaacgtatctcaatacttttttatccggtctacggctatcccccgtcgacaagtaaataacaccagaccattgtactaatagcaccagaacatcgctctaagatttcttaacattctggatagaagttttcatatttttcacacattgattataattattgaatgtattcttattgtttcactatttttttaagggttgtatttggtattattcggttttaagtagtatctactttttatgtaaatattgcatggtatttttatgagctttatatttgttatgttttagtgattactatttgtttcgatttttacggagagaggtaaagagaatggaaggatgcatgtagctcagtcaagagcacgcatgatataattactgcttgttgtatttgggtatatccagttttaagtagtatgtagttcgtatgtacatattgcatgatatttttatgatctttatatttgttatgttttacggagaaagggaggtggagagaatggaagggtgcatataggtaatataagggcacgcatgatacaatagctgcttgcgaacgcagcagcgtacgtgtccaaccgtagtcatatctcgttttacaagaccatttctaccatatcatggttgatccgtatattttaatcaagatgttatttagatcaatcgaacttataaatcgcacagttaggttctaaatatatccatgatcctgatttaatgtgtcacatgtagtctaactcgtctttgatagatctaaggaccacgtgcacgtcttcacagtagtaaactcgtttgcatttaacccctccaaagctcacaatggcgaaaaaaattactcttagccccattgctctattttttttcagggagggtgtgaattttactggctaaatagagtgattacaatcccgtgggacaagatcatgaatacaagttggagcatcaagtcttcacaccgcattatgtctagtccttctggctaaccgagctagttcatgaggcactctattatcccatcttccaacatgatttagacagatcttaggaagtaaaccaacaaaactcttcgctttcaccaacaaggcacaccatctcgatttattttgcccaaggggcatgagtttaatcacttctgtgcaatcggtttcaaggacccacatgcacgtctccgcagtagtaaactcgtttgtatttaaccccttcaagttcacagtggcgaaaaaattacacttagccgctatgctctcaattcttgccaagccaacttctctctactctactctctctctctctctatcttttcctctattgaattagggagggaaagcgatagcaacgtaaaatccggtggggggggtagagagagggcacaaagagcaatgaagaggagggaggcgggcataatgggaaaaaaattctatccggcagtgccgcaccaagcctctcgtgcggcaccgcgcgaactagcgatgcgtgtccagctatcgcccgcgcgagccgcgtctattgcgatttcgttggagccgagccgatgcctatcgcgacgagtccaagccgcaagcccgcaccttgaagtcgaatcgtcgctctcatctgccgcttcgtgcgcccaccgcttgtttcatcagagcgacctatgatcttccttctttcttgttcataacaattgatcgatctagtgtgtttccttgcctgctgcaccgacgatcgagccatgtttgccgtctctgcttgacgattccgctcagagcatggacgaccctgccgtgcagccggccataggcggcaggacctcgtcgcatcccgtgctacgatcaaccctaacaccggagtcagatggcatcgtcgaaatctcaatgttggagccgtgttctgctgatgcaattgcccttcctttatcctcaattcctaccatcgagccaatggaagatgcttcaatgggttcagcagagccgatggaagatgcttcgataggttcagcaaccacaatagctccaacagaggtaaatagctccgaacaaactttcttgttcacaacaatctgatatattatcggtatatgtaattcgttcaaaattttcttattatactgttggtggataacatgaatggtcaatctgtaatagtacctcaagttggaatgtctttcaaatcagaaaatgatgcgtatgatatgtacaactcatatgccaggaaaattggttttagtattagaaagagcaccacaagattgagaccagtcaagactatataccagaagcatatagtttgcagtaaccaaggagaacgaggaaagcactcatcacatgtcacttcaaaagaaaatgctactacaaggacgtgttgcaatgctcgtgttcaattcagtataagtcgtgagggaatttggacagtgcaaaaggttgtcctcgagcacaatcactatcttgctagtccaaataagaaacacatgttgaggtcccaacgtgatagaggcggataaacttctaatcagtcaaatacgagaagctggaatacaaccagcccaagtgtatgagtttttcaagcaatggtatggaggagctgagaatgttccattctcgcggatggattgcaataatttgattggccgtgagcagaagaagtacttgccatccaatgatgcacaaacgctactggagtatttgaaaaacaagcagttagaggatcctactttttttatgccatacaagtagatcaggaggatggtcggatagctaatttcttttgggcagatggtcaagctatcatggattatgcatgctttggtgatgctatgtcatttgacaccacatttcagactaaaaagtttgaaatgccttttgctcccctccttggaaccaaccatcataagcagacaattatttttggggctgcactgttgtatagtgaaatgattgaatcatttgtttggcttttcaacacatttctaacagcaatgtcaggcaagcatcctagcacaattttcacagatcaatgtgctgccatggcagcagcagtaaggatagtatttcgaaacacaaggcaccgtctttgtatatggcacatttatcagaatgctgctaaacatcttagtcatgtaattgctgaccatcctcaatttcttgctgattttaagagttgtgtttacgaagaaaggtctgaggcatacttcgacaagaaatggaatgagttgttgagtagttataagcttgaggagaactcatggttgtagaacctatataagttgcgggttcattgggctgctgtctttcgtgattcttttactgctgatatgacctctactcaaaggagtgaaggtatgaacaatgttttcaagaaaaggtttcgtagaaagctttccctatctaaactcctagaagaatgcgacaagtgtgcaatgagtcttcgtgataatgagttggatgcagactacaaatcacgacactctacccctgtcacttatattcgagatttaccaatgctgaagactgcagctgagttgtatacaagaaggctttattcagaatttgaggaacactttaaagagcagttttctttctcatgtaaattcctgaaatctgaagggtcaatcatgacttataaggtgatgcctatggaattccaggaacaaaacaataacatgttcttgtcacatgtatgaatgcattggtatgtacaagcatttttcaattgcactatagttcacaatatattttgcttaaagtatttctacatgtttgacaggtatattgtgcaagcatgctctccgagtctttaatatcaatgaggttttcatctttccgaatctttaatatcaatgaggttttcatcttgccaactcagtatgtactaaatagatggacaaaatatgcaaaaagaggtttttattttgagaagaaacaaataagtgacaatgaaactttgagaacgcatgcagcgcgcatctctcggaaggcgacatctgttgcacagtatcaaaaagaacttcttgatgatatggaaaaagctatagacaagttggacctagaagcagataattcactgagcaaaatacacaccaaaacttatgaggtttctgaaagttctaatggatgtgttggagacatattaaaaggtaaagtatcaatcagagttcctcaggtcataaaaggtccaaagaataaaagatcaaaaactgtacttctaaagaagaaagggaagaaaggaaatgctgctaagaaaaaaggtagtgcttctcacttaaaaatatttttttacatctctcttgttagctagtaatattgattcccttttatatttgtaatctaaaggagaagatccaaagaaatcaacagacaatggagaaatgattcaagatccagatgaattgattgtaagattaatgatctggctttccttccaataattcatttagctgcacttggcctgaataatttcatttttttattagggctcttttgatgcaaacattgatgataatatgcatgaagatttttcaactatggttgctcctccgatccatggagaatatacaagtcttttgtttggactagatcaagatgccatggctgctcggaagttacattttgattaaataggaaattatggaacatgtaaggtgtagtcgtgctttggcaattatttattgacatgagactgtagttttgctgtgccagcagcctagaccttctttgtctctgcatctggatacccttttagcagcctgctgagagccttggtgctccttgtgattggtttgaaagctggaattctggaaaccccagcagtttgtattttccttttcccttttgtttctttaagtactgtatgaactcttatgctttcaagtaaaagctggaaggggtaaccgtcttttgtctaaaaaaacaagactgtagtttgccattccactgttttggaggtttataataagatgttgggctttattttgtggagatttcctatgttttggagatttataaccagatggatgcaaatcttgatgaaatctggaaatatgtattcatatgagatcactgtatccaatctgataagtagaaattacaatgtgctcattgacaactgtttacaacaccatatattcacagcatgcaagaccatttggtccagatttcagaagaaaaagacaaccaaaacaatgcccttcaggagtagtacaaggctataagctaatttagctatattggccatatgcacttcaagttccttatctgcagtggacactggacagactatcagagtctccagctcctcctttggcgctgctaccttccatttctcttttcctggagagataacagatgtgtagtaagtcactgttcgcagtaatattcagcaaattagcactgcaattttgaagagctttagtgaaacaacaaatattcagaaatagctccatctcccaagtggacaaaatatttgcagaaggttcagatagtgagtaatatgattatgtcgacagaaaacttctacaatttccagttgtgctagattattaagaaacactaattttacatccttcatgaacaccaatccgtacatgagagaaaactacgctaatgcatttaatcattccaaattttcaatcaagcaattagaatcgaattgcatattttcaaaaaacataccttcttgctggcctgcagctgctactgctccctgtagacctgctcactcctgcggcgctgctgctgctcggctgctcctgctcacgcgcagcgagctcccgcgccgccgccggactcctgctgcactgctgctccggctcacgtgctcccgcggcgccacgctgccaccggcctgctgctcgcggctcgcgcggccgctctgacgctccgttgtccgcctgcctgtcggctgccgcctcgcggccttgcgccaacgcgccgtcgcccgctgtaggggggactcaactccgaggagcagcagggcccttatagtgcgccgccaccgtttcagaagcaacagcagcagccgccgccggccgttgccatagcagatgagagcgacgattcgacttcaaggtgcgggcctgcggcttggactcggcgcgataggcgtcggctcggctccaacgaaatcgcgatagaccggcttgcgcgggcggcagctggacacgcgtcaccagctcgcgcggtgccgcacgagaggcttggtacggcactgccgcatagatttttttccggcataatgtggtgtcctaatttttataatcaccatcaaagcttgtagtagtaggctggaaacacctatagtatgggtgtcattactttaataattattattatgatcactgttctagagagtcgaagtaatgtaatcgatttgggagtaccgtatgtaagaaactaattaaatacagatttgttaccatggtgggttaggtaggggcagaatataaacgctttataagatgttcttttgattttgataaggttaaaatttgaagattttaaccatggatcagtacacatccaaatataatttacaaatagaaatttataagagttatagacataactttatattccccgtaattattgatttcataccggtgacaatatattttaagccaaaataagggttacaaaaggtgaactgtgggagcatgtgccgttttctaattctagatagagcccgaggtaaacacatacgtggcggccggtggccgcatggcgtcaccgacccggcgcgctacacgcacacgtccttgctccgcctttattcccttctacgcaccagctccgcctcctggctcaccccatgcacgtacacgtacccccctcttccgtacccttcctgacctacacttcggtttttttatgtacttctccaacctccaagatcagtataaatggcacgtacgctacccttctgttcccctgcatcgatcacaagacacaagatttttcactgatagaatagcaacacttgggtgagagatcagacgcgtgtttgagaagatggagaactaccaggggcagcacggctacggcgccgaccgcgtcgacgtgtacggcaacccggtcgccggccagtacggcggcggcgccaccgctcccggcggaggccatggcgtgatgggaatgggagggcatcacgccggcgccggcgggcagttccagccggtgaaggaggagcacaagaccggcggcatcctccaccgctccggcagctcaagctccagctcggtacgttcactgtcgtccattcataaatctaattaatcgcctcgcttctgaattcctttatttaatttgagttgtactcgtgtgcgtttgtgcagtcgtctgaggacgacgggatgggagggaggaggaagaagggaatcaaggagaagatcaaggagaagctccccggcggcaacaagggcaacaaccagcagcagcagcagatgatggggaacaccggcggcgcgtacgggcagcaggggcacgccgggatgaccggcgccggcaccggcaccggcgtgcacggtgcggagtacggcaacaccggcgagaagaagggcttcatggacaagatcaaggaaaagcttcccggccagcactaaataagctcgaccgggtcgtcaccaaatatgtcgtgatgtacgtgcagttttatatgttgttgaataaactagcgtgaaatgcgagtgatggtgtcttctgccttgggacggatgacacattgtctgttgtgttctcgcgtccgtgtcggttttacccttgaaatgtaatatggtgtgtgtacacactaaggttttattgaagtgtgactttgtgcttgtgttatttggccgtacgtctgtggtgcttgaaagtagtttttcttccattgaaatttctaagagtacttgactctacaacttttctttgaggggtacttaactgtacaactagagatgagtaatttggccgtttcctcgcagttagattcggccagtggcccgagttgattcgttaaggagggacagttaactttgagtgcaaacattcagggaagcggaaacatggagcgcttattcagagcattggattagagatgagaatgagaatgaaaaagggtgataatagaactggttgggagggatgctccagcaggcctcacaaatcgtacacgacaatgtgtattaaaccaaagcgtccaaattcaaataaaaacactatgctaagattttgttaatagtgtggtaaatgaaggcattcaggatagctcataacactgtgtagggtcggattgtaatcaaacaggagaaggtatctgagaaaccgcattttcaggtgccctgtttggatgcttggcctgtgtggcgcagccagagccccatgggcttctttagttgccgaaaaatcatgggcttctttagttgcccagaaattttcgcccctcatgttacatcgaatatacggattcacatttaaaacattaaatatagtctaataataaaataaattacagattttgtcagggaatacgtacggattcacatttaaaatattaaatgtagtgtaataataaaataaattacagatttcaccaggaaatacaagacgaatttattaaacctaattaattcatcattaataaatgtttaccgtagcattatattgttaaatcgtaacgcaattaggcttaaaagatccgtctcgtaattttcccgtgaactatgtaattggtttttttctacatttaaaacttcctacatacatgtgtccaaatttttaatgcgacatcgtcaaattttgtttggaaactgttgcgtgctgccgtagccacagctgcagaaccacctacgatctcctctctggaaaagcgactctagggtgaaaaagaacttctctccggccccttcatttgaatgtgcggtgacattcaggtcgctgccttgagttgaggcggttcggcttcttctcgctgttttagttccaacttttttcttcaaactttcaactttttcatcgcatcaaaatttttctttttttgataatgtaaatgtgttatatctccagcctctgcccgtaggcacacagccaaaaaattcagacgtgaacagaaaagttaaaaaaggcgagatgggacaaactcccaacttctgccgatgatatgatctactaaaataatattttttttcaaaatcacgtagattctattatgaaattctgtaggtactacgccatccaaaatggaataaaagttcattggctactaattccaagcgtgtagcaccattgcgcatagtatcctgttgttcctgtgaaagcatcatacaccaagagtggagccaattggaacacatgaagataatctgcatgatggtaggcatttttttatggttaaaaactatatcattacggcaacgccaaattgaccaacataaagcactagctccaaacaaaatcatttttttgtaggtctaggcactccccttagccagtcaccaaaaatatcttttgcattgtggggaggggggatgttgaaggcaaagaagacacatcgccaagcaaaacgtgcaacatgacagtcaaagaaaagatgttggatggtctcttgtgtgttacaaaaacaacattgcttgtttcccctccaatttctctttatgagattatcttttgtcaagattactttttttgaagaaaccacataaatactttgatttttagtagtacctttacctcccataagatcctcttgtggattcttatattggaattgatgatcgcattatacatggatttgaccgaaaaatggccatttttatgtagcgaccaaataaagcaatccttttcatttgacagggttatgttagctagtcgagagattagatcgttccactcaactaactttggtcctacaattgatcgtcagaatgaaacattcaacggtgttgtgctcataacctctgccaaagtagaatgtctttttcggaccacattgtacagaaaaggatattgatatttgagaggttgcaagcccaaccatgtgtcttcccaaaatcttatttccatcccattaccaggtttaaaacatccatactgaaaaaattgatcttttactttcattaggccagcccaaaattgggatgttcctggtttgtgtgacatgtgggagaggggtttaccccttaagtacttgttgcgcaaaaggttttgccataggccatcaccattaagaagcttgaatagccatttgctcaacaaacatctattcatgatatcaagatttaggacacccagtccaccttgatcttttggccagcatatataatcccattttgttaacctatatttctttttctagctatcactgctccagaaaaagctcgatcggtagtaatccagtctttgaagtacacctcgaggtatttcaaaaaaaagataacatgaacatgggaagactcgaaagaaccgagttaagaagaaccaatctcccaccataggagctgtttttgcccttccatgtgctaagttttctttgaaacctatcctccacacatttccaatcagaatttctaagttttcgatagtgtatggggattcctaagtatttgaatggaaaggaaccaaagttacaaccaaacagttgtctatattggtcctccatttccttggctcccccaaagaagaaaatttcacttttatgaaagtttattttcagccccgagagatgttcaaacacacaaagaatggctttcatgttttttgcttgttcaaaatcatgttcaagaaatattattgtattgtcggcatattggagaatggacaaaccatcatccactaagtgtggaattacccctctaatttggccatcgactttggctctttcaataagaatggctaacatatcagccactatgttaaaaagaattggggacattggatccccttgtctcaagcctttgcatgtccggaaatttttttctacattatcattgactttgacacttacagttcctccttcaacccagttggaaatccaattgcaccacgattgtgaaaaccctttcattcgtaatgtctgctgaaggaactgccatttaactttgtcataagccttttcaaagtcaattttgaatatgataccatccattttctttgtgtgtaactcatggatagtctcatgcaaaatcaccaccccttccatgatatttctatttggcaaaaacgctgtttgggttgggcgaatgactttgtgagcaaccgttgtaatcctattagtgccaacttttgtaaaaattttaaagctgacattcagtaggcaaataggcctatattgttgaattttgatttgcatcagccttttttggcagtagcacgatgatcctaaagtttaggttataaagggataatgtccctttatgaaattctctaaatagagccatgagatcattcttaacaatctcccaaaagacctgataaaactctgcaggaaagccatctggacctggggaggagttatgatccatttgaaaaattgcctttttgacttccttttctgaaaattcaatagtaaggatgtcattttccaagtcggacacttgaggaatatcatcagtccatccctctatcatggatacatgattatgatctggaggaccaaataatcctttataataattggtaatgtattctttgagattcccctcacccgttattatagtgtcctcttgttccaactggaaaatcatctgcttacaatgtttaccattggctatcaagtgataatatttagtattactatcccccttggagtaaatgatttgtcttagatcgctggtaccaatacaactcttcctcccttaacagttttgccaaatcatttttggcctgcttcaacgaagctaactctgtgttggagagagttatgtgttcggcttttttgtttagtgtgtcaattaaagctaaaagctttattttttgttttttatatgtgccacttaaacttcgcgcccaacctcttaaatgttgcctaaggtggacgatcttgtgtttccaacgttccataggattctttcccttgtttacgctttgccactctttggctaccatctcaaagaatccatcccgctctagccagcctaattcaaaacgaaatggcggctgattgccgaaatgtgcatgcgagccggatctcagtataattggagagtggtctgaaatggctcgaggtaaggcttgacacgtaactaaaggatatttttgctcccagtcagtgttcattaacactctatccaacttctcataagttggattttcgaggttattggcccaggtgaattgtctccccgaaagatcaatctctctcaaattgagactattgatgaccgcattaaaaagaaaaggccaacgagggtcaaaagaattattattcttttcttcgggtgatctaatgatattaaagtccccctaccaatagagggtatgactccttaccacaagtctgagctagttccgtcaaaaattgttcttttaactcgggttgagcaacaccatatactgccattaaaacccatttgaaaccatcctctttatttcttagaagaaacttcacatagaagtccccttctgaaatttcacctatatcaaaaacatttaaatttactcctaaaagtattcctcctgattgcttgataggaggtttctcatgccaaagaaaatcttttccaccacaaaggtttttaagatttgaagggggtgaatgatggttttctagtctcaagaatagcaataaaatccaaattttgctccttaacacattcagatataaatctaaatttagatgcatcaccaaagccacaactattccaaaatattcctttcatttcttaaacttattagctttcttttttgaccagtcaaaagaggacataccactttatgtttgattttggtcaaaatcttcctcatttgaggtatggcctgagatacataaatttttaactttttatttaatcattctaattttcaacaaaacttttaattttggttaaacacacccttaagttgattgtttctcgtggtcaagtctaatcatctatttttttcccattttttcctgggctggccggagtccggcaaccatgtcccggcgacggtgtagctgcgttgtggttgcacactgttgcatgttcaggacgcccatcgacgcagcgatttgagtggaggaagtaatcaaatttagccagaaaacttatcaaaaaccgatttataaaatttaggcattgtttagtttctaaattttttttcacaaaaatatcacattgaatctttagacatatgtatggagcactaaatatacataaaatgaaaaactaattgcacagtttgcatgaaaatcacgagacgaatcttttgagcctaattagaccatgattagccataagtgctacagtaacccacgtgtgctaacgacggattaattaggcttaataaattcgtcggtttctaggtaagttttgaaattagtttttttatacgtgttccttccaatatctgattaattatccgatatgacacacatgaactttcttttcgcgaaataaatggaggaagtacgtttctagtgtttccagaaaaagtactagtttgacttgtcaacatgaagtaagtatcaacgaaactagtggttgcaatgccgtcgacgcttagaaaaagtactactagacgcagaataaaggagggaacgtccggaaatccacgtcgcactcctggacacttgaatcagtggcaaccatcgtttctattattgtaatccagatcccacacactattaattactcgtacatcatattatctatccattacttccgttgtgtctcatcccttccagagaattcgcatgctgaccgtgtacgtacgtggcgccgcgctgatcgacatgcatcctctcgctgatcatgctcgatcagcattgtttagctttacgcccacctggatcacaatgtgccgtgctgtcctcgtctctgacatgatccggttgcaatattttatccctcgccggagcagcataaatacccagcaaaaccttgcagtaatcggaatccattcagtgccaatcaggtaatcagtgtgagagtcttttcaaagcgaaggagcaaattagcttttgtgttgtagatcgagcaggctaggtatagcgagaatggagtaccaggggcagcatggtggccacgccagcagccgcgccgacgagcacggcaaccctgcagtgaccaccggaaacgcacccaccgggatgggcgccggccacatccaggagccggcgagggaggacaagaagaccgacggcgtcctccgccgctccggcagctccagctccagctcatccgtacgtcgtcttcctcccaagtttattgtattttttcggtttgatttcagaactgttcggattgtagccacttttatccatttcaatatttgatagtgtcaaattttgacatattttggtactaccaaattttaataatcttggttgtatttagtttaatatcttaccaaaagataatagaattttaatttaagaatgaaaaattctaaaattaccaaagtttggcaggatagcattagcacgaaggtatttggtttagtgtctttccaaaatttaacaatgctaaaattttatatggttaaaattggtaataaagtgaacaaacctttcgtactcatggtctgaataatgaaacatatatactgccaattgctgaccaatttgcagtctgaggacgatgggatgggaggaaggaggaagaaggggatcaaggagaagatcaaggagaagctccccggcggcaacaagggcaacaaccagcagcagcagcaggagcacaccacaacaacgaccggcggcgcgtacgggccgcagggccacgataccaagatcgccaccggcgcacacggcggcaccgccgccaccaccgcggacgccggcggcgagaagaagggcatcgtggacaagatcaaggagaagctccccggccagcactgagctgctgcatgccatgtgtgtgatcggtgtttcgatccgacgatcgacttcgatcacaaacaacgaaggatctccctcctgaagaataataatattgtgtgtccttgtatatctgtgtgtgtgttccgggtaaacaataaagtcgtgatgcagccacggcatgtgtgcgtacgtgtacgtagcactgtatgtaagtgcgcgtgtggtatatggcgtgttggttaattttcgtatattatttggctcaaattatatattttaaacatctatgtgaaatctgtttatcgtgacaaacggggctacctatagatttctagtttcgaatctagaacatttttcaatcaatgaatgtagcctattttaaatgaaaaaaaaacaatcatgtcaaaaatcatcaatctagagaaagaaacggttgtcaaatttggttgtcaaatttagttttgttgacggagtgtaaatgagtgtaactataaattgaaaatatataataacacgaatcttggtgtaagatctcgtagacgaaaaattaagagataaaaacgtagaaatttatcgcaagtgaaacagaaaaaccgcttacatattaagcagcacctccccgtgatcgtaaaatactactcctttctcataaaaaccaggactgaaatgcttcctatccctccgtttcatattataggactttctagcattgcccacattcactttaaaggaataaattcactttaaatctctcatttatcgaagagtctaaattagtccataaacgttactaccagatataatgcgtctttaagtcctaaaattagtataaataaggtcttaaaatagtttggacagtggtttcgattgacatggcgcttacgtcacaataacgtgacacttaaaatcataaaaaaacagtgtgacccacatgtcaatgagtgttatgttaaaaataaaaaaaattgcactggggacccatatcacccccttcccctcttctctcccttcctcataaatctttctttacttgtcatctacgatgcactccgattctgtggcactgacggtattgatgagaggcagggcgtcagcatgggaggggggggggagttgctagtggcgcacggggccacaggacgtaggtggcggcggtgtggacaagtgtgtcatcatcggcggaggagagtgttggcagcgcgggagcatttcctgtggccgcgtgcctcattcccatttcttccccccgcgcccgtgtcggagttgtaggtggacaacgatggcgcgggggagcatttcctcactcccgctcgccggctggctagatccttctcgtgtgctcagccgtctgatgagcttctcgtcctgcgcgtcgggcgccgactaagtcctcctcgcatggatgactcctttcgtctttgtcctagtgctgcggcacgctgagcaggccatgttctcagagaaacaatggtaataaaatgtggtctaaagtgagatttactcatttaaaaacaaaacttcacaaattgacgtaatactactgatttacatatacaacttctaagaatattgaatgatatttgtttggtggtgtgcacagtgtgtgcaagtgaaggcttcattgtatagaatacttctatttgacattaataactccacaaattgttcataatgtcctatgatgatcatcattatcatcattaattactattattattattattatcattattttctgaacaatttaaattatagtagagttgtcctcctcccacactatcgttgatcccccacggcccacactaagaaaataaccttttccctattgatcactaaaaaaaccattgttttacgcgaaaatcaatcctcagaaaaaatggatacaaaaaactgaaccccataatttccgaaccaatatcatacagtatgaaactagccacaactcattttctcaaggattaatctcaacaacctgaagtcatatttcaatttgggttttgtcctactcagcacgaagattttctagcagtattgtcttactcaatctcatctctgaattgactacacgagtcctaaaccaccaaattacaagatcccaccgaataaaccaacttgcaaaatcttgtccaagaaaatgtaaggcgctgtcatttgagtcaaaatgagcagttgaatcgatgcactgaacaataaaacaaatgagcagtgagtgattaatcacctcaaacaaattcaataccaagtacacgttgttgaggcagtgagctggacggagtggcagagaacggcgatgatgcagatgaggtgaacgacgacggccgcggcagcaccaaggacggccggccggccggcaatgccctcaacggaggaccggcggcgccctagatcaacaggatgccgcagcctggacggaggtggtggcggaggcggagcaggacgacgtcttcgaccgaagcagctggggaacccgcagccccacaccctagaatagcggcacccaggcgaggattccaagcgcggcgttgtggcgagtggggagaaaaagaagacgacagtgtgagtgtggagtggggaaaaaaaagcgcggatgaagaaaaaaaaatggcgcgaggctgccgagattggcgcgaggctgctgagtttcccaaaacctgattcggattgacaccgtttttgggcaagagttaattttaggttcactttgggctatctgttggagggcttcttttttttttcaaattaccaaaatttgtcttttgggaatccttttggccttatcttggagatgctcttacaacgcacgggcttggcacactaaggagttttacgtactaaggagagagagcaaaaatctgaaaacgcttggttaaacgcaagagctactccctcttttacatatatatatatatatatatatatatatatatatatatatatatatatatatatatatatatatatatatatatatatatatatatatatgttaaatgtgggcaatattaaaaagtcttataatatgaaacggaggaagtagtacatacgtggcaaatggcagattccctctagcgcactatataaaccaatcaccgagatagaggtagatgcactcgagcactgttctctttctcttcctcggacaaaaccctctctattcctgagctacccactatttctccagttctgttcacctgcgcgcacgggtgacaggatgagcagcaggccttcggaactccatccgcttgcgtacctgtacgggtaggcgggcgatcaaattttcgtggagcgtctcggcgtgactacattgcgactcttctttctctgcatcgcgatggcttccattggagagaacagtggcatagcaggtgctggagggaacggcggcgtttcaggagaaggagggaacggcagtgctccaggagataacaccaacggaggcaatactaatgcctcaacctcctctgcaccattttcctggtatatagctctatctctaattgatgttctttcagttatttatatgttcatcgtgctatcctcaggattacaatcctatgtgaatgttgatgatgtttgtgcttatgttgccaaaagcatgctattgtgaatgtcatgtttattatcttgttattatgccgaattatggccaaatttccaacattatatattctgtcttgatccaacaaatgcaatggcgcctagcctggcaaagatggaggcctgcttgaggcatgacactggctggcctagtggataactatgtcgaagcccattagcttagaagcagcgtttggaggcagcggtcgcctccctcactacatttccctctccctgatggctagcttgccgggtcaagctaactggaggccgaggaacacgggaccggccgcctccaaccccaccaccccacatatctctgctgccaattgccccctcaatgtccatgccaagaagaagctctcaatcgcctacaccactctcaggggctgccacaagctccccatgcccagacctggccactcgatgttcggggccaccatgagcttgggcgtggtggcatctggccagtgtggcttgaaggagatgatggatgcagcagcaacttgagggagatcaatgacaacgccgttgtctctgctgggacggcagtggtgaatccaatatggtgttggtgttcttgttctgttgaatgtgtagcttttgtccatggcagcacgattttgatctgtgatgtgggtgttccagtagtgttgatgatatttgctggataattgaatgaatgtgaatagcttgttcttggtctgtgttgaccgtccgtagcgaacagtttcgaccgtcaatattaccaaaatagaggaagactagttatgccttgcgatgcatan

SEQ ID NO: 6857 - DNA, 750 bp, Oryza sativa
  unsure (1)..(750): unsure at all n locations
gccggatgatttcaaatgcnnnnnnnnnnnnnnnnnnnnnnnnnnnnnnnnnnnnnnnnnnnnnnnnnnnnnnnnnnnnnnnnnnnnnnnnnataagagatggttttgtagatatggttcaggaaatctggtcaaatgttgttagataaaaaagttaaatctggtcaaaggaaaagaaggacttgctgaaaatttagattttgttagataaaaaaagttgaattaactctattgagtgaggatgagattgatacaagacgttttttaggaatatgttagctagtttgcttagagaagaggaaattaaaaggtatcagcgagctaagactaaagatattttggaaggtgactcaaatacctaatattttgcttagagaagagctttttttgtcttcgtgaagcttcttcttaaactttgtatgaaagccagataagtgatatcccccaagtgtctcaattagaaaacaattctttagtagatgaatttacggaaaatgaaattaaagatgcaatttctcaaatggaacataataaagctacgggtccagatggattttctgctaagttttatcaagtgttttggaatgttatcaaacctggtttggtagatttatttaaggattttcatagaagtctaaatctttaatcactcaactttggtactattattttacttcctaagtgccaggaggctattaaaattcaacaatataggcctatttgcttacttaatggccattttaaaatttt

SEQ ID NO: 6858 - DNA, 2831 bp, Oryza sativa
  unsure (1)..(2831): unsure at all n locations
gcgcgattgacttcannnnnnnnnnnnnnnnnnnnnnnnnnnnnnnnnnnnnnnnnnnnnnnnnnnnnnnnnnnnnnnnnnnnnnnnnnnnnnaccaagcagaggttggtaatcgctcggttaaacgcatgaacgaccacgtcgttcacatatatacgtgccgatgaaccttttcttgaggcaatcccaaacctccctggtcgcaacctacatgtggagaacctctaggagcatctgaaaaagatggaacttgtacttctttgtgcggcgacgccctcctaccgttcaccttgccaccggtttgatcgcctccaagatgcctttatcttccatcatcacttgcacctaaaaagtaccctgctagtctagtacactgtcatcagatgaggatagtggaaggcactccctgtgctcccactagccacgtccgatgtcacgatcgatatagctctgataccacttcttggcgtaggttctcaatcaaacaccttgatggcctactgtagctaatccggcatggcacgactcacatagctaaaaaaaacagagctaagaacatgagtacgctaaagagatttgtgaggcaattttctggtttatgatagtgcttatatttctcgatgcaaaatcattgataacataggcatataaattggatccaacatagccttttctatacaaaatggtggctaggctattgaatctttcttgtgacattgctgatctcatatagtttttcaataatctcaactctgaaaagattctttcaaacaaatatttctaggcaaagatgacagtggatatggattaaggaacaaataacctggaatcaagaattgaccttcagatgtagcaagttcagccggatatctagaataagaaccaacacatcacagactgttggaatttcctaacgatattactagaaatataattcccagcaatggcgcagaaatactcctgatatattatggttacagagttcatccgcaagcgcacggatataccattgtagcatttcacccgagagtattcgaagggtatcatatttgtttaatcctgtggaaagatcatagtagagagaaccggactaataatttatatattacttgtcataatcatagtctaagcaggggttaagataaatcaaagggtagattgacacacaagcagcgagctactcattctcatactaaaacatctaagctaagtggaaagaaaatataaagagaatatattcctatacttctaatatacatagtatacatacattctacttatctaattaactagctaataccctctttctgatgccctcctagtacttcgagaagccacccctgcctgccaagtttcttacgacagcccgtcataaccatacaaccggggctaaatacggaggagtaccctccccaaaaaattaacttaggactatatacatgcaggaaggaatacctgtactaagctgtcaccatcagtggcccacctctcatccacagcatataaccccaaataatgatatcccgtaatctagacaccacacataaactaccagatactaatctaatatcatcgtcatgacatagagtaattgcataagtaaacattatactcgtaccgatgtatctcccaaataagctagcggtataatcagtataacatgatcatactgtaaagttggcattcatacactcggaaagtatttcaataccataaatgtataaagaatagtattctaataaaagtacaaagcttacaaaagaggaaaggagagctactagagccatacccgaactcttccgaaggcttccggactccgatttctactctattcctactccattagcttaagactactaaactaaacttgagagaatatgaaagagctttgcttgaggtgtgtgttgaaatggagagagtgagctccttaaataggcaggtaatgacagttatggtggttggaatggtcgaaaataccctccaaccaccatagggagtgaatctccaccgttcccccaaaaccctgaatccatcagcactggcattggttcggccgaaccccctggttcggccggaccctaggctggcccaaccatcccacaagttggctggtggcctcctggacttctcctctccgcagacttgtgaattttggcccaattggtcgtgtcatttctatgttcttggccctttcatacacaagtctgattctcgacatcgtccgattgatttatcgtctgatttgatattgattcttctccactttatagttattctctggaaaaggttagtgaaccaaatactagtggaatattattattctaacacaaatatgcatcgcaagcataactagttctcctctattttggtaatattgacggtcgaaactgatcgctaacgaccgtcaacacagaccaagaacaagctactcacattcattcaattatacaacaaatatcatcaacactactggaacaaccacatcacagatcaaaatcgtgctgccatggacaaaagctacacattcaacagaacaagaacaccaacacccattattgggattttcaaaccccaacctttgggccccccggggttttccccccccccccccaaaagagggccccccccaaaggggggaaaaaaagggaaacaacggcgttgtcattgatctccctcaagttgctgctgcatccatcatcttccttcaagccacactggccagatgccaccacgcccaagctcatggtgggccccgaacatcgagtggccaggtctgggcatggggagcttgtggcaccccctgaaagtggtgtaggcaaatgggaagcttt

SEQ ID NO: 6859 - DNA, 4012 bp, Oryza sativa
  unsure (1)..(4012): unsure at all n locations
tgctcgcggatgcgtatnacattgtctcagtcnttcggtgtgtaattctatcagcgtgtctctttgcacacgaagcgcgcgtgcgtnctattaatatataacgagntgtctgatcttntcatacnannnncnnnncccnncccccccnnggcgggatgatagtaacgctgttatntagcnnnnnnnnnnnnnnnnnnnnnnnnnnnnnnnnnnnnnnnnnnnnnnnnnnnnnnntttgccatacgggggctttactcgtgaattgtgtctagctcgttggtttagtcgcagacgtagttgagtcgttcgctcgttcgttcaaacgaggtgttcccccatggttcgttcattcgtccatcccgagttgtcctttaggccaggttaaagccgttcagagccaccagttccgttcgccgatttcgtttgatcatttgggtgatcccgtgtcacgttaaattgactcgttgagttggtatcttgtgaggctcgcttgccagtcaatgcatcctttgatcctatgttcctttttgggctttaatccctgtcaattggctaaggtttttctgttattagtaaacagcacaaagcatcttgtaaaattcataactaaataatctgagctccgttttaacccattcaaattgcagtgaatttgttaagatgtcaagaatccattaaaattggtttcttttgctgtttcagtatctttttagcttgtatttattgtgtgccttgtttgtcgtttagactccggcagttccgtcgctccagtttattttgaggtggtcgctgaggtcccgtcagctgaagagcaaggcaagtcatacatacatcattgattatattgagcctatttgcgaaaccccctgctttttctctgaaaactgcattacttttataacgttatgtgggatggtttctacccatactcagcctttgtttaccctgattcactgatagcctaggataataatttgactagatgattggtctaggattgcttagccatgcttagatcaactagctcacaatgggattcactataatatagtccttaatttcatgataatgttatgccttcttggcatatggttcattaattaaaatatgctttacttggtgggtcgtgggcacatgcatgatggtttcttttggtggtcgtgcccatgacaattaaggaccggttctcgtgaattcctggaagatatactcatactaaccacaagccagatgggctccaggctgaatcttaagtataatcttttctagctagcgcaccattggcaagggtaggcatgatggagtatggatggacctggattttggcctatgctgcttccggatttacctaggcacgagcgggggcttaatttcaaggttgtaacctatgtcgtaactaaatatcgactcatagttgtttcaatgtgtttctcttatgttatgttgttcagatcgatggcgctatatgtcttctatttcttcagctttatcaatgtaaagttctcctaccaaaagaaatatcaacacagatgggccaagcccacagtcacttgaggaggtcccaaaaagtactaaggggtagcaaactgtattcaagctagacaaagttcggaggaagcctcactatttcttcctccgtgtaacacataactaattatgggatcttttttttagtatatgtgagtcaatgcacacctgcattcacccctacataagtatgtggactaaactgaacaatcagtcatattgaacataatatcacacaatgatcagttcaaataactccagtgaagtaaaatagccttccagtaggattttcttcagaaaatcatatatatcctagatgctgtttactaatcttaaatggacattggaagattaagcatatttagaagatttagtttgtaatctgtctatctctgattttgctttcatgcatacatcaaaagataaagggtattggtgcgctcacattttattagatggcatggatcttcaagtgtgtattgttctgcaattataataaaaactggtgggcctctgttgtagttccgcatttagctttgctggtatgaaacttaaattccacttgctaccaaaatttaaagcatctatcatctttttatgtgacgagatatatccagaactctacatgaaaattatcactactagataagtgatctttgcccggatggcaaaaatcacattagtcccggttcgaataggaaccggaactaaagtttttttttctagtcccagttaaaaagcctaatggaactttttgatctttagtcccggttgtttataccaaccgggactagccgagccgcacggggagggagatcgagagccatgtcttatctcctcgctctgcgtcgtccttatcatctcctcccggcccgcttttccctcctcctcccctcccctcccctcccctctcctcccctccggttgcggcgccatgcggggcagcatcggcggcaggcgggaggcgctcgaggggaggcagcggtgagctaggcagcggcagcaccctccgctccaccggattcggcgagaggggaggcttccggcgacgacgcacgagggcagaggtggcaggcggcttccagctgtgtggcggcggtggcagcggcatcaaacgccgcctgtgcggagcggatgaaagcatgatggacgcagcctccctggccagggcgaagtggaggatgcgttggatgaggtcgttggagagcgctgagatgcggtcgatgccgccgacgaggaagaaattgtagaattttttagatgtttgtgtgaatttgtcgaatgttttagatgtttgtgtgaatttgtggattattgagtatgttcatttaattttgtggatgattttgttgttgagtatgtttttgtgaatttgtggatgtgaatttgatgttggggatttgggcatgtgaaaaaaaacaatgaaaaaaaaccaccaaccgggataaagatggatctttacatccggttatttcaaccgggactaaagatgtgcattcttagttctagattgggcgtcccggtttacaactcaagactaaatgtggttgcaaaccaggattaaatatgagttccctagcagtgtatattgttccgtggtatatatttccctgcttgatccacttctttggatccttgacgtagtgtgtgtcaacctagcctgtgaacttccagttagtgccacaaatagctaccttggaacataggcatcagatgcatcaggaactttaggtgatctgtgataaccaaataccgcaaacataactagacaagtgtctctgaactgacatctgtagtagataatcatctctagctgatagtccatccaaactgaggtgcacacaacgctaatggtaatgctgatgcacacagtgctgatggactattagttagagatgattatgtactacagatgttagttcagagacacttgtctagttatgtttgcggtatttagttatcatagatcacctaaagttcctaatgcatctgatgcctatgttccaaggtagctattgtgtcattggtaaaatgcaaaagaacgacataactttttttatgtcagcggtagttgtgtcaaaattaatttttttttatcaaattttacatttttatggcagaatgtatttcaaaacaatcaacaaattgcagagaaatattactagcaggtganctttttacatcaccctattaactctcacttacattgtctttnaaagatgtaatatgtacatagacgtaagattcaggaagtagctctttggtactattatgaatgattgattttcgagcgacggagtcatgaggtagtggtaggatcgtgtttcgtagtttgatttgagtaatgttagatgcgacaacgaattccgtgggttggttttatttagtatgctacggtgagtctgctttgacgcttcaccgttcttaaccgtactacgatctgagtgtaagatacaattaattgattgagtgtacgtattcaccg

SEQ ID NO: 6860 - DNA, 9936 bp, Oryza sativa
  unsure (1)..(9936): unsure at all n locations
caaccagcccgaatatggtaacagggtaaaacaaaagcccaaggggccacacccaataatgtgcctggtgatcacttgtatcaccgggtcagcaagaaaagctaataaatgattggcctcttgtttcaatcatatatgttttgatcatctgccctctgtaaaaaaagtttcttgatcagtagtggtgatggcgtgaagttacaaaatagatagagtcacctaccagtaatatttctctgcaatttgttgatatgctttgaaatacattcttctataaaaatgtaaatttttttgataaaaaaatattaattctgacacaaatattaatatattccagaaaaactgacaacggttggaaataccaccacaaccattcttgcttacatttacctactattttttatagcgtggcaaaccttcatgcatgttctactctttggcgtgacggcttgccacctataaaaaaactattttgtcctaaattattcttgtagttcgtaaataacaaaatattattttgcactattgtagatattgctgtagtgacctttcctatagtatttgttcgtgagaaacctatatgatataaatgtgccaatgtaccgacaatgtcaatgtgatacgtcatgccatacagagtgtttctaactaattcaaatgcgacatagtttatctggcacgccatgccacacatagtgtttataactgattcatataaaccatattccattcaattaaaagtttataacaaaaatatgtacaagaatgtgacatacatccatttatatcctcattaatgtggagattatgggtatcccatacccacacggcatggttatccgactagttataggggataacttatatctatggaatatgtaacagatcatgacttgggtattacgtttccttgtatattacggaacggcctaaagtcctggtttgataagattgtaaagtagatttaggaaaccgataccgtattggttaaggtttctatcttataatcctgcccccatcctgtataaggtgggcaggaggccctctagggggcatgagacaacctgattgtcagatcaatacacacccggcggattcaaatccccaaacaggagtagggtattacctctcattgagagggcctgaacctgtctaaatccttgtctctgcatccatccacttttaggtctcgtgcgctaccccttgtctctgccaaattcatgtttcgacagttggcgcaccaggtaggggttgcgtcaaattacccgtcgaaaagtgcgatggaatcaactccatgagtcgccggcttcgtcttcgcttcgggattgtcgcttcctcgtcgccgacgacttcaacaagctctcgttctctgacttggattcaaaccagtcaggagagattcaatctaactaagaaggagatgccacttttaggagttatctccctgacgaggcctcatcagttccgcccgaccggagaacgccgccgccgccgacacgcgaagagggagatcgtgtgctgcatgtgcctacaacggtgtcagcggtggcctcgcatcgcgctcgcgatagtgctcgtggtgacctcacgctggtgtcgcaaggcagcaagaccgatctctccctgatggtgtcctcggatactccaatctatcatcattagattgatttctaatcagattaatttgctctgttgtgctttctctgtttttgcatgtactggtgacgagacgggcagcatccaactgaggtcatctttgccatgtattaatccatgcgtgtgttgctggattaatgccggccaaatctccagtcagtcatgctattggcaaacgaaccaacatgcatactgcatatatgcaccgacatgtgcattatacctaattgctaattagatttatttataattgcaacttaactgaagcttgtgttggctattttgtttgcatgtttggagattccacacgcctgggggctgcgggccagcaccgcctttgcgtgcctaacgcggcccgactgctcctagggcacgcacgacctggatgcgatgccgcacgtcgggggcttcggtcttcgcccggccaacacagccagactacgccgcttccgccgtgggctcggggctttcgcctttgtgcgccgccgcctcatccgctgccgattggtgtttccgcctgcacagttggcctattatgccgtcgtttatgggcgtccacgtcttcactgaccggctggcattcgtcaccgctgactggtgttctcgcctacatggttggttggtcacaccactgttcatgggcgtccatgtcttcaccgaccggctggatttcaccgccgccgactggtgtctccgcctacacggctggcctattatgccgtcattgttgggcgtctacgacttcaccgtcggcctgccttcgtcgccgccgactggtgtcctcgcctatacggttggttggtcacaccaccgttcatgggcgtccacgtcttcaccaaccggctggatttcaccgccgtcgactggtgtctccgcctacatggctggcctatgatgccgccgttgttgggcgtctacgacttcaccgtcggcctgccttcatcgccgccgactggtgtccttgtctatacggttggttggtcacaccaccgttcatcggcgtccacgtcttcaccgaccggcttgcctttgccgccgccgactgttgtctctgcctatacggctggcctattatgccactgttggtgggcatcttcgctttcaccatcgactgccttcgtcgccgccgactggtgtcttcattgttattgatggacgacttcgttcccacatcggctacttctattgtcaccaagggaatacgaaaaagctaagtcatcattaattttctttatatgatattttccttttcctctgcctcatgacatcaactggttcgccgttgactagtgagtcgagggctacagatgttatatcatatttttttcaacaatttttataatatttatcttgatagctcgcgacataatctgagtacaaaagtgcctatcgagttatggagtttaatctttctatgctttccgtttggtttaccaatggatagttgtctttaggccgattcctagcacctgggggctcgttggatggaccgaataacacaaggtgctaagtattaatcggaataaatcaaaagcatatagataagataattaattttctgctctttacaattgcaaaagtacccgagtagtaaattctgattcgtgaaactttgttccattaatgacgaactcatgtcactcatatgcatgtttgggaagtgcctaggccgactcccgatgcttgggggctatgactagtcggacagagtgtttaaatgtacggagtcatctgctcagggaaatcaaaattgacaagaggagaaatacatatttataaatattttaaaatacttgaatttttctcgagtattatatttacatcagatactactcatcctatatgtttgttctgcaggatccagatccagatatgcataaaagggattcatggctttaagcttatctcttacgctccaggaatggatcagtcagaatatcaccaccggcttgccgtcgtcgccgccgactggggtcttcacctatacggttggttggtcgcaacactattgttaggcgtctacatcttcaccaccggcttgctttcgccaccgccgactgctgtcactgcctacatggctggcctattatgccgttgttgttgggcgtctacgtcttcaccgaccggccgcctcgtccgtcgctgactggtgtttccgcctgcacggctggcctgttatgacgccaactgatgctatcttcttcacggctggctacgtcgtcgtcaccgctaataggcgtcatcatcttcaacgcaagctgcctacgtctgctgctgactagtgccgtcacctctacggctggtttataccgctaccactattgatggacgtcatcgtcttcattgctggtcgccttgtctgacgcagactggcttgttcgcctccatgcctgcacgttttcgtcatcattgactggcattatcgtcatcgccggttttccttcgtcgctgctcatggtgtctttactttcatggttggcctattttgtcgccgttcaaggacgtcttcattttcgtcatcattctacttcttccatcgccgacaggttatgccgccaccgactaatgtttttatcttcacaactacgcgtcttcgctaccggtttgcttctgttgccgccgactcgtgttcacttcatcacagctatgcaactttgtcatcatggtggagcgacttcatttttattatcttcagcaccggcaaactctattgccgctacttcacaagttttgctacttcaccaaccacgacgtctacaagagcttcgacatctcagcatgcgtcaccaaatatgatgccgtgttattttactacaacaagtggtgttccaatcttcaatatttctactcggatatcttcaacatgcatcttcactcaagcaatgactactcgacgacaagaagctatagcttttgactctatgttcagttgtttcccaactaaccaaagagtcgggggctacacaaatacacggctcaaaattcgataggttttatgtcaagatgaagaaatcaacaaatcagccaatgagttctatggaatctacttcgggagtcatcggtttcatcttcgcttcagagcagacgttctacttcagcaactcttattatttcaccggcaatttttggtttctacacgccgctacaatctactccaaatttctcaattgtcaagtttgagatttaatctacatgttcgggagttggacaattatcaaccaatcagctcagttttaacgagttggacaacagcatatactttcctctaagtgaagcatctgcaacagctatagcaccaagttctactgccatcttcataaatcaagcggcattgcatcaatctttgtcatagacatgctcatgtcaagaaaactattcgagcttcgccatcttctcaacaatttgaaggattattgtcactgacatcatcaccaacacctctacttcatcggccctgacatctccgccgttgctaagggcagctgtttcgtctgtctccgactgattatttcgtcaccaaggctacaaaactctatcgctattgctgggtgccttcatcttcactgctagttgatctgactgctgcctactggtttcttcgcttccatgccgattgcatcagctataaccgatgaacaatttcaattactccaaaaagataagctatatgctcaggggcttacgagctcaagcacaagaatcataccttcaagttggattttgttctagatacaggcaacatgcactcgtattcctgagattatttcctatgctcgaagactggaccaatcattattccccgtaagggctgtcaaccgaatacttgcgccagtcgggattcaatttttatatctattttggagtatcccataagggataatcactcatatcagaagcaattcatatgagctacacttggtctatattacccggaagatttattactcgggagcatgttacatgcgtcatcctttaaagggtgtcgaaggcatattttttggcctaggcctaatatatctgcagcccatattttcaggtgtggcctgtcacgttcttttagggacttaggcactttttgcttaggccaaagtgcgtgtgattatgtgcccaataccttaaaatccttttatactgcagttactcaattttttaggagttggtacaatgcattttaaaaggtgcccaatagtgaagtttttcatagctgccccgctgacttttttatatagtcaaggcactgtttgggttttttaagcaattgattagatacaatatcattgctttttgccacgtaagtgtgcatttttattgcccaatattatggcttaggctgattatatatcttggttattttccaggtgattggtaaatcctttatgagtttatttactcggattttataccacatatgccatatatttccgggtgtgttgaaaccatgtgtcttttagggacttaagcacatctgttaaagcagtgtgcgcatggcgtatgcccaatactttggaaatttctttattaacagcatttaagcttctttatagctgttttactatgtgaattttcaatgatgtagttagggatgaaaacggtcggaaacgatcggaaaacagcctcaaccatttccgtaaccatatttttctcggaaacgaaatcggaaacggtaaagtcgaaaccaaaaacgatatcagaaatatcgaaaaaccgaaaacggaacaatacggacggaaacatatcggtacagatcggaaaccggtaacaaatacggaaacattaaactataaaaacatatatttaactttacataagtatattatatatatacataaattcaagcttatactatataaattataaattaacttcattttagccatgtacaaaagttagagattttattgaagagtcactcaatctataagctgtgggtcaagtatagacatgccctataaatatcgacatatttagaatacggtaattaccatattataagaaacggtaatttccgcaagaatacggtaaatacggaaacgatcggtataacagtaaaaccatttccgttttcatttccatattttttaccatttccatttctgtttcggtcgattaccatttccatatggctcggccggtagaaagtcaaaaaggaacaccggtcggccggtaattaccgttaccgttttcacccctagatgtagacaactttaggttgcacgcatcatattttacaaatcagtcggtatatcacctggatcatgttattcggggattcacaccgcatatgctatatattaatatcatgtcacttggttgactataattattaaaaaccactcagttggttggattatttattccttgactatatgcttagtttgttcaactaaccacatagtcgggggctacacctattaggtgcatctattcgatgcacctggttttatttttcagccctctacaatcttcatatttggtaaaagtactcaggagaccatggcaaagatgattgaagcacttggctttggagtaatctggttcgagagaagattatcttttcgactgtgaagatctcaggggttactgtggagattatgggtaccccatacccacacggcatggttatccgactagttataggggataacttatatctatggaatatgtaacagatcatagcttgggtattacgtttccttgtatattacggaatggcctaaagtcctggtttgataagattgtaaagtagatttaggaaaccgataccgtattggttaaggtttctatcttgtaatcttgtcccccatcttatataaggtgggcaggaggccctctagggggcatgagacaacctgatcgtcagatcaatacacacccggcggattcaaatctccaaacaggagtaaggttacctctcattgagaggacctaaacctgtctaaatccttgtctctgcatccattttaggtctcgtgcgctaccccttttattattgccgaaatcatgtttcgacaattaatatggactaaaaaaacttaaaaatatggcacgagcgaatggacaaactctgtccactcttactatcaatagactaaagtgacgtagtaggggaaaggagagcagggcagtgacctagagtttctcggttgtttttgaagctctaattaaaaaagagtgaagaataagttgtacaacatttttcttggaaccgaaagaaaaaaaagtatggaaacaatatgaagttggtaagtgctttctttttactatgtcagatagtgtatatatatacatacatacatatatatatatatatatatatatatatatatatatatatatatatatatataaaactagtcactaaatccattttgtaataattaaaattcaataaatatttgttctaccaaaattattatactcatacaatataccccatcaaagatatcaatgattttgagagcaacccattcatcaaccaaaatatatacttttatttgggaaacaaccaaaatatacacttgataaatcgaatgattatttattgtggccttgaaccacttctcaaatcacgaagtacggtacgtactaccttataactgcgttgcttacttgctttgtatactctaattagtttagaaatataagacaacatctgtgacaacatataactgatcaccagatatattgccccccattgcctcactcactcatttcagctgctgttcctgctactgttctatatccaaaatgttaactacaatggctatatcttttctgtgggcatgagatgcattgggaactgcgatctgtccaaatcattccttggcgcagtaaggaaagagggatacttttatgcatacatgatggcatgtagtaggacgcaatagcgataacacattattcctgccgagctcgtctgctttgatcctcccacgccatgattcatccatatagacccagctacagccaaatggacggcagaacatggcttaactgaatatatcaaatcaaattgatgcaacatccttaaaattacaataatccaaatcatcaatttgtgtactccctccgtcccaaaaaaaaaggcaaaccgtgggttcccgtgccaacgtttgactgtcaatcttatatgaaatttttttataattagtattttcattgttgttcgatgataaaacatgattagtattttatgtgtgacttatctttttaatttttttcataatttttttaaataagacggacaatcaaacgttggacacggaaactagggtttatctttttttttttggaacggagggagtaagaatcaatgattagctcatgtgttgttagctgacgcagcatgccgcggcttatcccctccagatatcgatggtagcaggtcaagcagtaccccactacctctgatacaaactgctatgtttcgtaaagattagatggttttaataagttaaatgtttgattaatcctttagatccattgtgccactaggataataaaaagaaaaagggattctctcacttagctgctatacagtttgagcattgatatatgggccatagcaaagtgggatctacatgtcagtgattaactccatgtgtaattaagtcaaagcatctgctttcaataaaaaggggtccatggcagtatagcacttgacagatatttactgccccttttttactttctactccctgtatctcatttgttttcctaaatggaagttatcaatgttcttccatgcatattgttttttattttcttcatgagacttgctgtttgaccgtaccagcgctgtacaccctaacaaactggaaatcctgttcggcgatcgatcgctctggggatggatcagcgatcgatcgcctcctccctccctggctccctccctccacccctctacctggtttctttttttttggcaccgcattactttcctattttagtaaatttatatacttaaagtttatacacctcaagtttatacttctaaagtttggagaccaaaaagttttattaanagggttccaaaaaaaaaaagggggttttttttttttaaaaatttttaaaatttttttaaaaattttccccccccccgattcaaatttgaatttgaattcaaatattttttttatatatagnnatttctatatatctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6861 - DNA, 1553 bp, Oryza sativa
  unsure (1)..(1553): unsure at all n locations
cgcgcggtgagtgnnnnnnnnnnnnnnnnnnnnnnnnnnnnnnnnnnagctgtccaatggaggatgccctgcagggtgcatacttggggccacgccagcgaagttctagtcgcgacgtggtgaaaccaccggcggtgcagttgagggtccctacaagcccgcgcactaccggtactaggctgcccagcacgactagcggctgtggcatgagaagtgtcaacttgaagttcgccatgacgactctggagtatcctgctttgttttcatcatcttatatgccgtcacttaggaggatttgttgtggggtttatggtttgagactggtgaaggggaggaatgggaagccgtttgcttttgcccagaaataatggcgtaattgggtggagttggggaggtgtgctttggcagatacagttttgtcttgttgactctacttatctgatatcatttgcaagcgttttgataaaaatcatgcgtcatttatgaataatattcttgcctttaaagatagttttgctcgttgtgctggattgtatgcctgtttcgttggtttgttatgtgttgctagtctcatttgctcgtggtagagctggtgcttcacttcccattgggagtgtgttttgcatttgcttagtgtgctattatttggtactagtacattaaataagcttatcagaatcaggggtgcaagttcgatacttatgcgaattcgtattgtccggtataagaagatagaaactgaattcgtattcgactcaaatcctgtcaaagtaaattgaaacgataagagttttgatatttgacttaagaataatatccttattctttataattgagcatcctaatcaaattcgaaaaggcaattcaatctatatgcccgtttgatttttgggttaatttgatctgtgccattgatcaaattaacccttgatttttagacatggctctcctatctgccactttacctctctcgtcggtctctctcgagttctaagtgagtgtccatttttctcctactctctccgggcgtgcgtggtttcggctcttgttgtctttgttgagcttgactgtggaggctatcgttgtaaagtttgcgagaatgcttttcatcgggcgtccgggccgacgcaagaaatcggacggtagtaacggtgtctcttcacccgagacaacagaagtcctcgcgtgcatgcagggagctagtgcacgtaagcacacgtcaagtgcatgcatccatgcatattcaaatattcaaaatttaaatacatgtttctctacaatcatttatccaacctactatttaattataccattagattcgttataattaaatatttatataatgatcttacatggttatatcagatagcggctggcgcggtaggcggcgagcgggggcgaacgggcagatagcacgcgggggcggacgatggnctttccccactgcatctgcaggctccccccccgtgttcctacatcaccgctacatgtcttgactccagacccaaccccctcacttggcgcttccgacgctaccggcccccgtccactcg

SEQ ID NO: 6862 - DNA, 5534 bp, Oryza sativa
  unsure (1)..(5534): unsure at all n locations
ccgcaccccccatcctgacggtgaagaagaagaccggaccatcctctctgtgtccggcgcctccattgctccctcccgcagaagttcaacgtcgctgcctctgcgtcccgcgcgttagccgcctcagtatcccgcgccatcgctgttccctcctgaactaaggtgcataacgcttgcctcgccgaccacccacgcccactgcccgtccccacaccgccgtgcgcgctacgagagaggaatagctagagagaggaagagcgatagatagaagaagagaggggaagaggggtatgacatgtgggtcccatattttttaataaataaaatactaactggattgccacacgtatgctatgtaggacaaaatcgctctggattgggtcgagaggggtaatttgttcggtattaaaagttcagggtgaacgatgactggttttcgggtttagggggtaatggcaaggaagttgctagatatcccatgatcccaaggccacatgcttaggaacctatcagtctgtcacaccaatggcaccttttcatttttaaccctataaatatttctctttagatgtataggtttagagattgagttttccatactagtaactttttatatactttatctataataaaaaccacatatacatgaaacaccttggaagtttcaagtcttactattgaaattgtattctttactaattttctttaccattgtataaagtacactcaatctccagttttgtttagcatacaagttaaaccatctcagtttttttttttgcagtgaacacatattctaaactaaattattataaatttagtttaactaaaataaaataaaataaaataaacattagcaaatttacaaggtaattaactaaacatagcctaccattttcaccttaccaaaatgataaagtcgaattgcacataatagttatggctatcaggcatcctaccattgattattattgttgtaatgataaaacaaatcacaacaaaataaataacatttacatatttttttagtaaagcgaatggtcaaacatcatattcaactgtatcatctattaaaaatagatagagtatatttttttattacgaataatatgtgaagacattcggtatagaggaaggttaaagtcgtgcattcgcacgactatatacactagtcttctattgaatacattgttcttcgaggcacatcaggtagtggtcaagaaaaaagcttttggacatgatgttcaatcatccatcctattcagagttccacgaaaaatcaccttgtcctatggaaaaggtgagcctaatgaaatttgcatttagataaatccatgctcctattattatgagtgtaatatatggtcaatcattaaagttgaacgatggtgtcacttagaatccgcgaatttgcaaaatacacattcaggtctatattattggtttaatgtagcacaataggtccatttgtcgtttggccttgttagtttgttgatgcggctctccattttggcaccaaatttgtgttcgtcccctctgcagcatagcgtgacgcgaaaattgcatttaaccccttttcgctacagggataccccaaaagccaccaaattcctctcctccctcgccttctcccccaaacacgatgattcgtggtggaacgggaaatcatcaacaatgcagagtgcttcaggcggtggttcgagctgcaccataggtgacgtgtggtggggctctatcatcggcacggcgatgagcgatggacctcaacttcatggggaaggttaaccgatgcgtttgtatcatgagtactgcccacctatttcttgtactccagcattcatctagatgaattttagtaattaactttggttctttatgcaatgcaacatgatcttggttaagtagttggggtttgatctagggtttagtttgttgttgatttgtttggttttattttccatctgtttgccctggttcaaattatttctcaattgagtttcattacacaaatttctctgtggtatgtgagtaaatttgtcgattatatggagtactattggagtctaattttccttaggcgtgtatgttcaaaggtacttcctccgtttcatattataagactttctagcattgcccacattcatgtatatgttaatgaatctagacatatatgtgtgcctagatttattaacatctatataaatgtgggtaatgctagaaagtcttataacctgaggaggtagtatgatggaatttcgattctttttcaattgcacagttaacggtagcaatgatgttttatctttcttttttctctctttcatgtcagcaaatattctttattggttaattaatttactggatgatgtgtagcactgaaagaacacaacataacggtaattctaatgatcggtagtacagttttgttggtaactttttgtgacaagtcgacaagcacgatcacaacacctaaacgccttgcggtgatatggagtcgccaaccacctcgatctagccaaacggccaaatcaagatgggtttcgtagaaaaacagttaaaccggctagcggagccgatttagagatcaaaatcagcttctaggccgatttagatcgatatgaggataactacccgtctcgtgggcaaaacggaaggttttcaggacaaacctacagagaggcgtcgcactctcgcagcggcggcggacaatttacagcgcaaatcgacgaagatggactaaaactagggtaaaatagaaaacatggtaaaagaacgatttaagtagattgtattcggggttttacaatgaaccggccttatcccttaaataggggttggtcttgccttctccacatccaactcgggatagaaactaaagaaaacatgaaacatgccttcctgagtaaggaaactcgagacctgacgaaatcggactcggaccttgacggtctaaccgcccacatacctgcggtcagaccggccctactagccggtcagaccgcccacatacctgcggtctgaccggccctttgaaggaaacccgacactttctaaattttgataattttcccctattttgtccataggtgctaaatttgggtgtaaacactgttgatttgtttccgttgttatctcctgaacatcctcgaacaaacggggttaaacaacacttgtctctttccatttaatcatatatagttgcctaataatctgaggctttctaatttctgtttagatctcaagcggttttatctgcatgggtgtctcaccaaagaccaaacaatttcagatctgcatgtttatatgagatctctgtttatattggtgtgcaccagcttaatttggcccagataagaaagctgaaaccgaatccaacagggtctcttttaagttgtaaaaaaaatgaagaaaaacagggactcttttttgagttggactctacttggcccaacttactttgcatagataatttcctttctttcctaggggcctatagtttttgcctgaattggactctacttgggcccaatctatattctcttgtggcatagatcttgtttggcctataaatattccaagacctattgcttatccttccagattctctgccatagaaattagaggtgttaagctagggttttgggattgtcatcaagggaagttgccaccagcacaacatctgaaattattgaaggaactcccaacagaaattattggggaagagatctcttgatctattcagttggcaggaaggagttggatcatccgtgggggtgaagagagcagaaggatcaggccttgaattgtgaattcttggtggtgattgagcagaaggatcaggccaagaagtccaaacgagcagtgaaatcaaaatagatacaacaggagaggcgcacgtaagttttccatgtctcacatctgtggtttttctgtcttgttatttcaattgaagtcgattgcacaatcgctgcttttcccccctcctttctagatttgttcggtattttatatgcaccctttcagtttttctccaaggatcacgggagctttccgttttgaacagtccttccaaatcgatcttgatattgcattattagaactggcataccatgaatttttttttttggtgtggggaagggggggggggtattatgtgaattttggatcatgagatgtgcagtaagatttatggtagcattcttctcctccaactccgatgagtcacgacggcttcggggaggctgcggcggcctcgaccaatagttcaaggttggtgtgaagggagggggatggccgtgagaagcaatcagaccggccatacggcggctcatgtcatggggtgaggagctaggggtgatggtggggcggggcacgtcgtatccacctggcttagggagtgggagaccgtttaggtgggccttgtcggcacagttggtgcctttcggtggtgacgaggttggggtcgttgtgcgagccagagaataggatggtgttagcgagctgcaggacggggaggggggggttgttcttgggcagatctcgctcctaaacataagggagggacaggggaagaggctggacctatcatataaataagacttcaaccatatgtacccgtatctattaatttaccttctctgtgttattttccatgcataaattttgatgcaattctactgtgtgaaaagtgattaagatcatgtttttttttgaaatgttctataagtagcatgtggccgtgtgcactaattagatttaacaaactaataaactttccttgccaaaaaaaaagaagcaaatgtcccactactccactagcatatctcgttgatgcgtgtcacggctggtccatgaatgtgcgtgttgtcttatgtaccatgtcaaaaattcaataaaaaacactgcatgacaaaatcatattatgaaataggaaaaagtacgaattaccccctgaactattacggacgaccgaattacctctctaaacccgaaaatcagacatcgttcaccctgaactttcgataccagataaattacccccctcgacccaatccagaacagttttgtcttacgtggcgtacgcgtggcagtccagtcaggattttatttataaaaaaatctgggacccacctgtcatacttctcttccactcttcctctctcttctctctctctctctctcactcttccttactctctctcgcgagtcggcggctggcggtggacgcggaggtggcggtggcgaggtgaagcggaggcggcggcagcgtgggacgaggaggtggcgggagacgaggaggcggtggcgagtgatgcgggacgcggaggcggaggccgtggccacaatgagtagccgcctcctcgggcggggatggactgaggcagcngcggccgtgtgaaacggtggaagctgtgtcgcgggtatatagaacgggcattgaacttcaggaggaagcttccgcgaactcctttcgcgcaggaggggtgccagaaggcgttctcttgaactgtcgtcgcccattcttgattgcctcc

SEQ ID NO: 6863 - DNA, 26198 bp, Oryza sativa
  unsure (1)..(26198): unsure at all n locations
nggtaccaaaagaatttttacgccaatttctggtttatgatagggttaatatttccaacgcaaaatcattgatacgagaggcatataattgggatcccccatagctttttctatacaatatggtggagaggtgatgcaatctttgtttgaccttagggcatgtataacagcttcacgataatagcacctaagaaaatattgtttcagcggactcctctggacaaggcccactgtgtatatttataaagtaccaaaatacctgggattcaaaatttggccttcatatgtagcaagttcacccggatctcaaagataaaatcaactcgtcacatgcctgtgcagaatccttccgtcatcgctacaaagaacgttatgatcatagtggcagcagccgccgccaccactctatgtccgcccgcttgccgccgacccacgagagatagagagtaagagtgagagagagagagagtgagagagaggagagagagaagagagagagaaagagtgagagagagaggaagagtagaagaggagtacgatagacggatcctacatttttttaataaatagaatgctgactggactgtcacgcgtacatcatgtaggacaaaaccattctggattgggtcgaggggataatttgtctggtattaaaagtttagggtgaacgatgtctagttttcaggttcagtgggctaatacggtctaccgcgatagttcgttggggggggggggaggggggtaattcgtacttttttctatcaaatatgcacatgacctttgttttattttactttatgatcctgcaaaaaaaaggaaaagatatacaaaatgttaaccttcattgtttcgtggttggagtataagggatacaaggtttcaaattatggattttgtctcacttaaccgcccttcatttaatttttactcagtcctaccctcaaccatcttctcattctccagattaggtgcatcatagtcttttatgcatatgtataccgacggagaatctgccatcccacctattcctgttgcaattcttacatattaccctttaaacttttttctattatagttaaatataaaagaatagccacatataaaactaatgtggatatccacattttcctataggaaaaatgtgggtaacatatttcatggtaaatatgatttatttattttagaaaatactgtggtattttttcctttatccatagcaaatcatgggcatttagccagtcgcataagaaattaaaggtaggttatatacttccttcttaatctcttaaagaaatttggactggtggtcttaaaagaaagaaattctcacattcataaaaaaaatgttaggagctcccatattatatatagtaataaaaaaagagaaaaatcatggctgttaattttcttcaaggaaaagttcatttacctttatgcctttcaccaagttcaaactggtttcggacaacctttttagtattatctattaattaatggcgatgagataataaatacaaactagaaatattggttagtttcttgaatcctagatggaaactgattcgtgatgtacatacatgccaacttctttacgtggcatatagactcctattgtatttttgatatagggactgtgtaaccatcgtttgcaagtttttagcccctaaaacacgcgatcgattttgtacccattggattgaaaagcgatgggccaaatctttccttgcaaaccctattaaatagatcaactaccctcagccttccttgcaaaccctattaaatagatcaactaccctcagcctccaagcctccaataccctttcttgcacattgtacgccgccaccatcctacctaggtgggctgcaagccttctgtcttgttggcttcatcccgccgccatcccccccacccccacaaatacatcaccactctgctccggatccactactgcgtccactccggcgagtgcccctgccccgccccgccctgtgcttctttcccctttccgatggctccttttcactagatctgcatatgccgccctcttcctccgaacttcttattccttcggcccactactgagccgcctcaaccactggtgacttcccctaagtctagagaactccccattttatgattcctccaaaacaacctttcctacccctatctcgaaccctaattcgttgcccttaattctatcaccacgggcgttattgcctgaagtggagaagaaggggtgaaagagtggatcaagatccgttgctgccgcgagtggagaagggatgaaagagtggatcttgtcataagttaggaggtaaggaaaattcacatgttgtaacctccaaaaatcatgtgcatgttgtttagcatgtctattttggtatggtataaaatgcaaacttaatatccaggggcaaaaagactgggctggggcttcaggttcaggttggctaaatttcctactgtttttttcttttggccttctctcctctaaacctaaaaaaagttgatgttgcggagttatttttttctcggtagttcacgagtcatatgattatagtagcaagtacaatacaagtgagaataagtataaaaaagggaatgtgtgatggatgtctagcttgagaataaaagtgaggagagagagagggtgagtgagctgctaagggcatgttcaacaattaaacctggcacatgccctaagtaacatgttatatatgttgtgactaatcctctgcatcagataacataggctttaaatattaaaccaccaaaaaaaatattttaccctttgtcccttccaacaactagttgcagcaaggtaaatttatatcttgtgacaagagtcgatgataagctaagggtttgactctcttccccttctctcccttccacattcacaaaaatgtctataaagcagatttatggtatacatgtcatgaatagtcggtggttgcacatgagttctaagaaaatgagacccatcattagaacatgtttagttatagtggtcattgatacctctaattttatccacatcacatatatgcttactaatagaatataccatctttattcacaaatactggatattcgtatttgtgcagtgtataactagaatcacttgtattcgtataggagtaccattaacaacacactactagtattctttcgctctggatcgatggttatctttctttatcccttgaagtttgtgtaggttctctcttagataaggggcacctcctttttcttctcccttctaaaatgtacatgatagagcatgcaccatatgtttaaaaatctattgctaccttcatctgaaaaaatataagatgcaacctctgtctaatttgtaaaactaggatatgtgtctaatccggtcagacggtgctatattttaggatggaacgagtagcaaaaaatatatttctgtctattatatacatcaggtgcaatgtaccacacataaagattttttacgtgtaaatggctaacccatatttaacttataagtggatttgtgggttagccacatacacccttaggttttgtatataatggaagctttattgaactcaagagtcttagtacactcgcggcctctgcaccacgaaagtgcacacaaccaacaaccctacacacaactaagggaacacaagattgatcaaaagtcatctatctgaatactagaacaccactcatatgccgggggtaaaaaactccgtggccacctgctccaaccgaagacaagccgcaacagtaaagtccttcaaaataggcttatgaagtataagccaagcacagagctatcgtgtaattaagaagataacctgcagttagtagagattaaggttaaggagaaggactctagtgtacttaaaaaaatagaatgatagataattgacaggacaaacagtagttatagtaatatagacattatttttggataaatttaaaacacttggaataattatagctcaattggtttgcatttttgcttatcagctgcagtcaaaatttgaatttaaaaacttaattttggatttgattctgatattttttttattttctagcatgtacataaaagtgaaattatttcttatcgttaataaatgttacggcttataatcagctataggcgaaacaatgacaatgcctatacttgtgaagagagggatatatagcaatttgtaatttacatcgttgaactgactctagttgctatcgtcatgagaacaggaatcgtcaaactgccccactactaccgatctcggcaatatgaactccatggcggcggaggaacaagacacgaagcctttcttgtccccgaccaccaccaccaccatcccgccgcgagcccaccgtggataccagcttagcgcttgcccccaccaccaccaccaccaccagatgacggcggcggcaccggaccagcgcagtgcaggcgcaggagcggcggcagcagcagccgggcagcagcagacggcggcggctgcctgcgtcctgaaccgagaatccgatgaactgccggaggaagaagacggcggcgccgccacgtggttattggctcgtcaggcgcccgcacggaggatcagcaggagcttctggagcgccggcgagtacgatgcggacaccagcggcgcggcgcggccgcctggaagtacgtgtgtatacaccgcgatgcggatgaattttaatcgcctttaaattcttatattctcatcctgtgctcctctcgatctcgtggcagatgtgcagaatcgcatgtgcgtccacccaaaattcctccactccaacgcgacttcccacaaatggccattcggaggtaagcgattatttttcgctataaacgtgtaagtggttaatccacgaaccaatttatacttcaaatatgtggagcaattttacggtcattgaggaggtactatgaggcaccaaaatttagtgtaaaatttggtaccttatagtacctaggtaccaagaggtattaaatttacaatagaaaacgtgataagttatagtacatccttaaggactgtaaaattactcaaatatgtgggtaccacttatttaaacttctataaatgggaaatccacttatctgaagtgtaagtggatagtacacttactattggtaaatactttgtatctatccctaaactgaaatatcagacgattgtttctgtctttatatgtttttgatattcttgcagcggtggcggagttattggacaatgctgtcgacgaggtgattcaaacagcttattaattatgcatttcaataatttgatgatttggggatatatatctgattgattttttttgacagatcaaaactggtgcaacaagaattatagtggacaaagttaacggttgtaatggatcaccagctttactcgttcaaggttctggttactgtgacaatgttatattcgtttacttgattttgtataggtgcaaattttgacagtaataacagatggtctgaaatttcagtaatgcaacaaatgtctaatggcttggtcaactgaaattgcatccagacaatggacataagtaaaaaaaaaatgccaatatcaatattctctttaccttctctgatggacttagtgtaactacagaatttgcataatgttgcactgggaatctctttctgattgacttagtgtgaactagagtgtctgcttaacgttgagtatttgcttaatgtcaccacatgaaactaaatggctgtacatttttctgtttgtcatacagatgatggtggaggcatggatcctgattccttgaggcgttgcatgagctttggattctctgaaaaacagtcaggctcttcgattggacaatgtatgtactactatatcatatattcaggtttttatcctctccaaacttaacttatattgttatcttgtatattgacattcgttgatctgaccagatggaaatgggttcaagactggcacaatgcggctaggggcagatgtaattgttttcagtcgctgcatgaagagcaggtctagctagtctcatttccctatatattttttttttacttataccaacttgttgccctttccccccttactttcttacactttcttgtttttttttattccagcgagcctacacaatccattggtcttctctcttacactttcttggccgagaccaatcaaaaggatgttgttgttccagtggtatgctttgccatctgattttatcaattgggcacaacacacacacaaatatatatatagcgcttagccatcacttacctcttttactgtgattattctgatgacattttttttatttcattaggtggactacaaatacaatctattgacaggagaagctaaaccacaccagcggcttggtccagatcagttttcgtcaaatctctctgttctgttgaaatggtccccttttgcaactgaagaacaactgatacaaaatgtatgttacattaggtttctaccatgaaagaagacatttatattactataaactcgcaaattaattttcaaaaattttggagcttggaatggaactatttgtctgttatttctttcagtagttgtaagtaatttatcgtcaattcagtgtgctaatggtgtttaaaatgtggttacagttcagtgacattggtccacatggaacaaagattgtagtcttcaatttgtggtcaaatgacaatggtgatctggagcttgattttgatatcgatgagaaggtaagcaaaacatctaaaaggatttgacttcagtaaacttttaaattgtaaaatacatgcgtaattctgaagtttctttcacttctgttgaattactaaatagctcctgatctcttggacaatctttatcatttttcagttgctatgaaatgtctcattattttccatgtgtctttcattatatattgtatatgtttaccatattccttgttgttttcatttcaggatattttgatcagtggtgctccaaaggcagcagaaacaactaatgctgcaaaaagaatgaacgaaagtcatctggcaaatcagttacactattcttttagggtgcgtatcacatggtaagtgtttctgcacaatactagttaattgattttgctaatatatattagcattttgcaggtctatgcttctgtcctatatttgaaactacctgcatactttaggatcatactccgaggagaagaagttaagcatcactacattgcatctgatctcagatatacccaatgcattagatataggccgcaggcctttggaaaaaaggaggttcgtcttcaacaaaaccattcccttttgctgagttgcatacacattacctgttcacttctgtaacagtgtgaacatgtaatgtctaatacattccttttttcgaacgaatatgtctaatacatttccattctcaaagtattgatatttacttctgtgttgtttaaatcgtttcccttttacatccattttcttcttcaatttaggacgaggtggatacaaccataggatttctagatggtgctccaaacatcaacctgcacggatttagtatctaccacaagaatcgccttatattggtgagctactgatttcttttgcattcactatgtaaaaaaaaaaagaagaagagaagatgctttacgggcataaacatcaaaactaatcaattttcactcaaccacattcaagctatttttgcctaacatttttttatcttgtttaaaacaaaatgacctctttcagccttttcaccgagttttgagtagtgcaagtagcaaaggcagaggtgttgcaggggtattagaggcagacttcatcaagcccacccatgataaacaagactttgagaagtcacagctctaccagaagctaataaaccgcttgaaagaaatgacgaacgagtactggtacaactgctaaatcccatcttgtttcatgtaaatccaatacctgtttctaataattcaataattcatatctcatcattcaactatttcacctgtttccagggatctatacagtcatctggttggataccataagttgccccgtgcagcttctggctctcatgcttctgctgcacttgtgccaactctgtcaggcaccattgctactgcatcgtcagagaggattccagccatccgtgacaatccaacaaatgcaattccaatcgcctttgctccccatcttgtctcttcacctgtaggaacaaatgctgttgctgcagtttgctcccagtcccagtcaagtatgcagatcacaattggcactgatttagtagatacaagaaaaagaagaatggaaactcttgatcagatggatggtcgatcgaaaaggctgagtatacatgatttggcaggaaacaactctgtggactcgagcaatcaggttagcctagattactatgtttgtgcccataatattgaaaatacacattttttttaagaaaacagacaggagaactacccattatattaataaagtaatagtaaaaaaacttatcacaacacctgaacaccaaaaatatatgattgcaacctacactaacaaattacttggcacttaatgtttatccagctagactaattttcgattagattttcacatcttttttatctgacagtagtttatgcgctgtattgagatctaatgactacagatactacagatatgccagcatatgggagaacgggagttgaaggaattttcctacttgaagatagagaatacactactccgtcaagagtaagtccaacaacagctctcgccttacttccatcatggaacaatttttggcctaaaagtctcaggacttcattttgtttttttgtttcacaatttcatatgcaggtgtgcggaattagagtcatcagagaaggaactcttgctcaaggtgacattttttatgttgtgatttgttcaatcttactcactagtacactacaccaggtgcatcttggctaaaatcaaactgcactgacgaacttaattatttgttgtaccgagcaggaacaacaattgagccttgaacttgagcagacggaggcacagtacaagagcctgttgaacgaatacatatcggtggctgcagttaggacagtgaaacgatagacatccttggctctcttgccatctgtaaagacagatgtttgcaacattgcaaatggcttgatatctcagtaagcagatgaacacatccggcttctgcaccgaaacagcatggagttggcgaaaacagaccggatatggtaacagggtaacagagaagcacaggggctacacccagtaatgtgactggtgatcacttgtatcatccggtcagcaagcaaagctactagatgattggcctcttgtttcatcatctatgttttgatcatctgtactctgtaaaaatagtttcttgatcagtagtggtgatggcgtgaagctgaaagatagatagattgcattttaggaattttaagattctcacaggaatagctaagaagtgatctttgccggttcatgcaaaaaccacattaatcccggttcgaataggaaccggtcctggttcaaaagcccaggggtacttgttgatctatcgggactaaagataatttttagtcctgattcaatagttgtcaggccccaacaaactttagtcccgaatcatatctttaatcccgcttggtgagcaccaaccgggaaaatatcactctcccatgtcattggcatctctcgctctctctcttccttatctcgtctgcatcgctgctgcgcgcatgccgtcttaattcactcgtcctccttatcttctcctccactcctccctctacatcggcgtgcagcaggcgatggcgccctcccttccgtcgaaggggaggtgacaggcggcggcccacggctcgccaagccaccgagggctctcctcctccactcctccctntacgtcaaatagagggagatgattgtgaaagtaggtgaaaaattaaattagagatgattgtgattggtcaatatgagtaacaggggaagaaatatcaaagaaagtttgtaaaacctcttagcagtgaatttgtcagaattccacttatccccttctccatcctgtaggttaataagggaaatgtcctcctccaactccagatactcttcctaggccaaactgctcaaaggcagtagaaaacagtcatacctagttttttcttcttgttttatttataggggttccattatagctattccttctagtgaaacttctttaagtttcaccatccaaactaagtggatcttttgcatctgatccaaattgtctcaatcatctagtcaaatagaagtgccacatggatgcaccaaattggattcaagatgccactattgtgacagactgcatgttcatttaaaattaaatcaattatttcttcttttttttgcggggaaatcaattatttcttcatgctcaatatgcgtggtaaatacccaaatttaatacttcccttcaatcctatcctagtagtggggttgtgtgcccatggagtttgtattcacaggcacccaataacatattcgagcaggaatgcaagttacgccttgaaattgagcatgcggaggaacagtacaagaacctaaacgagagtacatatttttctaagaggacactgatcgaaatgaaaggcattctacttccacggatcttttgcatctgcaaagacatacctccgcaacctcttagatgatagagattttagtaagcagatgaaaatatccggcttatgcgccaaaacatgcgctcgtgacaagggagcagattatagcacagggactgccatagtaatatgcttggtgatcacttggctccttctgccaggaagcaagctacaagacccttctctgcttgtttgtttcatcacctatgtgttttatcttatgtttactacactactgcaaaatatagatcaaagaattgtgatatgtttagggagccagtttttgtgagatctgagactcacatctctgatatctgcaagtggtatgcttgcaacatttcatatgatgcatattcattaagcaacttaaagaatatatccagtttttgcgccaacacatgcactcagctaaaatcacgaaaataaggtaacatgatagcacatggactgtattagaaatatgattgcaacatggcaaggaacagagtttatatatttacactagtaatggtgaaggttggtgaccacttagctctgtgatcagcaagcaagccacgagatctacgggttggtatttcatccacacaatttttgtagttgtacgagcgcattgtataaagagttgtttcatgcttaatgtaaaaaagaagtttcatcatgagtaccggtgattgcttgaaattgaaagatagattatgtttggggaatttttcagattctcgcagggacccattgataaggtttttatattcaccaggcacgactgtttttttcttaaatgttagtctcttcttgtacaccttgattattccaagatttttgcaacacctatattttttatgattggcttctgggggttgacaagaaaaagagtaaactgatacttattggagcctctgccttatgttgggctctatggctgagcaggaatgatagggtttttgataaatcaccatctgcttcctatatgcaggtaattttcagggcaacatattgggttcggcagtgggcacaattacaaaagtgtgatgaagatggagagtttctgattgtttgcatgtcgtaggcttgaaacgacggttatgtaacttttttctaattatggatagagattcaccaataggctggaataatgttctccttgtcttgttcggttttcttctattttggtttggtgtgtttcgctttattttggactacactcttttaaagtgctagattgtaataattggctgtagttcttttgagcaaaggccgagatgtttcattctattatcttaaaaaaaaaagctaaacctcatcctctttgtcatgagtcaatcccatcgtctttgtcagtcccaataaaacggacagcctcccattgcttcatcaatggtgaacatgcgcggatgagatcctctggtcgccaccacctcgccttctcggtcccccctcatctgcctcttcacctttgtccctcttcatcaacttctaggatgatttcccacccaacatctcctcttctgggatcgggatcaggtgcagtccctatagagactgcaactttggcagtagccaatctgaaccgtttctgagagatcagacggctggctcacaccactgcaccaactagcgctcaaaaggtcgtcttcttcctccagcgatagagccctctttcttctccatgtcaatggaagtgctctgtgcttcttcttacctcatgacaacaagttgacaactacgggaccttcgtataaaccattattacgaaagtgttcaacctgtcaaagattccattttccgtgcttcatcatgaattcatgatcctcaaataagcctcccgcatcaatataaagtatcgttgtatatcttcttcctcctctgttcttgctacgttcttctgtgaactcccatatactaataagcaataatctgcacagtccctgtcaaacgccaaggcagtaattaacttgcgagcagaccaagccaacctcgcctcctcctcgttcgatacctagctaccagtccaaatcaccaccaaattaaccacgagcatcagatagctaacagtagctaagcagcgcaactcctagccttgagcccttctcacccgctgatacctcctccttgttggtgaccacgctccagtgccgcctccaccactccactcttgaagcccaccggagatggagaggactaaagggttgttaattcgtagacatcggatgcttcgtgcatggtcagatcaggtgctactgctaaagttgcagtaacaatagcacttttacctaatccgaatcccctcttctgcctatgttggctcacactgccgtcctgccctgccccctcctaagtcataaccacgtgggctcctaatgatgatgcccctgccgctagacccacactactgccattcttgatgtatggctgatgccacttcttgctgtcctaaatgtactatgtcaattgatttcaaccattaattagatttcagtcatactgtttagaaatggagctaatccatggatattcatcctgcattttcactaatatgttaagtagctaaacagaaaatcaacacacgaactcaggaactgatagatcaatggggattccaacgaattccaccgctgccgccgccgccgttcgtcgccaagttctattacttaatcgataatcaaaacagagattgcttcctccttataaatatatatctctctctccctctcccttacagaccagccaagggccaaacagcacacacacctactgagcccattccggcccactcatgcgtacattagctttacgaagtctttttcccctccctccagatgcttcctcctgcaccctgctaccattgccctgagcaccagcggcaggcaccttaacattcccccctccttgaaaactggcttgcccccaagccagagctctgggaagacgagtgcgaaggtcttcccaagtggcttcctaaacagcactgtcagaccactgaattaatacttgtggtatagcagaagtacctgatttgcgaactcgggtgtcgaggacagcaacaggaactttcttagtttccatttgagcaggaatcataggagaagaaacacctttgaagccttgggcagacttgagttgagagacatggaaaacaggatggacaacgcttccttccgataatgctaattgatatgccacttctcccaccttgcgcaatacctcataggggccaaagtatttaaaactcaacttgtgattagcccttgcagccacagaggattggacatatggctgtaacttgagatagacccagtctccaacagcaaaggatctgaaactacgtttcttatcagccggagtcttcatatattgctgagcctgatgcaaatgctgctggagcaattgcatcatcaacctcctttcagacaaccactgttgcacatcagggagttcacaagaattcacagagatacctagctggtttggagtatgaccatataacacttcaaaaggagtttgttcaagggtggaatgataagtagtattgtaccaatattcggccaaatataaccatgtagaccacttagaagggcaagaatgggtgaaacagcgcaaataagtttccagacattgattcaccctctctgtctgtccatctgtctgaggatggtatgctgtactcatgtgaagtttagtgctaacactctgaaataattgctcccaaaagttgcttgtaaagatcttatcgtgatcagagacaacagccaaaggtaacccatgtaatttgaagaccccttccatgtacaattgagctacatcggcagcagagaatggatgtgctaagggcagaaaatgagcatacctggacaacttgtccaccaccaccattatgcaattaaatctcctggactttggaagcccttcaatgaagtccatagtaaccgtttgccatgcaccagatggaacaagtaagggctgcagcaggccaggatacctgaacctgtctggcttagcttgctgacagatggaacactccttgaccttcagcttaatctgcttcttcatatcgggccaagcaaagagggtcttgatccttctataggtcacagggaagcctgaatgaccgccaatagagctgtcatgcaaagcactaaatattttgttctgaagggcagagttgtgtcccaaccaaattcttcctttgtaccttatgagaccatcttttaacttgtaaggagagtcttctagattttgtatagacaattgagccaacaacttagcggactttgcatcatnnnnnnnnnnnnnnnnnnnnnnnnnnnnncaggtgggtttacagattgaaatagccgcaacttccaatggttctccatgatcacaccgagacaacgcatcggcagccccattatgaattcctttcttgtaatagattttgaacttcaaacccaataactttgtataagccttttgttgccagctggtatgcaagcgctgatcagtcagattcattaaacttttatgatctgtgagtattaagaattcagcatactggagataggaccgccaatggtcaacagccaataagatggagagacactccttctcataggtggagagacctttggttcgaggacccaaagccttgctaacatacgcaataggatgcttatcctgtgataagactgctcctatcccagagtcacttgcatcagtttctataacaaaggttttgttgaagtcaggcagagccagaacaggggctgtggctaaggcgtgcttgagactctcaaaggaagtgtgtacctcaggggtccattgaaattcaactcccttcctcaacaaatttgtcaaaggcttactgagaacaccaaagtttttgacaaacttgcggtaatatcctgcgatgcccaaaaaacctctaagtttcttcaggttagtaggaacaacccacttcaaaatatcttgtatcttgctggcattagtggccactcctgccaccccaatagtatgcccaaggtaattgagttcctgttgtgcaaaggagcatttgctcagtttgactttccactgatgttcttgcagcaggtgtagtaccttcctgagatcttgcacatgggtgggtaaatcagggctatagattagtatgtcatcaaaaaagactagggcacactttcttaaaactgaagacaaggttgcattcatagctccctggaaggtggctggtgctcctgtcagtccaaaagacatcaccctatattcaaagtgcccaaaatgggtttggaatgcagttttgggttcctctccagccaccaaccgaatttgatgataccccgcccttaagtctagcttggaaaaataagcagagccagccaactcatccaataattcatcaattacaggcaagggttacttacttttgattgtgagcgcattgagctgcctataatcaatgcaaagccgccaagagccatctttcttcttcactaataatgctggggatgagaaggggctgatactaggctgtataactccagatttcagcatttcgtgaacttggtgttcaatttcattcttttgggttgggttgtatctgtatggacgaatattgactggcttagcacctggtattaaaggaatggagtggtcacaggatcttctaggagctaatccctgtggttcctcaaagacagatgtgaactcagacaacacttgttgcactggtttaggaatcgcaacaacagtaggactagtttcagtggtgatctgaaacatgtgcataagtgccccaactttgtacaagcctctgagttgtgccccagaaatcagccgacagttagccacatcagagtgcaccccttgaattctaatgagttgccccttgtcctggtactccaaccatttgtgcatccaatcaattttcataacccctaaacctgccaaccaatccattcctagtatagcatcatacccattcagaggtaacaatttgaagttagatttatagtatctgccttggagccaccaagagcagtcagggagctgtttgtcacactgtaagagtcctccatcaacaactctgaccttcactggtttggataactgtactaccccacgcaaatggccaatgagttgctcatctataaaagagtgagtgctgccggaatcaacaagcataagaagctcagttccctataccaagcccttaactcgaagagaatggttagaatcagttctattgcaagcatggagtgatatagttccattgcaagcatggagtgatatggtcattagtgtagtctcctcgggggaagaatcaggaactggaatcacaaagttctcttcttcctcagactggaaagcctccaataattcttccaccacatgcagttggacagactgggcacacttatggtccttactccatcgtttcccacaggtgaaacacaatcctttggatcttctataagatttcagagcagaaattttatcatcgcgagtattggttctgacagactcaggaaattttctttcctctccagggggaggttgcaggactcttgggaatgacattgacctgagctgttctagaaaaaactttgttgaaattagtaccctcagtcttcctataagtagttctcttactcccttccaagatttccttttgtaacaaggccacagaacatgcagcatccaagtccaccggcttctgtagcatcactactcccctgatttcgtctttcaatccatccacaaatttagttaagaagtaaaggggtgtgagagcattgtcataagagagcagctggtgcattaatccatcaaacctctccacatattcagccacactgctagtctgcccaacatgaaaccagtgccgtatcagcaattcctgcctatcccttgtgaacttacggcaaacccgatcacacaactccagccaagaaatccccactaactaatgccgcaccgattgtaaccagaaagaagcattgccagtgaaattcagcagagctaccttgacccagttagctggatgcaccccatagacattaaagaaaatctcacaattatctctccacatttgagggttctccccatcaaattgggggcaggacatgggaggaacattaccaccaatactaaccattcctgtctcaaaggcctgatagctagaattttctggagtaaagggactcaccgaattgaactgaggatttcgccacccatgaggagaaggggtaaacaggaacggatttggcgagttaccattgagatcttcctctgttgacgcttgatttggtcctttactgcttttccccttaaacagcatccgctgctgcacttcccgctagcacttctccaatcctgcctggattgagttcactttcttggccaagtcactcacagatccccccagctcactcaccttcttctccaccaagggtatgcgcgattctaccgccgccttcaacgactggagttcggccagattcagtgcatccgactcctcccgtctcctctccgtctcctccctcttcttctccgcatcctccatcattttcaacagcaaatcgagtttcccatcccgagccatgatttgagccgcttgtttggtggtatacctaggtcgctccaggatgaattcactggttccgccccgaacccagccaaccagatcaagggagccccgagagcttttgcggaatctcactgataaacagcgaattcccacctatcacatggaattttccggctggatcaagggattcaaggaaaccaggaagttctggagtggctctgataccaaattgttaagtagctaaacagaaaatcaacacacgaactcaggaactgatagatcaacggggattccaatgaattccaccgctgccgccgccaccgttcgccgccaagttctattacttaatcgataatcaaaacagagattgcttcctccttataaatatctctctctccctctcccttacagaccagccaagggccaaacatcacacacacacacacctactgagcccattccggcccactcatgcgtacattagctttacgaagtctttttcccctccctccagatgcttcctcctgcacactgctaccattgccctgagcaccagcggcaggcaccttaacataataatacaaggaatccaatttacatattcacactgttgtagtaaattagagtactgtttgtacaatacgttaccattgtgctaatgcaaacatcacaagattcaatactgtgcaaacagtatcccctgtatttactcagaaggccgaaattcatacgtcttagctactccttagtttgggaagcaggctgtgaaacaacctataaacgctctcacaagtcactctatttttatatctgaatttactattctgaacacataagtgtgaataatgttgttcattcaaatgattgatgtgctacaacgttaacagattggcttagtcagctcgagcttgtgatgcttgcagaccgaagtagatgatatgcagcagacagcaagcggtgcacgagacatcggttaatttgcctagctgatccggtgtcttttcttgtgctagcttatgcaagaaaactacacaaacagagagggattcaaagcacgcgacagtcgacgcagaacacaaccaagggaagtatctggaaatatgttgtgatgctcgatagatcgacgagcttggcgtaaggctcctgcttcgcacatcgtcaatgtatggctacggggaacagctctggcacggttgcacattcagcaacttgctgaaagaaaaagcaaaacagtatgcacggaagaaacgctaattactttaatttagaaaattcacatagagataagggagtaaaatggcaaaaaggaacaggtaaatattttctaattctgttgcatctaactacatgccatcataatgcatgaaagtatatgtatgtataaccctcttcccttaccgtgcacaagctgtaaagaacaattggaggttcccaatgcatctcatgcccagagaaaatctatggacttttgttaacactttggatagagctacagcaagaacacaacagctcaactgactgatcttgtttagatgggactaaaacttttaagtcctatcatattagatgcttggacactaattataaatattaaacgtagactattaataaaacacattcataattttggactaattcacgagacgaatcaattgagcctaattaatccataattagcctatatgatgctacagtaaacattctctaattatggattaattaggcttaaaaaaattgtctcacgaattagctttcatttatgtaattagttttgtaagtggtctatatttaatactccaaattagtgtctaaatacagagactaaagttaagccctggatccaaacaccacctgagagaggcttgggggtgggggtgggtgtgggtgtaaggggatatatatagatttattttgttcaaagatattgtctttagtatttgtaaactacacaaacaacttgcccttatatctatctatctatctatacctaaactaatcgggcacttttttggagctctcacgttaatcaggaagatcaagccattgattaaacaaaccataatatgtcaaccgttgattacaatctaatccaagttccacgcggtgggtcttttaaagccccatgtaacctatattgtcaagcccatcgatatgatccattcacgcacgcaccatcgatatgatccattcacgcacgcattcttttttctttttctttcgaacgtgggtatttgtttctttttctaaaccgatgagtccatccatatttactgagatcgatctgatcagatgcagtggaagatacgggagggcacggcatggccatcgtgccggccggcagcggcaaacgacggagaaaggcaggaggaaacagtacatacaagcacatcgtacgccaattatgttctgctcgctcggccgcggcaaaggcgaatatatcaacgttatcggatctagcagcacacaatcactaaggcgaggttgacgtgcggccggtgagcgccggaaaagcacacaacgtcagccgaatgctaattgttgttttctccattgttaaggtttgattctaacttctaatttccagttcaattctctttacatgcatacttctcaactgtcacagcgtccaataggaattaatctacgtcatcaccatactgtatatatttttgatgttcagatgtgttgattcagcatcaacaagttcgctagcacctgacaagccaatccatggtcatcgtaccataataattcatagaagtcttccatctatttgctttgacaaattcgctggcatttaggaagatccatagtggtcaccgcatgtactattcatgtaagtattccatcaatttgcatagtctgactttttatctgtatttgatctacttttactattcttcttatattcaccctctccttaaatataagcgatttcaagagattaggaatgaaggaaaaatgaagatagatttaaaaaaggggtgaaggggcagtagaacgatggttagggataagattgatcgaaaaatataaaatgagaggtggctttacaaagttctactcttaaatccattatatttgtggatagaatttgaagtataggatcaaaaatatttgtggatgaagggagtatatttgttttaaaatgtattttttttcctatgtgatatgaatttgctacccttattattatattgttaaaaacttttttcatatttatgttcaaaaatatgtttggactttcctaaactatccccgcaaaaaaaaactctccatatattatttagttgatttttttttataatggaatgtaacattccggcctttactcaaagagttacagccaattattacagaactcacacagaaagttcacgatagcaaaaacaaagctaagcaaacacaaactaatatacaccaacggaagaaaaagatcccctaactactgaaatctattagagaacctccactcgatattggcaaatagatgcataattatattatttagttgattcatcataaattttgtgttatacaggtggtcatgcaaaggcaaagggcatggaaaaaaacaatagatatgcatgtgcagtttttttcgataataatgcatgagtggaaaaaagcaatagatatgcatgcgttgcttcagtaatatacatgcatgcatgaaaaagacaaatggtgtgcagtgaaacatggtttattttcatccctattttccaaaaccatggaaaaaagaataatcccatgcattttgctgatcctactttatcctaacatggcacacaatgaaaaattattggacacggaaccaattcatattaacattatggtaggacagtacagcagagttcttgatttggctcctagaactaatccattaatatttatacgtagtacatggtgtcctcttactatatgttaatactatatgttatttgattttgatcctttattatgccatgttctcacgatatataagtatatatatgtgtatcatcctatatcactataatctgttgcatgcttcatccagttgaacaatttatattttcattgatattcattacttcagaaaaatacatcattcctctaacaaattcagatgaagtacttttcttttaatcaatgttgagggataaacatgactaaattgttttatttattattaatctaataatagtatattgggacattgtattaagaaaatatgccattggaagtcatactcaaaatgaattaaaaaatatgaattttatcgttttaagtattctattgattaggaatcaatatttaacaatgtatatttcataaaaactcttcttttaatataatctaagagccattgtaattagaaaagaccacatattcatacataattaaaattttaatatttatgatgatatgacggctagtctatactaattgggtactttctatactaattgggcactttctatgagctctcacatttaactagaaagatctaaccgttgattaaaaaattattatatctagatcgtggattaatattcgaaagccatgggtttctaaagcccaatactattgttacgtttgggccaccatacaatctaggttataggcttcaaaccgcccttgatttgttgtgatcgtatcaatccagcaaatctagattataggattcaaatcgctgttaattagttgtgatcgtatcaatccagcagagggagagagaacgacgtagactcatctgcacgcgaggagatggcggcactgaaacaatccactctattactcggcactgaaacgatccgtataaaatttcgggtacccgaatttctcccaaattaatatggtcgttttcacccctagccataagggaacgtatgatcacgtcagagtcaattcaaccagaaactcgagtcatccatcctcttgagccagtaatgtttaatttatccaccagatttgattcagacatactttatttgatttgaacttcttttctcatgcatgttttgtcatgcaagatttgattcgaacttcttttggtttctaattcagttgattgtttctttacaattttctcatctaaacgacaccgattagtacacaagttcgcttgcaacataaaatgactcaatccatgatcattgcttctttgattcacaaaaagtatcatgttgatttgcaaatttttttttggctaatttcgctttcatgcatgtaggaagattatttttgccgttccatctacaatccatttaggtgttccatcatcaatttttactgttctgattgatatgtctataatctaactttgtctgttccaggatatacacaatctgtgacagtatgctctcaattgagtaagttcaattataaaattagttaatctatgacagtgttatgacagaggtttgtacatggtggggttgaaaatgtttccgtcttctaggaccgggacgttcccagtacgaggaacgtggatcaataccggccatctctttcgactatgatttcggctctcaacaaatatccagtgatcagaaggttagaaacaaattatgccgtgacaaagataaattaataactgatgatcacagtaaatcattcagagtcatgtttattctttagatacattactgatgctttataatcactgaaaaggctaataacattatctatctatataatattcattataatccacagagtaaaaccataatttatttatttttggatattctgcgaaagaggtacaatactttcttatagcacttcaaatttccattacctactagatttgcatttatgtatgtggcaacaaattttaataacttagactagaaaagagctgatgccggataccttcttagtagatattcatgacgaaaaaggaagattctatagattcatatacaagttttttatcgctaaactaaaaaaaatatagagctttataaaaagaaacagagggagtagaaagtatcctaacaaatattaggatggattgtaatttcataattactaattgtgatttttgaattataaataaaatgatattttttcttctttttagcttcaaaacatacatatgaatttcaacaaaatattattaatcgatacatctaatatatgattgtatttttaatattcaaatatcagattggctaagtctgcacgatttcacgagatatgattgaatttatttaggcaaaatactagaagttttagaacaagcgtgagcgccagccatatttttatcaaaccaagtaggtaatggtcgatctgtctagaatcataacagaagcacaaatggctgtgcttgtatatattcccagcacttggtcagtatttctagcatgctgatacttgcagcaggattaataattattttagtaattttatggcacaatgtgtttcgaaacactgaaaactgctttgccgagaaaaatattactggcaggtgagtcagagcatttccaagctggtagtgagagctgtgtcagccggtttctcaaagcagcagtttgtcactcgagggcaccagggctgtgtttagattcaaagtttggatccaaacttcaaacttcagtacttttccatcacatcaacctgtcatacacacacaacttttcagtcacatcatcttcaattttaaccaaaatctaaactttgaatccaactaaacatagcccagatcacagatcaaacatgggtaaaatgcgaaatgtcgtgacagcactacgtcaaccaggacttcaagaatgccagtatcttgttatttgcaacagaatcaggtcccagtgacatggcagcttccatgatggtaccgataatcatataccagaatagtccgtagagacacttgtctagtgatctcgtgatctctgcaatgtttttttctcatggatgacccaaagatactgacgcctctgatgcctatgttccatggtgggtattatggcacttgcaggaagtattatcatagttcgcaagctaagttggtaataagcactatggcatggactgaaacaagtggagcagtgaggggatatatataatgaaccttctcgtgcatatgtagaacacaacaagatgctagatacattaaattttgatggtggaatgtaagtttcgtatcaacaaaattgaattagaacattaaaacatttggtacaccagattttattacaatgacagagcaagacacattgaagatgcatgttatattatcattgtagatacatgcatatatacaacatgcttagattttttataagcatggaagtaataccggagaaaaaaagtagtatttatcaaatcttctaaatatgcatcatcctccaaagtccatttagtggtttagttatattaactatatatagagagacttactacatggcaaccaacgtgcacgtaactaagtaacacacttctctagtaacttttttttttttactatcagcaaccccacaccttcccccctctagcatgtgcaacccaacgtcagtatttttttattgtagcaacctagcagtataaccccaaggagacactgcttctaaaagcccaagtatttttttaccattgcattccaccaacattatctcgtatttatatttatcgttaccggctctacagggatggctagcattgcgcctccaaatccacccatcgccctgcacgtaacgaagcactgctatgtggcgctacatagcatgcatggagctatgtaactacgtaggacaactcacaagcgctctcacctccgcacccattgaagaggaaaaaagttgctcggcattgtttcagtctccttcagctcccacctctgtgtccccaaagggtaacaaattttnnnnnnnnnnnnnnnnnnnnnnnnnnnnnnnnnnnnnnnnnnnnnnnnnnnnnnnnnnnnnnnnnnnnnnnngtcatcaaacaaagcgg

SEQ ID NO: 6864 - DNA, 7705 bp, Oryza sativa
  unsure (1)..(7705): unsure at all n locations
cgcggagtaacatctnnnnnnnnnnnnnnnnnnnnnnnnnnnnnnnnnnnnnnnnnnnnnnnnnnnnnnnnnnnnnnnnnntttttactaacatgtataacttcacatccaccattcagtaacacctataacttctgtatccatcatttagtgagcttctgaacaacacatataacatgtatccatcatttaatatattttttttgttaacacggcacttatttgtttaggttggtcaaggataaatcaatagcaaactattaactccaagagaattaatgcaccacccaaccctcatctggcagggtaaatatatctactatcccaaagagcttccattctccatctattggattcaaagtaaaaacaaaatactcctcaaatgctggtcaaacaatccatatgaggggaacgcggactattgacatagtaaaaaaatactagcatgctaggtcagagatgcaacgtaagagatgctacgtaattaggtggcacgtagtgtcacatgtagtatgtctctccctctatatagagggagacttagtacatcgcacctgtcatgctacgtagctacatagagcacccctagtaattttttttaatatcaggaaccatgtaccttcccacctctacctcatggaccccacaccaacgtcagtaactttattttactgtagcgatgtaacaatatataaccccattgtattccaccatcgttatctgtatttatattcgtcattactagctctataagaatggctagcattgcgattccaaatccgcccatcgccgctctgcatgggatgaagcagcggtgccgctccaaaattgtgctgggcaatttaagtacttcactgaatatgcaattggtcaatttgatagtccctccgtttcacaatgtaagtcattctagcatttcctacattcatattgatgataatgaatctaaacacatatatctatctagattcattagcatcaatatgaatgtggaaaatgctagaatgacttacgttgtgaaacggaggaagtaacatatatagacttttatatatgttcgtgtggttcacacagtcttgttttggttcaactaatattatgattttaggtaaatgctagcgcgtctgagctatcctctctggtctctgccttaactaagctgaaaaataatggaattttttaatgaacttatataatgatcgataaatcattattttccgtaaataacgaatggatttttcacaatcagcgaaatgtgcgtacaagaagagagcgagtgcaaactgaaacattaaccgaaataagcaatcccttatttcattaaaaaactagttccttagttactatcttatagcttaattatatggagtgacaaacaaggtgacatttgagagttacctctgatttgtttctaaaattgttaccccttgtattccttagaacaagtgcaggttactgaggaatatccacctatcactatatttcaacattttcagtctacccaaatttgaattcgttaatctctctttcaaattcttctagtctagaagccgtgcctcttctctctgctcgcgacatcctgttcctcctttcgtctcgctctgtcactccctttccatctccttacatgccaaaaatcttcggtacaagttagacttcgtacaaacttagggctcagagcctatttgttgaaccagacctcttcttctttttccctaataagcattcatagacagtgtgtatcgcagaactagaccatatatacatactgtcaaatcattatatcattatagttatgcacaactcttcgtcgtcctgtaactatcctactctctccggttctataataactgacgttttgaacaagattaagatcaaactttaataactttaaccatcaataacttcaaaaatatttagtttaatttaaagaaactattatatagatttgtctttcaaaacactataataaaaataagcatgtatttatttattgtgtatattataatagaaaaataaggtcaaagatatattttgtagaccgtgtcattgtctaaaacgtcaattaaaatgaaaccggagggagtatgttgtttcatgctaatcaccactactacatcagaacctagaggaacaagtacatcttccattgcagattttcacaatgattatgaaccatacgcttcataattgttgcttactgcaggaataaatgctattggatcattccaactttccgatgcttctcattcctatccagtaattcaattctctctactatcggagtgcacatactgttctaatccccaagctcgactagcagacttgagttttgaaacaagagtcgagcatgcatggagggacacacacacaaacacacaagtacctactatacaccaaagcttatctttgggataggtatgaaaaataaactgacaggaaaagcatatcaggcacggtggttgaggtataaatgcatcactcgatctacacagcgttgataactactccctccatcctaaaatatagggcgtacctgccctggacgcgaagactaaggatgcctacctgttttactcatcccaacgcacagcacagcgcttcgcttcacgcacgcagttgtgctgggagagagagaaagaggtttttttaactagctagtcttgcatgtgaggtaacgggagttgaggaggtgagtcttgaatgcttgcatgcatatgtatgggaacgaggaaaaattcaatgtgtggatgcgtttaaacggctgccgaggaggtgccgccttatattgtgcgtgtactcacaattatcacacatagatacatttcaataaaaatctcgtagcattcatgtatttatccgtgttgtatagttcatctaatcagatgggtacatcaagagtgcttgcttgtgatgtcttccatttaagaggaaatggttgagaaatacccttcttttgctgattggtggccttgaacctgcgttagaacaagataggctatgtttagattcaagggtgtaaaaatttaacgtgtcacatcggatacacggatacacattttaagtattaaacattgactaataccaaaaccaattacaaaatccgccttaaactgcgagatgaatttattaagcctaattaatccgtcattagcaaatgtttactggggcaccacattgtcagatcgtggagcaattaggcttaaaagattcatctcgcaatttacacgcaatctatgtaattagttattttttcatttatatttaatactccatgcatgtgtctaaacattcgatgtgatagggtgaaaaattttgctagagatctaaacaggaccatagtggatggttgttccatcgttgtggaacatttgtaacaatgtatccttgggctttgtatgtcattagcacgtacagtggttggtttttatccgttattaaaaaagcaaaattaatgcacatgctgcagaagaaaagcaatgcaaattgaaccatctatccaaataagcaatccttattgtttttcttaaaagcactatagttacagtattacaggaagagacaaacatggtgacatttgaattacctctatttatttttctagaatataatttgctgcccctgtatttctctgaaaatgcacaaatgaccaagaatacacgttaacatgtctactcttggcaactatggatttaccattcctctctcttcgaaattcttttaatctcgaatgctagttgtctcctttcttttcacttgtcatttattcatctgctcgttctatacactctcttgactccctcttccactcctttttcgccaaagtcaagtaattggagacttctattgaaatttagatgcctagatttttggtaaaagtcagacttcctggaatatttgagctcaaaaccttgctagaataggtgttgaattaatgtactagtcctatttagttatagttggacttggagttgtaataggtggtaggaacggagttagagtcgaactctgtaacctgaccgcaaaatcaaagtgtgtttgattcttattctgtgatgaacaattggcatatgtggttattagttttgatatttggagatgattggttttgcaggtgatgaacatgagataccactgactatttggacttgtcagactgggcaggtgttgccagtcagactggagctatgtgagcggtcagactggctagcccaggtctgatcagccgactctgtgtcagtttcggtttcaggttcatttgttggatatccgtggataattcatatttatgacttctagatggatactatgcgtatctaatactgttgtttgctaacaatgagtcaagttggtgagaacttgtgctcggatatggtttcttggttgatccatatgtaggtgatcttgatgcctcgggagagtgttgttggtgatggatcatgagtcaacttgggagaagatgacgtccgaacgatcaggatatcatgcgggatgtttaggctaaagatcaatgcacatggttggtgaagatgccatatggcatatgatggagatattgtgtgtgtatgggatgcggagccgaatttggaaggagtccaaatttggtataattggagtttgtaaagtttgtttcttgtacgggaaggtttcctaggagattaggacttcttgtacaagtttggttcgtggctttaggctgcctaccttaggtataaatagagagggagggtgtggcctcccggtatcgctttagagcgagagttgagttgacagataagttagggttttgagtatagttaagattttcgtgaggagtgttgttgttgcactttgtaaacacagatagaaataataaagtttcaatctactttgtgagatcttcgatttatgtttgcttgagttcggcggtccaaccggcgggacaccaacgttcagaccgatggcatcgcaccggtcagactgacaagaacacagtagttagaccggcggcagcgacaggaggcataggcgattgcagggcagttagaccgggcgatcaacaccagtcagaccggcggcataggcacgatcaaaccggtagatcaactacgatcagaccgatctaaatcggattcgagggtaacttttaattttgctaaaactttcaacgcagcataggcgtcgcgttgtcaacggtcaactgtacgggtggagtgggggcggagctagcagcgatgagactcgtacgggtgctgctggtggtgtccatggcaacagccagccaccctggcggccgccacgccgaggtccatccccgcctccgcctacctcctgtccagacagttgtaacccttctcctcgtcgcaccgcagtgccctcccggccactgccgagttggacgctcctcgcctcgctcgcctcgacagagagagaaacgagagaggggtgaggtagcctttattattattattattattattattattattattattattattattattattattattattattatttttggattggtttgctacgtatgacaaaaccgctccagattgggtcaaggcagtaattcatctgatattaatggttgagggtgcaagatgtctgttttcggtttttgggtgttaattcgtactcacccaatagtgcagggggtaattcagacttttcgcttagaaaaaacttttgtaatgtttttacacagaactattttagtggagtacttaacccacaaggtagcattgaagcttttacgcagataactattttagtggagcacttaatctgtaaaggtagtattggatcaatctaatcccttgggtataggaaaaataagatcattttacgtcctaacgatatttatattctttttactttttttatgcttctctacatacaagtcataattcgctttgacaaatctaagatacgaaagtcaatgataattaaacaaattcactaaattccatgacctgcttgtataagcctctaaggtgtcaatacaaaatcaatagcatttcttataattatatgattagaaatttccacctaaaatttaattttaagactcattatgactaggtttttttcttaaaaatactgtagggtcctacctgtaagaacctctatatatctatgatatgtatatttgatcaattataaaaaagagatagctagaaaaaaatatttatgagcaattaaagttatttttaagaaaaactaaacaatgaacattcaatttagaagggaaatacctcactttaagttaaacttattttgttagacctgttttcaaagtaaaataacaaacatgtccgcgcgaatgcgtatgctacgtaccttgtttgtaaaccaaatggtgaaggcgggatggataatatatataggtgaaatgggtgatgcgcaaacggatctagcttgtgccatttcttgtactgtgtgttcatgaaaataaagagagtaattggaaattaaagaatcaacttagatattgttgtacgaaaccaaatcacagcatgtgaggaacactgacgagggtcgacctgcaactgcagacctatattgctccctcttctccctcttcctcctcctcttcttctctttttctactacagtacaccacacaaattttttttaaaactaaaagttagaaaaatttatatatagaaatactatatataaaaaaattgaattcaaattcaaatttgaatcaggtatataaacttttgacttataaactttgggtctataaactttaggtgtataaactttagatgtatagaaatactatatatagaaaatatttgaattcaaattcaaatttgaatcagatataattcaaattcaaatttgaatcgggtatataaacttttgactttaaactttggatctataaactttagatgtatagaaatactatatatagaaaattatttgaattcaaattcaaatttgaatcagatataattcaaattcaaatttaaaacgggtatatagactcttgacttataaactttaggtgtataaactttaggtgtataaactttagatatatagaaatactatatataaaaaaatatttgaattcaaattcaaatttgaatcggatatataaacttttgacttataaacttttggtctccaaactttagaagtataaacttgaggtgtataaactttaagtatataaatttactaaaataggaaagtaatgcggtgccaaaaaaaaagaaaccaggtagaggggtggagggagggagccagggagggaggaggcgatcgatcgctgatccatccccagagcgatcgatcgccgaacaggatttccagtttgttagggtgtacagcgctggtacggtcaaacagcaagtctcatgaagaaaataaaaaacaatatgcatggaagaacattgataacttccatttaggaaaacaaatgagatacagggagtagaaagtaaaaaaggggcagtaaatatctgtcaagtgctatactgacatggacccctttttattgaaagcagatgctttgacttaattacacatggagttaatcactgacatgtagatcccactttgctatggcccatatatcaatgcttaaactggataacagcttagtgagagaataccttttcttttattaatctagtggcacaatggatctaagggattatccaaatttaacttattaaaaccatgctatctttacaan

SEQ ID NO: 6865 - DNA, 1763 bp, Oryza sativa
  unsure (1)..(1763): unsure at all n locations
tacaggtaattttctttatcccaaaaaagatcatcaaatcaaaaaataatagaatgtaattgcaatattttgactgctgtttactgtttgcacaaagttgattaaacaaagtgctgagtttgaaacataggacttagattactagccaataattgcctcctaaagaagtgcaaataataacacatggacttaaagggtaatcactaaatagcaaagatgacatcaatggtcccagagttccatctacgtataaggcagaactaaaggcatgttacattagacaagtggcaaaagacattcctcagcatttactctaaaaattcttgataccaagggacttcggaatagagtctgacagagatttgagcacatcaaatgaaattggcaagaaccttgctcacagtaaagatattattagaactggttaagtaatccagattaggtacagaacctttgcccacattcatcatgcatgcaaacatcagttcaataaaagaaaagacatgtatatataggctatataaactttgcatgcatacagaacacagcatgaaaaagataacgtttctacttcatgagatagcaactatattgtattctgtaaaacatccaggcattgcaatggagcattgtataacagaagacttaagcataatgagaaacgttgaacagattaactttcatgccacctaaattagagattgtcgcattacactgctacttgtaaagataatgacaaagatacatgcagatagccaccatacaggtcagcacccaggtcacagatgaggcatgtaaactactgcaaagggacaggacatgcctaaaacctacacctaaaaggattctgcagtttgtaatctagagtacatacagacaattactcagaccaaacagctgcagagcaacctacaaagccaacaaattttagaatttcattgtcttttaccttatggtaacaaacttgtttgttccatgcttcgcccagaaggtcttcaggtcaatcggattattaagattataaccttcaccagnnnnnnnnnnnnnnnnnnnnnnnnnnnnnnnnnnnnnnnnctcggattttctttttctttgagaaacctctggattcatatcatcgagtaaatagctgagaaaatctcatgtacaaaataaaaaaacatgtgtgggacagtaaggaggaacttaatgtcaatttattaaggcattgtttagataaaaaaatttggtcaaaaacgtcacatcaaatgtttggacatatacatgggacattaaatgtgggaaaaaaccaattgcacaatttacatataaattgcgagacgaatcttttgaggctaattacaccataatttgacaatgtgatgcgacattaaatatttgctaatgacggattaattaggcttaataaattcgtctcgcagtttacagacggaatatgtaatttgttttattattagtctacgttcaatacttcaaatatgcgtctgtatacttcgaaaactttatgcccaaacaactaaacacacggccacaccctaaccagggtgaaagcgtccttggagaaccaaaagcagaccgcgagcggtacatcgatcaatgtacaggcccaatttcagagccaaaaaatatatttgatttaatatactctaaaaaaaatttaaccgacacataagcatttttatgttgatacgatatggaaaacctttacagagttcagacacatatttttatgtgcaaataatgtttaagagtaacattattgg

SEQ ID NO: 6866 - DNA, 956 bp, Oryza sativa
  unsure (1)..(956): unsure at all n locations
ncgtggctgccacgcgggccggcgggaggtagacgacgacgccagccggaacggacggcggacgacagcggcgagcggcggagcgaaccacggcgatacaggcgaaagcgagcacaccgggtggtcgcacaggaccgggggagaccagccaatggctcggattcgccggagggagtgcgtcggcggcggattgcggcggcggcaaccgtcggcgagggaagggggaaacggcgatgaggtcacgaggggccaattcccgacggcgagggcatctacgcggctacgggaatccgatgctagcgttggattgggcggagctgcgccgagcgaggccggcgacgagcggcgcttccgagcttgggcggcgacagcggcgagcacacggcgagcggcggcaacggtcggggcggcgccggctagctacggggaggctactcgagctactacccgagtctaaggggaggagatggagcgaggaggaagaatggagggaggcactaccgtgcgggcgggcgcagtgacgagaggccgacggcgcgggagtaatctctccggcctcggggcagggaagaggaaggagagggcgcgcccggagtccccttccgcgtccttgctcgtgccggctcctccgacacgtgcaacgacgaacagcgacggcgaacagagcacgggaggcggcggcaatggcgtggaggcgaatgggagaggaaaggaaagggggaagcttgggtttataggagcagcaatgtcggtttgggaaccgacttagggcggtcaaaggagagggctagcgctcggcagtcgtggccaaagcggcgacagggaggggggaggaggatgacgccggcgggaggaaaaaggggaaaagagggagagaaaagagggcttgtcccttgcctctttggggtnccgacctanntttcggcctgtttgatgcagtagtcaatcgagctcgc

SEQ ID NO: 6867 - DNA, 730 bp, Oryza sativa
  unsure (1)..(730): unsure at all n locations
tgggcccttgaattccatcatatannnnnnnnnnnnnnnnnnnnnnnaatgggaatgatctgtttgagattgatggtacacttggcatctacttctgtaatgatgatgcgacgatcgtagatatttgggtactgcaggattacaagacagaattctggtctctcaagcaccggattgaattgccagtcccagatataaaggggaagcttgatgatggtgatgattggagtgcgatggtattgtctgaggacggggatgtgcttgtgctggtttactacagacaatggctgctttacattggtactgatggcaagctgttggcgagttttcaacatgatgttgggtgccactacaatactcctctgaagcttaagcaaagccttgttccacatgcattctttccattgttaaagggttatgtcgtgaatgctcgacctttcatctgatgctggagcggctttgctagttgttggactcgtcttgagatggtttcttttcatcctggtgggtagcaacttttggtgctgtcttttagaggttgtggacactgttatcttgtgggatgtcaccttgctaaaatgtactcaaaccctgctgaactatgtaatatgcagtagctggtttgccaatctttttcacaaaaagagaaaaaattctgatgtctgttggataaggtggagcttcctgttaacatttgtttccgattccctgagtgcttttctattttatn

SEQ ID NO: 6868 - DNA, 739 bp, Oryza sativa
  unsure (1)..(739): unsure at all n locations
ctgcggcagttgagatccgatnactatannnnnnnnnnnnnnnnnnnnnnnttaagcttgaggacatttcaacctgataggctcatgtcaaaccaaccgttgaaacaaatccgaaattaagtgattaccagctagagtgacagctaaaagcaagctcaacattgcaatggggaaattgcgattagggaaatcttgcccgtgattgcaatttcggaacaaaattttcaaaattttgccccctctccaccggcaagcatatatctcacccgaaatttctccttttttcatgtttttgtgaatttggtcaaagcttattctaaatcattcaaaattcatcaatttttcaaataaattcagtgattttggttctttcgccccctccccccacggaaaaaaccccaatttctagaatgcaaaccctgaatattgcagtaaaactgcagtgaaatacttggtgcacaaatgtcattacgggtggcaccgcttcaggttttttttttcttttgcaaaaaatttgagagcattacatcacctgtggcagttgtagattgatgcatccttccgctgcttgtactcatggttctgttgaaccttagcttgctactgcttacaattgagcaaagcgtacctcatccgagcttgctatcttctttaactcgagagcacttaaattagtggtattccctacggtgtttgccagtaaattagaattagttaactcaaacagtacatgatatat

SEQ ID NO: 6869 - DNA, 1793 bp, Oryza sativa
  unsure (1)..(1793): unsure at all n locations
atgcaacacgaagttggaaccagcagaacgtttatgaagaagagatgtagttgtgtgctacgtttggttgttatttataggggatggcaagaagctgcgcaatctcaattattagaaagagacgacggcgcgtcggactgctagcttcagactaatcaattcaatagcgtcggactgtttcactcgtgaagttaataattacaaagcaacagcatcactttcggcggcacatgctgcataactgtttgctttattaattacaaagcgacgaagtcactttcggcgcagcgcaacggaatcttcaaagtttaattgtgaatgattttattctctgtggcatgtcccgtgattggaaagagaggatgccattttaggtgcgtatcattgcatctctgtgaaaagaaattactgggtaatttaagtcataagtgggtaatttaagtcatattagtaaaaagtaaaagtaatatgcaattttaaccgcacgagtaacatcgaaactgcactattaatttagtttgtgagactattattttttgttagctctcgtacgaaaaattattagttaaccaaaaatcatatgtgttaactggatacaaaatagggcataaaaatatgagatatttatgaactacgaaacatcgtacataacatgaagaataagcagtacaaaaaaataatgttcattgctagtaatagaaagccaaaatcacagcaaggttcagataggtttgccaggtgaactgaaagacgtaatgttcacttctactcgtcatcatcatcatggtcagtcgtagtcctagatgttccagctcgcttttttgtagttttttttcttgctcgtgcggcatgtcgagggcctgagagtcacagacggtttggctcatggagctcacggttagatctacgcgggtcattgtcgtttccttcgccaacctcttgttgtgtgggctgtgtcacatggggcgcatcatcaatttgtgaagtccgaagctcgttgggtaccgatgacgaccctcccccgaagctggacatgtcgccttatgatgcagtgtaaggcctaaaccctgacattagtttagggcgaaatgaccctacagaagcaatgtagatatcaatgaaattatcaaagctgtagcacgcaacaataacacaaaaaaaatccaaacctgttgacagtgcttgcatatatggaatttcattaggatgcgaggaatattgaccaaatagccaatcaccttgttgcaagaagtccatataaccctgtactccaccaccaaacgacgtgccttgcatccatataaaatgtcacggagttattgtcttaagttgaagtgggagtcatgtatggcatgaaagtgccatcgatatatgtgtatggagaatgatggctgagcgtaccaccgtaatccatggattgtccttgccatgggttggtgccatatgtaggtgcatgcagtggaaccgactgagtaggccctgttaatatcaggaagtaaattgtcaataagattcatatacatgcaaaattaataaattgaaataataaaaatatgaaattagatgtaagtggagactgaccgcctaacgacgtaaaccctccttaactgataaaatctgcagacaattggggtatggtagggataccttggctagtccctgtatatgcaattaattagcaaaaagtaaaattacgagtggacatatgcatgccaatatggtactgaatgtacannnnnnnnnnnnnnnnnnnnnnnnnnnnnnnnnnngaagtgcaactaaaangcctctcg

SEQ ID NO: 6870 - DNA, 841 bp, Oryza sativa
  unsure (1)..(841): unsure at all n locations
tcctcgtctgcatgcgatatctttgattggctcatanccntttctcntgttcgctcatatagattgactccattactccgtttaaaagttctctcccatcccccccnccccgggggcngtgagtaaacaatatcaataannnnnnnnnnnnnnnnnnnnnnntgaaggcattatgcacaggacaacgatgtggatgaggacgaggcgggccgcggcgttgcaacaaatgtctaacgcacaaacacctttctgcaaaaagatggcagagtacctccaagagaaggctaacaaggcaagatttctcacggtcattaccaatgggaacgtcagacgaaggtgggaagtcacatgtcgcactaaggggggttttggatcttctactggggtcatcactcatgaagttactctagggcacgaatctgataacaaatgttcgtgctcttgcaataagccgaagcttcttcataagccatgtagccatgtccccggccgcgtgcgctaaaattaagcttgattcaacatcatacgtgttgacgttctacctaaaggatagagttctgaatgcatggagtgctgagatcctcgggtggaggtaccttcaacacctagtcgatactaggggtgataaaaggatctatgtgccaaacttggatttgttgaaggctggtaagggtagaagacagacatgacgcttaagaaatgatatggatgcattcgaagcgggaaggcctgtgaagcgatgtgaggactgtcttcagtacgggcaccgcactaaagattggaagaataacatggagggtacatcttaaacatgggacctaagcaacaacgtgccaggagg

SEQ ID NO: 6871 - DNA, 743 bp, Oryza sativa
  unsure (1)..(743): unsure at all n locations
gcgtgccngttaggtctcctatcatatagggcgaattcgagctcggtacccatggttagtaattataactatattgtaaccatataaataattataactacataattaagtaattaactacttagagctcgaacctagactcgttgatagccctactccattgggtctttaacaatttctcaagcgtggatagaagatacatactgaaatgtatccatatatctctataatctctgtggaaagaaagaagagaagagagaagcagtcatttggattattttccgttcacaaactcacacagccacattgctttacgcggaaactagcttgcggaaactaattcgcaagacgacacaactttatactacgtcgctagtcttcatgcatcccatcaacacgcgtccacttctgatcatggaaaaaaatgggaatacggccacacggttgtccctttgcttttcttccatattaataataaattaaaaaactatgatttgaaaaaagcttcggatcggtcgactcagcaattagattctcatgcaaccacgtgcttcctattacgcaaattttgctatcggatatcggaacttcacggttgatatagtataccgcacaaagtaacttttagagaagatattgtataaacgtgataatttgtcaatagacaccataccgattaaaataataattcgcggttaatgaggagagaaaaatcgtgtgaaatgtcagatatacccatggcn

SEQ ID NO: 6872 - DNA, 740 bp, Oryza sativa
  unsure (1)..(740): unsure at all n locations
tgctgggctttttgatcacgattcatataggccgaattcgagctcggtacccccaccgacgccgccgcggccatcgccgtcgccgaccgcatggtcgcgctcggcacgcacaacggcaccctccacatcctcgacttccagggtaatcaggtatcgtacccacctctttcccttcacgcatagctcgtagggcggtcgcttgctttgtgggattgggatttctggtaggataccgtggaattggatcgtctcgtctctgcgacctgtagcattggtctactgaattcgatttggttgtagaaaactgttaacctattgtttgtggaagagacgtcacaaaggtgaaattctgtttggggacacctgaaatatagattttgcagagaatatatattttaaggattgtgctagactgaggaatatggttcagtgtaaaatgttttcacgttgttggaggggattacctctggtgacctaaaaaatctaggaggactaggattgtctgctaaatatcggatataaccaagctgaggtggctgtgcatttaacaacattgacacagaaatttcaataaatggagattgcccatagcttccttcggcctgaaatcatgtgatggagcactatcagtaatgaccatggcctgcttagaaaataacattgtcatccattaattcaatacttttgcaggtaaaggaaattgctgctcacacagcaactatcaacgacatcangtttgn

SEQ ID NO: 6873 - DNA, 6909 bp, Oryza sativa
  unsure (1)..(6909): unsure at all n locations
atggggnattgacatgcttctnnnnnnnnnnnnnnnnnnnnnnnnnnnnnnnnnnnnnnnnnnnnnnnnnnnnnnnnnnnnnnnnnnnnnntcctgccgctatggtccgttcgatcacgcgcgagggactagcgtgtcccagcgtggctgctcttccaccatgcggagatcgttggatcagaaacggacggcctagatttggcaagaaccctagccacctcgcgctcgcctctcttctcgctcgtgctgccccaccctcctccctcgtgcgggtcggcgcctcgttatattataaaccaataggtatatagttaatttaggctgtgttcttcccccaattttcccaactcatctctcttgtttaccgcgcgcatgcttttcaaactgttaaacggtgtgttttttgaaaaaaaattctatacgaaggttgctttaaaaaatcatattaatctattttttcttttaaaaaatagctgatacttaattaatcatgcaataacacagctagttttatttttaaacttgtaatatttattcatttaaaataaaacgagtatcaaaagttctacgggaagcaaacataataggtttgtctatttgcacagaactttcgagcaaggacgaatagtcaaacgtactaaaaaataactgcatcatattctaataacatttaaaaggcggtatagtacaacacatacttttcatttgctgatatatacatcagatgtacagctagtgtgagagttactccatccggttagaatgacatgacacgctgctacttctaatattatgccattttataactgtgagcaggcaaccaacgagatcaagcaacacagattttatttgaaactaccaggtatagagttaatttacgctgtgttattccctagtttttccaactcatctctcccttttttcggcgcacgcttttcaaaccgctaatcggtgtgttttttgtaaaaaaaaattctatatgaaagttgttttaaaaaatcatattaatccttaatgaaacatgcaataatacatgcttcattttgcgtgccagggatgaagggttcccaacccctcctcctgaacgcatcctaaccttgcatcagaaataggtgtggaaaaaaaaaacctcgggctcgtgagctcagcttgggcttggctcgagctcggctcggctcgaatgaaaaacaagccaagcccaagcctcctttttagctatttgttgaaatgagtcaagcccgagttggctcgcgagccgcttgtttgggaatgatatatgtcaatgatttacccctgcttttcctaatgattactaattatatataaagagatgtttcaatgggaaggctcgcaagctagctcaatctggcttgagccaggaaacgagcagagtcgagctcatgttttagctcgtttccttatccaagctgagccaagcaagcctagtttgttgtgagccattacaatctgagacgagtcaggcttgactaggctcgtttccacccctaatcaaaatctatttatcttctattatataataaaaatccattaaatttccttaaaacgctctcaggttgacacatggcactctaaaaatgttctcaagctaccacgtggcgctagaaaatcctaaaattctagaaaaaaacaaaaatatccatccctgattttcacttaaatatatgggtccaatattatacaccgttagatttatcagaaaatactacgttactgtcctctccccgcaccgcaggcgctaaaattccattaaacttccttaaaacgctctcaggcggacacatggtactctaaaaacgtttccaagctgacacgtgacgccagaaaatcataaaattataagaaaaaaatatccatccctgattttcacttaattatatgggtccagtactatacaccggtagatttatcacgaaatacaacgttaccggccgtcctctccccgctggcgcgtgcgtacatgcgccatcctccctcctcttttttctcaacggtagttaattaagatcaaaagtattagtatcgtgttaactaattttaaatagtattggatttatatctccatagggcatagaccaccagggcacatagccgtatctcccagccgcaagtgtactaatagatgtacatgtatgtatatacgtgtatgtgtgatcatttacaagaaaagagcacgtggctctctcccattggctctatcatgtccgggcgtccggttaattcaaatgcaggtacatataataaaaacttactatctacaccttccatcccaaaaaccaaattcatagtgaggatttgacataaccaagctaaaaaagaatagtacaaatctaccaaacaaatcaactaaggatgcttatccaaaccaacatcaatttgggtcgggctgtttatacaagccagtctatacacaacaaacagggatcaaatacaccctaattaaatctacttcctccgtttcatattataagacttttaaaccgtttcatattataagactttcaaacattgacaacattcatatagatatatatttatagattcactaacatctatataaatatgggtaatgctagaaagtcttataatataaaacggatggagtacatagtatcactgttagtgatgtatgaatattggttcatgttacaaaccttcaacgatgtaccattgcctgttcttaacatgtaccagaggtgatcttctcaacacataattggttggaccagcataatattgatcaagaacaattaaggtttttagttgtcaccagtgatctcaccatccccttgactccggattcatggacgaaaaaatcaaggcatccccttgactccgggagggtgcttatcttgtggtggtcaacatcagtgagctcccaatcaaagatacctagattctctcgcaacctcctctcattgaagctcttcacgattatgcagtcaccttgctcatacactcatacacccatcttaggcatacctgcactacaattgcaaaatgtttcatatatatacatgttagaattcatttcaaaattacctacacacacatagtttcactttttcatacatataggaagtgataaactcctagcctctacatcgaccaaggttgtacaaagccaaaaaaagcatgacaaaaaaaggcatggtgttcactataatagatatattggcattatcattttgtcaaatacaaatataacaacaatttctatttgccatgggtctttttcttcttatgatatctaaatttaatcagttcatccaaagcttatcttgttgtagctgatccaaaactgagatgacatagtatagtattgtgtttacctgggcaactgttttgcccctttctaaagcaatctgtttaagtgggcagtccatgacattgctacaccatgaagtgccatttgcacctaatggagagtaggcgcacatttggattcctttccctttgcagaactccctcaacttattttgccggcaataaggatgcacctcaacctgtaaccgttcgctgatcacaataagtgattgtattaagtattaattaattatttcttctgagaaaaaagtcttgacaaggataacatgtaggtcagtatttataattttaactagttaacgatatatatatatatatatatatatatatatgtatgtatgtatgtatgtatatatatgcagtgtcacataaatggtgccattgaattggagatgtttaaaatattaaattctgtacaaggtaatgttatggagtgaatgaagttgattaaaaaatgaaattcaatcttggagaccatatcaaagagctaatatgccttacttttctcaatcaaaagattaatatgtacatatgtgtggaacaaaaattgatactgctggtgagcccacttttgttttaggaaaaataaaaatgaagaggggcagtgatgccgttttctatatttttttctctcctagttaactcgatatattattttaataggagaagtgtccattagcaaataaccaaagttttagagtatcttttagcatagccacatttttacggtatctcttggcaaataccataaattttggatgtttagtagcaaattttgccaagattatattgttttgtacaaattacctgatttgctgtaggagggatgattgcaaatgatagtaagggtatcaagcttcttgcaggtgaagttgggtaatttggaaccatgccattataattttacaaagtttgagatatgccatcggtatctcaatgacatgtaggacccacatgagtcaatgacatgtgggtcaggatggtatatctcaaattttacaaaattataatggcatggttccaattttccctagaataataaatgggctaggcccgatttattctattaaatctcaaaggcccataataaatgttaaggataataataccaccttgggaattaaatgaggagtatctcaacttaaatagggagttattggaggctccctattgactggttgaggtgaggatcggaaagccacacgcgcgcgcgcgagccgggcgggcgtgggggcgaggcgtccggtgcgcctacgcctgtctctatcctttttgcaatggaccatcccgagattgcctccgtaatgagattgccttcgtaacgggcaggcgagtcaattccaattgatcgcgtcgttactgcggcaaagggcggatatcgctcctacgctacaaggaaagatctaatccgatcagatgcggctactcactttccatctgttgttcttcctcctcctcctcgtgcacgcctgagctgctactgttctgcttccccgcttctgatcgcttgtgcgcacgagaaatcggaacaagcagggcctccggaaccataccttcgcctgagatctgcaccgggtaggcaggtgatcaggtttttggggagtgcttctgcacgattgctcctcttcatcgtcgtcatctgctaccatgtctggtgccgccgtcgccgctgttgctgctgccacacctggagatggaggcgcgcctgtcgacgggggatacccatagaccggatatagagggtattggggtacgctggtacgaggatctacgtagtacgatatcaagcaaacaggaaacagggattatactggttcaggccccttggtagttaatagccctaatccaattgatatgggattatatgatggaaaccacagattacaaaaggaatagtaaagctcgatgataccgacaggatcgtagtcgagttgatccgactagatctcccggcgacctggctttgataagctccggcttcgtaggctgtggtagatgtgttggctctaagatttaatgccttaggtcctcccggggggtcccttttataccgtaggtcaactggtctccatgtaggactcagagacatcggacccgacatgatataatgacggccgatttctatccaagtaggactctttccatctatagactccatgatagacttccttaacttatgctgagaacgtccgtatatgcgcaaacataccatatcgatacgtgacgtatatcgaagggtagagggtataccttacccgtaaccctgacaatagtgtcgtaggctctccagaccttccattatatttgagagatgaagtgaataattcaagtcatcaaacaagcataatgaaacatccgatgcctcgagagaggaatattggagacattgctgggcccttagcctgccagtcaacttcagcctgagatgtgcccgtcaaaccactcgaaggcggcgaccagatgtgttacacattcaagagacttgacaaaaatggctaaagatctacaacctctcaaatattcctaactcatactcatgtgaatctagttcccaggatgtgcactagatccacactttcatcttaagcatgattatacatagcaaacacaactaagatgaaagaaacttaagacttacaacaacttaataattacataggccgaccggccaaatagacttattagagaacagtggaagcttgactacccaatcacaagcacaccgactaggggtttaccccattaagttctcatcctagaagaaacaatcggaactcgcatcactcaaggactaagactaaacctgcaaacaaaaggttatatcaacagcaagagtcaatacattaaacaagttaatgtactagcaaactgtagcgcccgttccgtcgtggcgcctagcgggaaaactatctcttaaaaactctatttgcgaaatctgttctttgcttgttgtctagtgtccgtgccatctcagatctgaaatccccgatctatcgtcgagttcaatcccgaatccaaatccttcccaaatcaattcctccgcaaaagtctattttgcctcccccgggttcgatgggccgaatctctctcggcccatctccccctccctacccggcgctctctctctctctctacctcccccctctgctctacccgcgcgccgcgcgtgcgtgcgcgagagccacgccgagcgcccctccctcgctctgcccgcgcgtgcgcgagagccgcatggtcgccgcccgtgccgcgcctgcgccaactgcgccgcccggccccgctgccctaccgcgcagccgctcggccccgcgaaccagcgcgcgtgcccgagctgcgccgctcaaaccgccgcgcctcccgttgtaacccgcgcgcgcgtgccgtggtggccgaccgcctggtcgccgccgccgtcagactctgccgcgctagccactaactcgcggccgagatattgcccccgctccaaacagacccgacgacatcaacgcgatatcgccaggcaccggctatccaaacgctattctccaagggaaggagcagaactactcccacattgacgcg

SEQ ID NO: 6874 - DNA, 9570 bp, Oryza sativa
  unsure (1)..(9570): unsure at all n locations
actcggtacccgggctttatttttgccgtttgttgagttgtcccgttctgcgtgtactttcggagcccgaagacccgcagtgcgaggagttcgaggatcaagctccagatctcgagcaaggcaagccacctttgaacatcttgagcctatatttgaatttaattatgttgcttgaaaaatattatgcattgataggatcgcacttaatctgtttgtcccgtctgcaaggcagattggcgaacctacctagtttgttgcatttgatccttcctttgttaattgttatcccatgttcccttgtaaccacccagttgcgcctcggaaatcgtgcactctgcacgagtatcgacggccgccttcaaacttaaaatctgaaaaacatcttgggtaaaacttgggtcttacaaaaaacttggaaaacccgacacctgggtcggtgcttgcgaactaaatgaatttccaaaaccgcggaccggggaacataccgggtgtacggtttcccgctcttgcacttaaggaccgttttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggccttggaaatgtcttgtcatgaaagcttggaggtctcccgatgtggctgatccccacgggctgggtgatccgggttagtaatgtcgtgcgggtaaagtgtaccccctctacagaggttaacaaactgttcgaacagccgtgcccacggtcatgggcggatgtgaggtgattcctagcgtagttttgtttgactactgccttgtgaaattgctgttgtgaaaaggggatcgttgtttggaaaatctgcagctgatgggatcagctaggcccgggtggccgtttgaaagatgttggcccgggtggccgtttgaaaattgttggccgggtgccaatcttgatcaattttaaagactgatacattgcacatactccgaccggacgagacgcactgtctcatctgtgtcgtttgagaagcactcacttagttgtttccagaaaagagttcaaataaaaatcaattgcaaaaacaacagccctttctttgaagcctgcattaaacacttatttcccatggcttgctgagtactcccgtactcacccttgctctatataaataatcccccccccagttgctgaagaagatgaagcggatcctgcagatgaggagttcttccaggagcaagccggctacgatgagttttagggtttcggcctagttcccaagtcgcgcctgtgttgtttgatccaagtcctagcttccgcttcccttttgtaatgcagttgtgagctcgggatctgtccgcagcccaacatgactgtacctctactctataataaagagacctctattgctgtgataatttgtcttcctgtgataccagtactgtttcctgggactggtatcgattaacaggttaatttggagcgtcacgggctagatccggtcggtactagttcagggcgtgacacaagcacaagtcaattctaccatactatatgtaaggcatatattcaaaggaaggcaatatgtagttcattttcagcataaagcaagttttgtttcgcaattcttttgtaaaggagttgatgcttcaattaacaaatcaaattttaagtttcaatattaaattcatcataattccatcataatcaatctcttgttgtcatcctttgacaacaagtcataatatatcacctcacacacacaactcaacacatctatcaatttcaaaccaatgtcacatgatcacatttttaaaacatagtctatactcatgacacatcaccaaagcgctcatgaccgtgagcacggctaatcgattagtttaaagaactctgcagagtttgtacagctttatccacatgatatgaactctctagtttgttttgagtttgcaagactccaccacactcttcattttgaattacactacttagagcctagccttgcaccagcacgatacgtgttcctccatcctaggcatacttgaaatatacctagaaccgttaagtggtgggcccacgccttaaacttaatgccgtggtggcggacacgacgggaacccaccgcacaataccgttgtattggaaacgcttagtcacctaaactaccacgtcagggtaaataggaagctcctctgaattatacgaactcatacacaccgacctaccagaatgcaaggctagtcctaaatagattactcagcttaggccatctcatactagcacatgtggatgtacgaataactttaaatgggtgacacaagttcggtccttatggacttgggcaaacactccccctatcggtatgcaactaacaccatatgcacaccacttgccgcccaagtataaaatcacattttacacattttagttcgcaaatacccatcatatttattttattccagcaaaggttcatgtatcaaaatcatattttaattatagatggaatgagcatttgcatagttgtaagcatggctaagcaagtagttgcaaatagagcatatataaacccatttgagcacaaagagtgtactctaaccatttctaggggttcaaacagcaagaggatcaattattcaaggtggggtatgcagcaaataggtcataactaccttaacccaatttcaaataccgatatagtctaagttcacatgcaactttgcaaacaaatattttcattcctcaaatcatgggattcaatgtgttcaaaggatgggaggagaaaacttgccttgatcagagaaatgttagcacctaatccactccttcaccgattatgcaattatctagataaaggacacgttatgcaattaaacaccgaaatagctaaaaaatctaaaatgctctaaaatgcatgatttatgcacagtgattaggtactgatctaaaatgaattttaggtgaaataatttttattttatcttattccattagggagttatgaattttagaagttttatcgatttatagtagtatagtcttaggtagtgttatgaaatacttttgtaaagtgatttttactagattagacttcacaggggtgtagagatgtgttttataagactaactcatttggtttcacaatttttggagttacaatgattttcttatagattttacaagttacaacgtgttttaggcatatagtgttttatatgtgcatgactctcaagttgtaggttcagaacatgctacttcctgtttaagttgaataaaaggaataatttggttaactaaaacatttttagttcacatgtttatggtctttactactatggttcatattttataaactagagatgctataaactaaactagcaatatattatattaacctagaaattgttatatgagctaagttcttctaagttttagtggatggggatggaactatggcctctctggtctaacaagttttattttggtttattcatagctagaatgcatttttttaactaccttacacatatattttgcttaaccattactaggtgattaactcctaggttatctatttaaagattagagctataatatgttcaaaaggtgcaatattttattttactatgttgaagctcactatttgctggttctatggaaatttggttcatttcatttggactaaagatgaattttctacaaattttacaaagtaaaggttgctctatcttggttattacttacataaatatttaaaggcttttattacatagtaggtgtataattttatttcatggaagtatacgttttgttgattctacagaacttgggtttactcaaaaaggatctaagatgaattatgaattttatgtgaatttctaaagttcagcttacctaaaactagtcattttaaagataatagtttcagaggcatttgatctaaagtatgtatacaatttcattttactttataggaaaacataagttggtggatctatagaaactgagtttgctataaaatgagttgagatgaattttatatgcattttataaatttgtgtatggtttatgtatgatttatcttagaccaattttagagacaaagtttgtacagtgaatgtctagttttatgcaataactctaaagttcttgatttggtgagttcacagaaatttgatttactctaaaatgagttgttttcaattttttatggattttataagtttacatgttttcctgttgaaaatataaagcttttagtattatctttttacattttcagattttaaactcatggggtccacctgtcagtatcaggccaatatgcaaaaaggcccctaggattttcaggaaatcaacccgcagtcctaggtccatatgtcattgattgggaacattacgtaatgaaccttatagttatttaaattctcaaactgaagtccctgactcctttttcacacgcacagaggcagagcagccatggctgagctcgatcccgggttcaccggcggcgattggtggctcggttggagttggggttaaaagataaaatgaagagcatgttcttgcgattccattcctctagttttcttggtcagaggacatcggagtagcgccgatggcgagtgtgagcggcggtggttcttggggtgaaagctcatgtgtgcatggaaatcgattccgaacgatgcatgcatgtggtcttctagccttcaggatgctcaccgtgggtcgagctagggttttcgaggtcttggcggcagcggtgacttgtggaacggctcggcgacggtgctcctcctcgggtgaacgacgacggctcgaacgggacgatgagctgctacaagcaagcatgcacgaggtttgtgaggtcaaggagatggtgtatgcgcgaggaatcgaacaatggctcaccgaggcagcggtaatcgacgatgacggcggaggcgattctagatcggcgccggtgaagaaaagatgcgttctccgagtccttcaaatctccggctggggttcttgaggcgtattgaagaggagattgaggcgatgacgatggcacaacggcttgctccgaggtggtcaagaatggccggacgacgacgatggttgaagcggcggcgctccggtgcgtgctccagggcgtcgtcggcgtggtcgcgttccggtggctgtgatgcacaaaatgggacgtggtcaaaagagaaatggttcggcattgtgtggagagaagggaacgcgaaaaacctggagatgaactttacccaatcagcgatggcgatggtcgtcgtttccacggccggcggcaaggtttggggcgatggagaggcagagaacctcctccctcggtttcttcggctctgagtggtgaatggagaatggcaacgcgtctgggaggagtagagagtgagaaaagggaaaccgagatcgacgacacgttgcggccacgcgtcggctcgctcaatctctccctctctcggctggagcagtggaggaagtgatggacagagtcaaggcaagcttaagaggctgtcaggtgggtccaggtcgtggcaaactaggctagggtgagagggttgggtaagattctgggtaaacttgatttttagatcatttttcggaattattttctcctctaactttgtagcttcataacttaatgtgtggaccaaattatctagtgttgaatttactggaggtaaatgattacacctagattccattttctttggttgcactcaaaaataatgggtagattaatcacagaaattaaacaaagatgggctgttagaaagctagattgaatttttaggaggcctaaacagaggaggaaaattctagaaaaattatatttaggcatgataaataatctagtatttgaataaattattttccatcttcacttatgagcagttaaatgtacttttggatgaagtatgactttagccgattaaaatttaatttgattccttttagttttctgctttgactgattaatttgtggtattaaacttagttattaacttgtaccaatattatagtgaattgcttgtgctaaacattatctatctaatttttttccatgattttaacttgcacataatattttagagaattaggattactttactttgtatatgtgttcccacttcataattgcacctaatattgttacagggattacattaaacttcttttgggctgagaagatgatatttgagtttaatattaagtccacatgttatcacccaagattaacttttgtttagtaattttaacccttttagtttatgctcatgagacatattatgaaaagcaagaccaaaatccaaatgcacaagagactcgagcctaggcatgcattatgcacatgtatgctcatatacttggtgacatttctagtctaatgttgggaatgaaaaggttttattttgttctcaaattttaatcatgcaatgatttaagttggtcatcacctaaattaaaacggaaatttttgactctaaaaattggagaagttaacctctaactattttgacaagaaattttaagtcctgaaattttgggtatgttacaagtagcccccgacttctctctcctttccttggaattcgcaccggcggaggtgcgtctatttaagggagttttggggatcccatttgaggtctgcctgttgaaaaaactctccagcttccaagcgtccctcgtcttcttcgctcccgcaaaaaaccctagccaactcgtctcggtcctttctccggcgatcttcggtggccatggatctcgacaagtctacctccaccagtgcgtcactgaagaaactgcaagaggatggcgcccttcccggtcgcgggaccgcggagagggaagtaggaggtactgaaccccagcctgtcctgggtcgcatggttgcggttgaggactttattctctgtggttttcttcctccgccttctgaatttctccttttggtcttgaatttctatggtctttccttgctccatttgaaccccaattccatcgccttcctgagtatttttacgcatctttgtgaggcctacattggggtggagccgtttcttgacctcttccgcttttactatgagttacgctggatggaatccaaaaaggtgtccgggtgtgttggtttccgacttcaggatggcctgaagtcgcgatacatcccctttcagtgcctcacatctcgcagcaaatagcgggggaggtggttctatcttcagatagaggattcggatcctgtcttcgttgtacctaaggaacagccagacaagatttcatcttggaccaccaaacccgccttgaccccgtccctccaatctttcatcgatatcattgacgacctccgagaacgggggttgtcggggtatgaagttgctgccgacttcattggtaggcggatccagccgcttcaggctcgagcccatcctgcctttgattattctgggccagaggacgcgacccgggtttctcctcagggtatttcctttttagttaaattgactcccttatgttcatgtttttcccgtcttatcggattctgttctcaatctacaggcttgaatagcgcaaccgtggagcgccgcgtccgccaactgataatcagcggcccgacaacggcgagcaacgtccccgtcctcctttgcgagaaaggggtagccgagcgcgacgctgccatcaatataagtgtacttagctgtccttttgcatctttcttccgggatcacattatgacttcatgaaacgttggctctccctctgactgatatcatcgggtcgctcgtggaccatcaggtggcggcgtcgctgaaagagaaggtcgccaaggaggggtctgacgctgctgttgccactaccacgacgagtggcggcgacgttccgaaaaaggggaggaaattctcctctatagtcggacatcgtcggaagatacccactccctcagtaagttcacccgttatttgatcacgtagtcggaaaacttccacctcacatcatatcgattgtactccaggcctcggacgcgtctcccccgcctccgcgacgacagcggcttgtgacgctcagcgagaagtaagtgaataaatttgaggtttcgtgatttcgtcaaactctgtctcaatcgcagcctttcgcagggcggcgcgggcgaaggcggcgtaagatgggtctggagggacctccagcgcatctcctgccgtggcctcgacggatgtcgtggtcgtgcccaggagccatgaggcgacacctagcggcccagccagcgatctcgtggctggtcgtggttcgccggatgccgtcctcacctgggaggagctctaggttgagatggggcgcctcctcgaggctggtggtcacggtgttagccacgagatcgcggaggcgagggcggcggctgcgtcgtcggcgaatgagcgcgccaatcggctggcgcgtgatctagcggaggttcgcgaggacctccagaagatgagggaactggtggccggcaatgagcgacaacagcaggggctcgagcaccgcatttcggagcttgagaacaacttgtcggaaatccgtggctcgttgtgggtcacatatactggtctgcaccagctcgccggggagtgcggtatcaagtctaccatcccggcgaatcccgatgagttctcgctgatgtcttctcttgcggagctggtgacggcgatggaggagatcccctccaagtatccagccaggatcggagaggagacgtctaacgggatctacaccggggcgtgccacgtccttgcgtgtgtgaggctggcgcaccctgaactcgatctgcggaagatcttggatcagggggcagttagcgacgcgcgtaaggatgtgatggaggaggtcggcgatctggggagtccgtcctcccgctttttgaagagtagggtcttagctctcttgtactctttagtcatgccttgtaaaacttttattggttccaaccgccctagtgtgtgcggtcattgccttagctttgtttggcattttgatctcgagtactttgttgtcctttgtagagatgttgatgtcgaggatgtcctgcggcgcgggcaacctgagttgctagtggtcgttccgttacttgcgtccgaaccatatgtgccgcacggctctgtacatgtatgttcgcctgtgggtacgagcatggcgcggactcccttcgtttggttgtctccccttccgttgcgtggttcctatagagtcgacctgcaggcatgcttgctttttattattggcccgtaaaaccttgggtttcatcaccgnnnngggggnnngggggggtgccgctagagacatacggcaacaatgtgaggaagcgtaagatttgggcacaaacgtaggcacncggagtcgacatacggcccgcttgatattatatagttataaatgtgccttgccgtg

SEQ ID NO: 6875 - DNA, 14771 bp, Oryza sativa
  unsure (1)..(14771): unsure at all n locations
cgcgccgtgagangtgnataaccnnnnnnnnnnnnnnnnnnnnnnnnnnnnnnnnnnnatcgacttgatttgttgtgttctcgggagagaagagcagcttgacttagtcgtttccatgctgagcagatctcgagagtgcgcttgttgaccaggaccgtcccatccagtattggaggacgaagtttgaggttgcggaactcgagaggactatgctggaggtgagaaaggatcaggccgtagagacacttcggggtcgtgagctgtggttcaactcgtatctaaagagttgctgcacatccatgtcgagagtctgtagagagcatcgagtaccccgtggggatcccgaggaatcggcggccggatacatctcgtggctaaatggggcctgcgcccagctcgaaggcatcggtcaacgtatcgacgaggccttgaagcaggagtgtcgtcgctcaagccgatatgccggggggcacgtgctggcctgtatacgagatcatcgtccgcagctgcacctcgagttcctccgcgaagggttttctcgttctcggagaactcctacggagatagatggcctggcgaagtcgatggcgccgctggcggagaaggttttccagtcgatggactggcgttggccttcctggtagtctccatgtcctgtgacaaatgtctttggaagaagtgtaatatagttttggattttgatggaattgtaagaaatacttgtggaatagaaaagaaatctatctaactaagctttcttactctggacgttgtgtgtatgagtgtcttctcacttcgcaactttgatcagtcgtttgagttatacactctccctagcccccagccttgtcatcggagaattcttctcggaagataaggttcttggacctttgacctgcctcggttgaacaagcactgatcgtagcctccagccatgaagttggaaagtttatttccgattacacggcttggttaatacgcacggcgagaactcttacacgactagatcttacatggtctttcgtctctacaggatataacaaggccttatcggctctggtcgtccccagccgaagttcccttaggttcctcggaggccttgtcaagacgacgtaaagggacatgaggataggtttcaacgctaggtgtcatctaggtaagggattatcgggaaggaacactttgattgtcgtctgtacctgaaaaataggctttattgaggctgtaagatgtcttacaagtatggatactattgacttatacatagaatttacgtaattgatcaatgttccaggaatttgccaactcgcggccatcgccgtctgcgattttgaatgcgcctggccacagaacttgtgtgatcgtgtacggtccttcccatttgcgtgagagcttgttgcgccctgcttggctttgaacccgtcggaggacgtagtcgctgatcgaaagcgtgcgtgctcggatgcgcttctcgtggtaacagcgaagggcttgttggtagctggctgctcgaacgacaactcgtttgcgatgtttctcgagtagattcacatcgtcgtatcactgctcctcctgatcctcattggagtacttctgtattcatgtactttgatgtcgtagctcggtggggagcatgccctctgagccgtacacgaggaagaagggtgtctccttgttggacgttgtcggtgtggtacgcacggcccatagtactgatggaagttcctcgacccacttcttgtcatgtgacatgagcctgtcgtagacgcgggtcttgattccttgtagtactatgccgtttgccctctcgacttgtccattgctctgagggtgagaaaccgaggcgaagcagatctttactcccaacctgatgcagcaatcctggaaatcgacactgatgaactgggagccgttgtctgttatgatacgatggggcaatccgaatctgcagaatatccctttgatgaatttgatggtgttgtcggccttgatttctcctgtgggtgtcgcttcaattcacttggtgaatttgtcgatcgctacgaataggaacctgtagccgccttgtcctcgtgggaatggcccgagtatatctatcccccagcacgagaacagccaagtgagagggatagtctggagtgcttgcgctggcagctttgtgtgtttactgtggaattgacaagcttcacaccactgaaccatgtcgcaggcatctttgagggcggttggctagaaaaacccttgtcggaaagcttttccgactaatgtccgaccggcggcatgtgacccacagatcccttcacgtatgtcgaggaggaggtgtctgccgtcgtcggacgagacgcattttaggagtaccccatttggtgccttcttgtatagatcgttgccgatcatacagtagacttttgctttacgggatattttctcggcttctgcgtcgtcctcgggcaactcttcgctgcttatgaatttaatgagtggggtgcgccagtcgtccgtggtctcgatatcggcaacggcgcgctctgcctctgtagcccccgaggtggtgtcgggggcgaccgggctatcttcgccgcttgcctctttcactgatggcctcgtcaggacgtccagaaaggtgccaggttcaagtggttctcgtctggacgcacatcatgctagatcatccggttcgatgttgtctttacggtacacatgtcggacctcgatcccatcgaaccttttttctagcttcatgacttctgtgagatacttggataactcggggttagagcacttgtaatctttatgcacctggttcgtgactagtttggaatcccctttcacgattagtcgcttgactctgagtgcagctgcagctcttatcccggcgagtagtccttcgtattcggctgtgttattggttgccctgaagttgaggtgaattgcatgcttgaattgatctcccgaaggtgatgtcaagatgaatcctgtccctgctccctggctgttgagtgcgccgtcgtacgccattgtccatgtttcattgtcgatttggttgtctgacctattatcaggcatggtccaatcgactacgaaatcggcgagtacctgtgacttgatgattgttcgtggcatgaagtagatatcaaattggcttagctcgactacccatttcgcaacgcggccgacaacgtctttgtttctcacaacttcaccgagagggaaggaggagacaactgtaaccctgtgggcttgaaagtagtggcgtagctttcttgatgtcatgattactgcgtagagcagttttggatctgtggatatcttgtctttgcgtcgtggagagcttcgctgacatagtagactagtcgttgcaccttctctctctcgacaacaatgacagtactaacagaatatggcgtggcggcaatatagagaaataattcttcattaggttggggggcaacaagtacaggtggattggataggtagcgcttgaatgcaatgaatgcctcttcggcctcctgtgtccatacaaatttgtcttgctttttcagcagagcgaagaaaggttgtcctcgctctcccatcctagcgacgaacctgcttagtgctgccatgcatccggttagcttctgtacttccttgagtcttgtaggcgacttcatgttctcgattgccttgatcttctcgggatttgcttctattcctctgccagagacgaggaagccaagtagcttgcccgatggtactccgaacgtgcacttctctggattgagcatgaggcgatatcgtcggaggttgtcgaacgtttcccgcagatcgtcaatcaaggagtcgcttgccttggtcttgacaacaatgtcatcgacgtaggcctcgacattgtttctgagctagtcactaagtgcaccttagaccgtgcgctggaaagtgtttcctgcggttattagtccgaacggcatcttaacatagcagaataccccgaacggcgtgatgaatgctgtcttctcctcatcctcttttgccatgcttatttggtggtaaccggagtaagcgtcgaggaaactcaacaactcgcaaccggctattgagtccaccagttggtctattcgaggaagaggaaagtgatccttgggacacgccttgttgaggtcggtgaaatcgacacacattctccacttcccgttggccttccgtaccatgactgggttggctagccactctggatggagtacctctctgatgaaaccggctttgagaagcttgtcgagctcttctcgtatggcttgttttcgatctggtgaaaatctccgcagtttttatattactggcttggcatcgggtcgcaccatgagtttgtgctcaatcacctccctgggtaccccaggcatgtcggacggctgccaagcgaacacgtcagcattgtcgcgggagaaggtgatgagcgcgagttcctatttctcgcctagtgaagccccgatcttgatggtcttgtcggggttggcactggatagtggaacgatcttgattgcgccgtctggtttcggcgtcttgtttgtcttgctcactttcttgggtggctctgctgtggcaggcgggctgggcgtgtgctcgaccatgtcgaggctccgcttgtcgcattgtactgccagcttagcgttcccttgaatagtgattgttcccttcggtcctggcatcttgagcacttgatacgcatagtgagatgcggccatgagcttcacgagtgcagttctcccaatgatggcattgtatgctgtatcgaatgcagcgacatcaaaggtgatctgttccgttcggaagttgtttgcttggctgaaagtcacaggcaacgtaattttgcccaatggtttggacgatgactgaggagtgattccatggaagggttgatcggtgggtgtcaactcgcttcgtgggatccccatcgcgtccaaggtgctggcgaagagaaggttgattgagctgccgccgtcgatcagtactcgggcgaccttgatattacgaatagtgggttcgaccatgatcggatattgccctgggatgatagcagtcttggggtggtcctcttctgagaattctatctactgctcggaccacttcatcttgggcgcggccccctgccacgtcgaacagacttcacgttccactttcttgtattctcgctttgaggagtatgccgtggaacctccgaagatgtgtgagacatggagatcgtaatctgggtatgctaagtctgattcctgagtaggcgccttagcgtccttctcaaccacgcgtactcgcttgcctttttccgatgccatgtgtttggcgagcgactttttgaagacgaggcaatcttctagagaatgtctgtccgtcttgtgtatagggcaccatgctttcttcgtgtcgctgccttgtgggtctgggcgcttggcagggtccgcgtattctgttgcgagaacttctgattgagctttccttttcccactcttgcgatttttctttttgcttgactcaggtgcgtccttggctggtttcttctctccttcggtctttggtttgtcgttcttgcatctcagtgcgtcatccgcatgagcgcatcggtcgacaatttcgaataatctccgagtagtcatgatgcgcctcgttaccaactcctgagtagtatagcgatctctgacaccggatttgaaagcgcgaattacagaagcatcggtgatctcggggattgtgtttctgcactcgttaaagcgccgaacataatccctcaaggattcgcccgggttctgtgtcaacgcatgtgggtcatcttcgatcgcgtggcgcttgtaagttccttggaagttggctacgaactgctgccacaagtctgcccacgaagagatcgagttggggggaagatgcatcagccatgaacgtgcaaagcctttaaatgcggttggcaagtaattcactaacgcgttgtcgtccgctccggcagcgcagagtaccgtggagtaaacctaaaggaactcttctgggtcggggctcccatcgtatttctctattgctccaggtcagaatctttcgggccatcggacatcccgaagtgaacaaccgaaagctctacacccaacgctgggggcggtgggttgttggcgatcatgcgtccttcgtggatgtctatccgatgatgaagatgacgaggatgatgacgatgacgatgggtcgtctagttccggcgtacgattacggggacgtcggccgggttctcgagaatcctgtcgtcgtctcccgctgttatctcggtgccgatctccatcatcaccgtcattattgcgacgtcctcgaccagtatcgcccagtacccgccgttcgcgatcgttgtgatcgtggcggttgtggcggttatcatggtctcggtcttcgcttgaatgacctcctcgatcttcgttatcgtgacgccgtgaagagatatgacgccgggaacggttctcgttgtctcgtgtgcgtcgtgcctctcggcggccattcaggtgatcgcggagatcgccggtgccgcgaggtggaggggttgctcgatgaggtgattccgccgttcagggtcttcaccatttgcatcgcaagttggtggctgtttcgggtgcgctgcagcagcggcctcttcgaacgcgttgctgaggttggtcactaattgcgttgacggctctgatgtgttgggccggagtagtcacttgattctccgcttccgcattggtgcgtgctgacgtgccgacatcgtcgatagccaatacctcacgaggcgtactcgttgtcgatgatccatagtcttcgagtaggtgcaagactgatggttcatggggatcgatgtcgattaccccaacaaatcgatctgaaatcggcgtcgctccttgttccttgtcctcatccctgatggggatgcgtgactgctggaccttaggaggtggcgtcttcatggcgctgagaaagaccttgcagctcgagaggtcgtgattctttgtcttgtgaataggacaatagacatcacgagttggagaggtacactgaattccacgctcttcgcaggcacgaatttcagcatggacgttgagaaagacccagcaggcttgcagggtgtgtttcctggttttgtggataggacaccaggaccttgtcacctcggaagtaatcctcgtcggctcgtgattcctgtcggaaagacaaggcttggccgcactaggatccttctcgggtttggatgtcgttaacgttccgatctccgcttcggtgggaggatccttcgacatggagttgaaaacatgaaaagaaaaaaaaataaaaaaacatggatcttcgttaactttttatgattcttttttttcattaaaacatgttttaatccttcgacatggctgagatcggcattgtggtgtaaaccggaaagacgtttcgccgacttgagtccacaccagtgttgttgaagttggaactccttggttgaggttggtgttgacgctgttgtcgacgaatctggatgtcaaagtagtagaaccttgagcaccaagtccccctacctggcgcgccactatcgacgggggatacccgtagaccggatatagagggtattggggtacgctggtacgaggatgtacgtagtacgacatcaagcaaacaggaaacagggattatactggttcaggccccttggtaggtaatagccctaatccagttgatatgggattatatgatggaaaccacatattacaaagggaatagtaaagctcgacgataccgacaggatcgtagtcgagttgatccgactagatctcccggcgacttggcttcgataagctctggcttcgtaggctgtggtagatgtgttggctctaagatttaatgccttaggtcctcccagggggtcccttttataccgtaggtcaactggtctccatgtcggactcagagacatcggacccgacacgatataatgacggccgatttctatccgagtaggactctttccatctgtagactccatgatggacttccttaacctatgctgagaacgtccgtatacgcgcaaacatactatatcgatacgtgacgtatatcgaagggtagagggtataccttacccgtaaccctgatagcgccgggagccggagccgctgtgaccgacaatatcaacggaggcagtttgcctcacaatccagcggagagacattcacagggtataaccttcgcatactgttaattcaatttttgatacttctgttagtcgtaattctattgcgttcgttgtatggtcatgatgcttattatatcttaagcatgcttctggttatgttagattttatcactagatcaccccactttgttcatgccatgattattgtcttaatattttagattaaaatatgtcaatatatgactatatttccaacaactgacaccgatggctttggtaagacctagcatctggcactcctccatctccctccatactcgctccatgtccatcaccgcaaggtcctccttagcgaacacagccgatggtgggccttctggaactccaaggctcaccggaaagtgaaccaggtacaagtcgatgtactccacttgcaaattcctacatacatgaaccattgctcaaaccaactacgaaaatgcctgcctttatcaattgtcaaacatatatatgaacatactccctccttccctaaatgtttaacgctgttgacttttttaaacatgtttgaccgttcgtcttattcaaaaacttttgtgaaatgtgtaaaactatatgtatatataaaagtatatttaacaataaatcaaatgataggaaaataattgtgacatccccgcccagagcttaataggattaatagaatactacaacttctttttcggaagccgatctcagaagaactctaaggttaagcgtgcttggcctggagcaatttcgggatgagtgaccgaccgggaaattcttagcgggtgcacgagtgaggacaaagtgtgcagaaaagatttgtgttggtctgcgagggctttctatgacctataaaagctgccagatataagcgggacgttacaataattaataattacttgaattatttgaataagacgaacgatctaatattttttaaaaaaagttaagggcgctaaatatttggggatggagggagtatatagcgagctctaactattggtgcatgctaaccggagtgtcctacggagtgccggcaccacacgaccggggtgtgcatcgctgatccataatttggatgtgatgtagagttcatctcgcgatgaaaccaaagccaacgcgcaccgcttctgtcgtggcctcaccaagggcagcctctgtgccgtaattggccgccgtgtcgaagtgacggtagccgactttaatggtgcataggacggcctcggtcacggcgaccggatcggctatatgcctagcgggaacgttgccgtgcccatgcctacccacggcatcggcttgccggagcttagcgccacctccggcatccgttttccctctgcaccgtccgcagccatggggggatcgaaggggcaattgtgggagatacaggattgatgaagtatatattgtgtgtccatactactaactatatatatatatatatatatatatatatatatatatatatatatgtatgtctaaatacgtgttgtcgccgcagcctctaattaatgcatggagagctataatgctatatatattatagtatgaatgtttgcccatacgtgtcgggagtggctgcaagttggaagagccaaacgtgtctatgtcagcaatcaagcgtatgacagcatccacacacactgttattgtatttttggaaaataagaaaatttgttttcttaattacactagtttatctacaacaactgtacagttaacacaatgtgggtgtgacaccctgcatagttttcttactgtttggtgtttgcgctaatggagaacatgtcaacagtcaactgtgccacctatcggcatcggttaagaaaaactcacactaataatagagggagggtttcctgtccacccacctgacccgcactgacagtaaccctaaacccactctctaccacaccgtctgctcaactcctctccctctcatctacctttttcacttctttggtgagcagcacccacctctcctgcccttatgtggtgcatcagccaatggaaccagtcacctcgaaccagcccaatgcggtggagcaagcggtgtgagggttatttccacggtgacggcggcagatccacggtgagcggcagtggtaaaactacggtagatccacctgagcttgacagttacaagctaagtcattctatcctgctcctctctttagggttcaattttttaatttagttagttgcatcgggggtatcgatatggtcacaatttccaaaatttcggttattttaatccgaaataatttgaagttttaaacaaaatttgatcaaattcaaatatttttgtggaattcacgaatattgcaaaaatccaaaaattccaggtgaaataattttgtatgggatccaatagacccaaaattttgtaaatttcagtccaaacttttgttccctgcctctctctcagctttcaccacactctttctttttctctccctctctctcccatgcagagcggatctgaaacgcagctagcagctgttattcttttggggtgactacgaatcgggcacccgacgttatttctcaagatgtattcaaaaaatgtttcaatattgaaaatggtaaaacacaatcaatcaaatcatacaatgaaaaattttggtacaatatataaaacaacacatccaagtgcatcgaaaaaaatgaaacaccatggaaaaccccacaacaacatttcaatttaactaatgaaacatccaagtacatgaactgaaacatcaaatattcaaataaaaaaaaaaaactagatcaacccctccctctgctccggtggtttgccaccacatcgatgtcggggtgccgccatgggtgaggaggtggcaccggcgtgcacctatggagatgacgctgtggccgaagaaatgctcaagaatctctaccacctgctcctgtggccactctgcaacaccatcgcccgatgccacgccgagcagggccacatccgtgtggctgccgctgtgctaagcttggccacgtccttgccaccaccactaccatggctttgctcttttgccaacccatgagcgataagctcttcgtgaatgctagcccgttgcctcacaaatagagaagagaaaaggcgtggagagaagaagggagagagagagagaaagggatgatggaatggataagaaactatgcctcacatccgacagtgatgaaggggtatgtatatttctatgtgtcagttgtaagaaccggagctaatgcctgcttataaacggcactgaagacgtttcctgtggtagtgacgtagtgtttcactatttcggctggtaacattggcaatttatttttgaccggaaaatagtggggaaatcccccacggtaattttcattaaataaaggaactgtaaaaaaagattacaaattgtcaatccatgattgaaaagagggtctcaaaactactcgaagtctaggtaaatgtagggttggtttggtttgagtcctatattggccttaccaatatttggcaatttcaatagtgtttattgtctatttggtttggagccaaattttggcatgcctaagaaaataggccatttcaacagttaatttaggctattttggcttcaatccaaacacaatttttcctttgccaaaattagccatgccaaaagttgccaaaatttgacattgacaaaaattggtaaggccaatttagaccacaaaccaaaccagccctagctcctctttcaggcttgctttccatctactgagagagggagatactttgttgaatataagatcatttctctgcctccacaagagccaagcagccactaagaagatttccatgaagcaaaaaggagacaaaaccaaacctctgcacttgaatcatttgatgaaaatcaagagaagtatcccatgagaacccaatcatattccaacaggctgcagcaaaggggcattcaaaaaacaaatgatctcttgtctctcttgatcctaaggtacacatgacacaaaaggagggtacatttgggggcttgcaatgctttctctctaagagatcccgagatcccttgtatttgttctgtccaaaaacataagccaagcaaaaacttttgtcttcatatatgctttacacctccaaatacaaggcaaagtaactagggttgtagagaccaaaagcaaagcttgtagaacttctgagaggagtaaatttcatttccccatatatataactccatctaccaggctgtgaattgactgaaatctgtgaaagatcatccagataaattttgtactcatcataagcttgcactgacaagggcaaatggaagtgattatgaactggccggtcttgcaaatgctgggccacattatgatgcaaagtttttttatttatttgatctggcaatactatagtgggggcatatagcgttctactttcattaaattattttactataaaaaataaaccagtaatacaatagcaaattatcttttccttatacaaattggaggttcctctacgagggaacctcatactaaaggcttatattataaaaaattatagagtttttgtcgatgtgtttgtccatcatacgacttctttgatcctgtggtgtattttttcgcccattggtcctctatgtgtgggtacttaaataaggaatccttccgcacggccttatcactaggtgtatgcatttgtgtcacctagctagatgtaatttttccaccttaatactttgtttttatataatggaacatagcattccagcctttgctcaacaagctacaaccaattattacagcctaacactcataatgagtgcagttcaaatagaattatagaaataaaagacaccaaccatgaagaagaaacaaaccaaatactaccaacccaagataaagagtacacaattattaaattatgtttataaacctccatccgaaattggcaaacagatgcataatcgttttctcaagattacgacatgcaatctttaaaagctcgccatcttcatcacacctttgtagttgtatccaagacctaagccaatgtattgctttgaaaattacccaaatatatgaaacatatggtgttttgtcaaaaatcttatcattcctattgtaccatagagcctaacatatagcagatgctcctataagtataatttttctatttttcttgtccactccctaaagccaatcatcaaaaaaatatgagatatgctattaggagggtatagaccaaaagataactgaactgctctccaaataaattttgcataatgacattccaaaaacagatgatgaatgggctcattttttatacagaaacaacatctcaaacttccattccaattcctccttaccaaattattcttagttaacacaacccgtttaagcaagtaccacataaagatcttaatcttaagatgcatctcatatttaacactttgttaaacttatttaacaaataactattcacaaaacttattctgcaatgttgatgccaaactctgtagtctgtactgttaaatatatgtcgaaggaaatgtgcctaattaaggacagctcctgtagcatgaaggcctctctttgtttgggacggctaccaacaacccaaaattagtctagcgcgaggtagcaaatactaggggaaaaatcagttcggatagtttccgatacccgcacgtattttagaaacggatagtctcgaatagattttttttttatagtaccggatttgaaaatgagtacagatagttttttttaaatggaaacaaatttggaaagacgagatatggtaattaagaccagtatccggtagaaatttgaaacggtcagaaactatccggattcttttccatatctccacaggtagcaatcaattttattaaaaaacatctcttttccatatatcagcaggtatcaatcaattttaaaaactaagtatatatgcataactttatcatataaatttagatgaagataaactttatattaaaattgtagagctagacaagatctacaactttgttgcaggcaactttatcatctgagattattttggggtttaaatattcgttaggaaataccatatgtatttttacaactcacacatacgattcaaatgatctctgatggagatgtcctctataacaaagtacagagctcaatgaaatctagtactattttatagtttttgattttttctttatttaagaatatttgaagcgcaaaacaaacattataggtttcgaaggggtaaaataagatgaatagtatcttcaatctagaaaaaaaaacttgctaagtgagatgataagttgtgcattgaggaaggtgggacgatctattagttaccttattcagaaatgataaaaacgcatcgaggtttaggccctgtttaggctgtgtttgcttggggaggttgggaacaaatcttcttcgcacggaaaacggagcggtccattaacgcgtgattaattagaaattagctttttttttcaaaaatgaatcaatatgattttttaaagcaatttttgtatagaaacgggtaccgagctcgaattcgcccatagtatcgagtagcacaccaatnggccag

SEQ ID NO: 6876 - DNA, 1883 bp, Oryza sativa
gcccaggtggtattccaagtggggatacggtttggttacacaattagtctccaaaaaaaataaatgtatttgggataaataatctgctatatattggcgtaatatatatggagtttagtttggatgatgtgtagcatgagagaaaatggatagacgaacaatgcgtctgtctttacccaaaagtcgacggatgaaaatttgtatgatgaacggaacggagtgtgtacagtgaccaaaagatgtattagataattaggatcaatgtgacgatcggaaaaatacaaatatttatattaattatagattgatagatagagaagagatagatattataaaactttcaatcaactatttatttatttatttaaaaaagttattaagaatttaatttgcgttaaataaaaaaaagttattaagaagttgattagcgttaattacgtgacccagttagtgggccgagccttctcgtgtgtgggtagactccatatccgccgctggaaacgaagcgacgcttcctcgcccttatcacaaacgaaacgaagcggttagaaaaaagaggggggggggggggggggctcggacaatgagaagatttttttcgctcttttttaagacggactcatttttttttcatttttttttatcattcacaaaattgaaatcggattggaatttgaggaacagacgaaaatacgaacgaatagagggggcgacgaccggaaaaatctaaatatttatattatagttattatagatttgcggcgcttcacagtccatgtcgcgtgtccggattttgtaccgcgcgaatcagcaatgaattaggaatcgaaggcagataccgatggacgaaaaaaaaattacacaaacattatgtattttttattaggtataggtaggtataggtttagatatgggtctcttaaaaggatggatataaaaatagattttcgcaaatggttgatggaccgcgtacaaaaactgaatatataaaatttagaaatattgacctattgttgtaggaaaataataaagcgatatgtcttcactaactaagtgtaacaccctgaaaattcgaccaacgaaatcaaaacaccaaaaatacggattttcaaaaactttttaagtaataaattgcatcatgccgattttattcgtctatttcattggattttgatctcggaatttattaatcgcgaataatgaataactaactaggaataaaccctaaaaatcaagttggctaaaaaaataattaaaatataaattaaaataaagattaggtgggattggaaataaaaaaaatattatcacgaccatattagcaataattaaattttagtacgatggaatgagaattaaccctaattaaaaattcaaataaattatataaacaaaataggagtgatattaaattagggtgaatttttagttaggataacacaaatatggagtaaactttgtttatgcaaaaattagaatttatagggctatatttaaatagaaaatgggctaaaatcgggataaataggaaaagttactgttcattgcggcataggtgttcgatcgtggtccccctagccccgccccctcccttgccgcgtgcgccgcgtcgcccgcccgtagcgcgcgccgccgccgttgccgcgccgtcactgtcgcgtcgccgtcggcctcgcgccttgagccgatgtgcgcccgttccctcgcgcctacgccccggcgagtggcccgacccctcgacgacgccctgcgccgctggcgggccgcccgttccatagtgccgagccccgtgccaccgcgcgcgtcgtgttaccccgcctgtaacgccgaacgcttgcaaccgccgtgtctgcgtcccattgcggatttagccctacgccacc

SEQ ID NO: 6877 - DNA, 18301 bp, Oryza sativa
  unsure (1)..(18301): unsure at all n locations
gtgtggccattgttgtcaaatgactaactatcggccgaattcgtgctctgtaccctacctcccctcttccctctccactgcgccgccgctctcgtgccaccgcaccgccgttcccgtgctgccgcgtcgccgttcccgtgccgctgcgccgccattcccgtgccaccgtgctgccgctcccgcgccgccgtgcgccaccgtcgccgccgccgtcgtcgctgccgccgtcgtcgccgctgctgccgccggtgagccgccctccttcccccctcgcgtccaccactgccgccgctcgggtgggagagagccgagagagagagggagaggaaaagagaggccggcagagagaaaaagagagaaagagagaaaagaaagaaaaagagaaagagagaaaagaaagaaaaagaaagaaaaagagaagagagaatggaggaaaagaaaaggaacaataaatagaaaattaggaagaaattaaggaggttaatagttcaagaaaatctaaaataattagaatttaattatagattaattatggtcatagaattgcaaaatttaatataaattataggttattcttggtaatttctaaaaaaatcaattcgcggtagtagtttagatgtaattaacgactaaacaattagatgaatttttttagactattacagattagttttggataatctctataagtaatcgattcactgtagaagttcggatttaatcactaggaattttagacgtatatttggatctttatttgaattttaaccgaattcaaatcgtttcttcgcacgtaattttagagcccgagggagttgcggatccaagcgaggaccaagaaccgcaagactttgagcaaggcaagtcatcactatcccttgaacacgttgatcccaattgcgaaattatttcgtttataaataaaattgcatgcaatgatgaacattctacttgtgtttataccatgccttgattattgtttaccccttattccttcgtaaccatatttacgtatgagtccctagtcaattatgacaattgcttagaaatgctattctagaatcatgcatactcatatttatcaaatgctaaatgcttgggcaatcacctttgggaaggtaattgagatgcggcatgtggagacatgagcaccacattgccatgaaattgatgacatgatttgggaaaggaaaataaaatgaaaacaaccgttttcgactggggcagacggaggatttgggtggtatctggaaaaggctagtaccgtccccggtcaattaaggaccgagccatgaagttaaacatgaaacgacccccgtacaaccgtacttctcgaatgggtatagacctagcggattagatagccgagcggaggcagtatccctgcatagatggttcacccctgagtgaggcaggcgcgctacggtggggcagccgttgaggtagggccgagaggcatgctctacatcggtgtcgccattggtaggactgccatgagtgtgtgagagagaacttaacttgaaccataatttaatatgtgtgtgagacttctcttttccgggagcgctagaactcctctcactgctagaaacatggacgcctagagtgcatgaggatttaagttcatggagcgggtactgccaatgcgaggttatcaaaaggctttgccatggcgcgtctcatgtgttgggacgaggctcatgtgttgggcagtcgcagagtgcgggtaaagtgtacatccactacagtgtgagtaaaccaaatctattcgaatagccgtgctcacggttattgagtaccgggacatgtattacacttggctagactataaattctttaacttgtgtgggatgggatattacatgatgatttttatgctgatggagccacttcctgagaggtgggaatgtggacgtcctcagaaaaccatgacgactcaatggcggaaagctatccttgggatcacaatggatggtggacagaaccgtcgttgtttaatgtgaacactggtattaaaacttgatcagtctatgctaggttttaggcttatgaaaagaattacaaaacttgctttgcgcaaaagaaccatagccatcctttgaattcttctgtcatgtgcattattgctgtggtggcttgctgagtacggttggtactcacccttgcaatattcaaacttaatcagaggccggagatgaagcttcggaggatccctatgcctattaccaggagggtgatgaggacgatggcgctcaataggtcttagttacggtcgttgcctgtggcaatagcgtgccgctgccttaactccgctgccttacctacttctgtttttgaaatgtattccggaccgctcggtccgatgatttaagactgtgcctgcgggcttatgatgtaataattcgtactagactctcatgtatgtgcacttgatatttcagctataagttcgtgtgtaccagactacttgatccagggaaatggtactgtttacacgattaattcctgttataaaaacgggggtctaaggaagctcaatttgagaagttttatatcccgggagatattcattaccgtattcatttcactctatattcgatccatatctttattgataatattttattacgtttttatacaagttttcaattctgattatgtttctgaaaaaaatgaaaataaacatggtagatcaaattttcatccgtttctgttccattttcataactagctaatactgaacagaataattgaatgcggcaggtaaaatcgttgcagcaatactcatacatcaacctgaaacgaccatcctaggctgtgaccaagatgatatctattgatgactttttaagaaatgctagataaaaaagtattcatgttcggtatcaatatctcgaaatttcaatattattttggaaaataccatatttatcgattacgaatagaagaaagataacaattgagcacatctggcgctccatttcacacaattattttgcgagaagacagaagattaaaattgaattacaaattattttgctagatccccagcaagcatgatccatccagattattggtgcatagggccagcctgcgacatgttaagcaccatcccacaaatcttcgacgcacttgtaaggcccattgtcacagacgaactgcattccagtcagacccctctgctgggggagtttgctgattttgtctctctcttcctcagtgagctcccagtcgaaaatatcaagattctccttcatcctattttcattgtatgtcttcactaacaaaacatcaccctgctcgtacatccacctcaaacaaatctgcaccgcaaattaaatattgaagtctcaattaacatggtatgcccatttaatctcttaccttaaattctgtgaacaactgttttctaaattatttatctgattgaagatctgattgcaccgttaatattaaatcctcttaacaaaatttcataatataatattctaataaaacatatatgtgtttgacgttttgaaatagtgtttcatacgtgagaagaaaaaagtgaatgtttcaagtggaaccaacctgagcaagcgtcttgcccttggtttgggcgatgtcgtgcaggacgccggagtccatcaccgcggcgctgccccacggcgtgcccttcgcccccagcggcgagtacccgcacagctgcaccccctctcgccggcacacctcccgcagcgtcctctgctgccacatcgggttcatctccacctggttcgccgccggccgaaccacggcgaacgacagcagctgctccagcttcttggcggagaagttactgacgccgatggcgcgcgcgaggcccagccggtggcactcctccatgccgcgccacacgccctccatgtcgaacgccggcgccatctcctccttggggaacgggaagtcgtagctgcccggcgccacggtcgccggccagtggacgaggagcaggtcgacgtagtccattccgaggttgcggagcgtctccctcgccgccggcacgacgcggccggcgtgcaggtcgctgcaccagagcttggaggtgacgaacacgtcggcgcgggaggcgacgaggccgcgccggacggcctccgcgacggcctcgctgacgcagccctccgtcgcgtacagcctcgccgtgtcgaagtggcggtagccgagctcgatggcgcggagcagcgccgccgtggtttcctcggaggaggtgaaggggaacgccgccgtgcccatgccgatgcgcggcatggtcgggagcagcgcgctcgcaggcacctccgggatggtcgccattgccattgccgtattgcagtgtagtgtagtggactagacaaggacgtgtgtggctatatataaagaaaaaatggattctgttcaacgcatgccgcaatgcagacaacacatgggacgataatgaaggagaaataatgaaagagaaattcgatcggcttgatttttcgtagctgagtagttgatcacgttgaattatcaacaataattcagtttttctgatttacattgtactattattattagtttactagtcatgcaaatcttgcaaaatgattaattacaaactgtacatgtaatgcccaaagctatgtcacgtgcaaagtgatttgtacacaaggctgtgaccaagacgagatctgttattgtcttatcaagaaatatatataaatcttttagtatcttatcaagaaatatataaataatgattcgatttccctctgacaacctagaaatttcgacaatcgcaccaaccgggatggcaacgatcaggatgctgttcgtccacgatatgcgatcctcgccatcggctagtgagatggggtctggggactccactcatacctaagatgtggatggttctaacagtcatggctatttgttttttcgaacgcgcaagctccctgtatacgaatcaattgttattctgctccaacagttgtaccgaaataatgaataccttgagtaggtagaaatagaaaaaaacaagaattttcctaaatgagaaatgttttctttctaaaggaaattaaataatattaattttgattaatatcagaatatcgaatgagtttatgcttcactaattgaatgataaataactgcaagtaaaggagataggtggtttaaaaataaacccaaaattttaaacatgtatctaaaatcacaacaaaaatagtgaaatgaaattagctcgtcgggaatgcatccaaaatcattatagacccagggaattaattaatagttcccaaccacgggtggagtgaaatccaacaaaaatagatcaagagtcgtatacatttaaactaaatctaccatcttaaatttagcatcctaaataaatttctaggtagctaattaaatttgcaatgcatcatctatggacctatatatgtataccaggggagtaaccatttttcgtgaacgtgtcgacgtgttttaaataagtggataggtatacagcaattaatatacatgtatggtccatacattaattgatcgcagaacgtgtacgggaatggtgccgtgcccatgcctgccgcacataattaagatagatccacatcatgatccatcatgattatttagatatatactccactgtatctaagtagcttgctagacgtcaccatcccacaaatcttcaactgatttgtaaggcccatggtcagagatgaattccaatccaggcaggcccctcagttggggcagctgactgatcctctccctctcttcatctgtgagctcccagttgaaaatgtccagattttccttcattctcttctcattatatgtcttcaccaataaaacatcaccttgctcgtacaaccacctcaaacaaatctgcacgacagagtaattatatagtgaaactttatttgacctgattttttgtttggtttaattaaatattttatattcatttaatttctaaactttcgtgttttgatcacttttgatatacatcctttgattccataatttttgacgttttaaacatggttgggtcaaacttttataattttaactatcgataatttttaaatatttattttaaaagcactacaacaacatatttagatttgtcttacaaaatcctataataaaaataaaaaattatttatttattttatcatagtgattttttatgtaatttgtatataagttggttgagtttgatcacgagatataaacattagacatatatattgaaatattcacttaaagttttctttttaccggttactagctttcacttacaaacaagtaaaaacataataatagtatggtatcacagtataaggataaattgatggcttacaactgatgatatgtaaatatgttatattagttatttagagttgttcttttaaacatccaaaatatgcaaaaccactctccaaaactatcttagggagtaatatagatggtattgcaaagtttagggggttagatgttcggttttaaagtttagggtgctaggtggatttgcatccaaagtttagaggggtatttggacttttttccttgttaaaaattttaagaataatggaattggagggagtagtatatatggtatgaatttttctcctacaaaatttagaaaataagtatatcaaccaacctgagcaagcgtcttgcccttggctccggcgatctcctgcaggacgccggagtccatcacggcggcgctgccccacggcgtgcccttcgcccccagcggcgagtacccgcacaggtgcaccccctcccgccggcacaccttccgcagcgtcctctgctgccacatcgggttcacctccacctggttcaccgccggccgcacggcggcgagcgacagcagctgctccagcttcttggcggagaagttgctgacgccgatggcgcgcgcgaggcccaggcggtggcactcctccatgccgcgccacacgccctccatgtcgaacgacggcaggatcacctccttggggaacgggaagtcgtagttgcccggcgtgaggctcaccggccagtggacaaggagcaggtcgacgtagtccatcccgaggttgcggagcgtctccctcgccgccggcacgacgcggccggcgtgcaggtcgctgcaccagatcttggaggtgacgaacacgtcggcgcgggaggcgatgaggccacgccggacggcctccgcgactgcctcgccgacgcagccctcggtggcgtaaatcctggccgtgtcgaagtggcggtagccgagctcgatggcgcggagcatggcggcggtggtgtcctccgaggaggtgaaggggaacgccgccgtgcccatgccgacgcgcggcatggtctggataagctcgctcgccggcacctccgggatggtggccattgcaacctgcagaagtgcacagtgtagtgtagtggagaggaggacaatgaggtttttctctgtgggtagctatatataggaaaagaatggatctcctccttgaggtttcgtgctgcaagacttaaacaacacaagtgacgatgaaggtaacatttttctaggtgaagcatgggcagggatagagctagagcgaaacagaatgtggtgttactctcttaatttactttactttagattaaagtttaacctaatacaaatgtctaagtttgtattaagggggtacatatacggtgaaaatagataaggtatagtttaaaaaattttctttatcgggttcctgagcaccccctaatatatactagctccgcccctgcatgggtaagttagtaagagatcaatatgcggtacaaagttcatttgcaatataaacctgaaatatcatgggataaacaaatgagcatctgagatttgttcttgttatcatgagtaattttttttgccacaagattaaccataagtaacttttttttttggaataaactatttagtggcatggataaatcttaaacaattatttatatatgctacggtagcttacaggtttgcaaatgctgtgttagttagtaccaacacaagactaattcatttttaccttttctattttactagtccatgaaaacttgcaaaatgtatgattagttgcacctacctgtacatgtccatgacccaaagccgcctaggctgatgtgccccgttgaaagcgatcgagatagaagtctgacgaagactatgacgatctattagttaccttattcagaaatgataaaaacgcatcgaggtttaggccctgtttaggctgtgtttgcttggggaggttgggaacaaatcttcttcgcacggaaaacggagcggtccattaacgcgtgattaattagaaattagctttttttttcaaaaatgaatcaatatgattttttaaagcaatttttgtatagaaactttttacaaaaaacacaccgtttagcagtttgaaaagcgtgcacgcggaaaacgatggagaggtgttgggaacccttgggtccgaacacacccttagtcacaaaacaaaattgttcacgctgtcacatcgaatgtttggacatatatatgaagtattaaatgtaggaaaaaaacaagagttaattgcactctggtccaccttttattgccaaagtttcactttaggctatcctctagctcatatttttactttagactaggtaagattatctttggtgcactttggaccgcccaagtcattttctttagctgcatctactctataatattgtaaacaattgcctgtgtaagttggaaaatattaccgggttacgggctgctgatgtgtttaaagttggaaaagtcatttatgtattcctaaaaagtttatggggtggtccaaagtaaaataaaggtaaagtaacctagcccaaagtgaaaaaatgtgttaaatggtggtataaagtgaagctttggtaataaacggtggccctaaacgcaatttactaaaaaaaacaattacacagattgtgtgtaaattgcaagacaaatcttttaagcctaattagccatgatttaacaatgtgatgctacagtaaatatttgctaatgatggattaattagacttaataaattcacctcgcagtttcctgacggaatctgtaatttgttttgttattagactatgtttaatacttcaaatgtgtgttcatatatccaatataaaaaccaaacccaaaaaatttttccaactaaataaggccataatctgaaaacgtgtaaaatgttgtgatattaactagagaacgaaatagagtgaaatctataaccgtagttctagagtgagtactacatgttattaacaatgtaaatatattaaacgacagagtattgtaaaagtaaaatttataaatagctgaaatttgaattgtggaacgaagaatagatgtaaacacagtatgagattaattgaaattagaaatggaagataaagtaaaattagcaattgaaattcaatacgagttaccaaacttgagtccctacaatactaaattaaactttggattaaaatgaaataataaaataattccgagtcaatataaaacaatacacaatattattttaaaattcaaaacaaaaattaaaacaaaactactcctccaaaacatggaaaatggttaattcaaccagtacaatgtacggaattggacttggtgattcttcactctctagtatgtcttgttatcattgtccatgtaatctctataatgattgattatagccttttaaagaaaagatgggaataaattctatgattaaaaaatatgtctctccctaattgttttctttatccgaccctgcatccatgtatgctcttgcttttgtcaggatgtatgtcagctatatactccataactcttggtcaagtatgctatagctagagctagcttatggcggccactttggttgaccagaaacagaaaggcaagtggctgatggctgatgacattgttccgcttgaagatatatgcttttttaaaataattataaagtacaacacagacactcacaacatacgtacactcacccctataaacgcacgcacgtaaaccctactcctacgagcatctttgaagactgagctgataaatcctaaagactgacgaagttactacagacgtctcgttgtggacgggtgcatcacatgccactaaaagcacaaaaccgttaaaatctaaaaaattctctcccataaaaatcaaacccaggatttaaggtgctactaaagtttaatgaggcgcgaagatatgtgctgatgcagtaatattggtgcttctttccatgcaaattctttgcccgtcgtgtgtcaaaaagatggggccactagccaccaatttttggaattatcggagaaaacagccttcccctcacacacagcctaactgttggctgcttacctggttcgttgcatcccatggcgactagcgtaaaacacaactacgaaaagcatttttccgtgggttcaaaaagtgttttttctacagagatcttacccgtctgcatcaggtgtctgggaaaataaatatttttccatgcgggcgatcaaccacatgaaaaaatacatctttccgtgtggtcaggttaagtggaccgcacggaaaaatctgatttccacgtgcgggtgcttatatcacctgcacgtaaaataaaaatcccaaaaaaaataaaatcaaaaaatccgaacccaaaccctagaagccgttgtcgccgtcaccatcgccatcgccgaatctgccgccacccacatcccctaccaccaaatccgcggccgccgcacgtggggagggcggcgccactccctaccgcctccttgttgtcatcggtggcggcggaggcggcggatccagccatcgtggcggcggcggttgcggaggaccgtcgtggtaccgcaccgctaaaatgcgggtcccgcgtgcaccgtgctgcctagcgatttttgagactgtgcaggcactgttttcacactgtttgacacggcttcatactgtttggcactgtttgagcgacgatcccgcgttgtggttacgcagaaccgtcgtatgaacagtacaaaacagtgtacaaacagtgattgaacagtgccgacgcggtaaaaaattcgatgtcatcgtggttccgcagtttcaagctgtgggactatcgcggtcccacgctttcgtcccgcgggaccatcggttttgtgttttggatctgcgggactgtcgcgattccgcgttttcgttccgtgggacggatatatttttatatgtatgtatataaatgtaaattattaagaataagtatatttgcaatttttttcccaatccctctcacctttcaagtgccagccacgccgtgctgaacgcgatgagcagcagctggggcaatcgcggtccgacgtgtcattgagggtgggaggcgaagcgaactaccccatgccgatgaggacaaattgtgggcttaaagaagacttttaaggctctgaaatgatagtcactttttatttttaataaacctggtttcaagagaatttttaggggaaactagttttacattccttattcagttagcatgcgttttgagaatttgtagtgtattggcaaatatttgggcggcatgttttgcacagctcgctgagctgcttccaaacgatatttttacagaggagtgattgttgggctctaggctgattcggtgaagtgattttcggagctagtaaaaagaagtggcttctgctgattaacctagtgaatcactttcagtcgcagaaacgctcctttcagaaaatcagaagcaggaggaggagctttacgtaccaaactcaaactgacccaaagtgtgtactggcagcagtggcggaggcagctgcccgggctccatgccatcgcaacacacattgctccacagcataaacatcatttactcattaattgcttacataattaccttgcttcctggttccaaggaaggttaattagatgactagcgagttgtaccacatcctaatcttgctttcctgatgtatagtagccccgtactctaactccttgacaataaacaaccaacatttcattgataaattgtaacttggcaacaatcaactttaagtctagataaacggtacaattttccatatatatatatagggcatgttcactttgatgcaaaaaaaaaccttaccaaattttggcattggcacagtgtcggatcccaaaactaaatattcggaaaccgacatgtttaactgtatcaagccctggatcagtagattgatacagcttcaacaatctggattttcattgcgtacatttgaacaaggctccaaaggagatgttattacataaattaataggggaatttacaagattgtggctaactattacagcagaagctatagagtgtctcaactctaatattttgctatagacttaaaccatctaactaatctagatttgaaaactaggttgaaataatgctaacttatatgattgaactcctggcttcggcaagaacttcaatttaactctggaaaaaggggtttgaagcaagggtgagtacaacgtactcaccaagctattatattcaataatgaatgtataaaaaggtaatatttgagtaggattacgattacttgcagaaggcagagaatatagaaatagaaagcctgatgttttaaatgtagcagcatttagtaaaatcttgaattaggtttctaaccaaagtaccatatgagtcccgatactcaattccgtgagcacggctattcgaatagattcaggtttactttactgcagtaaatgtacgctttacccgcaatccatgacatgccaatattcattagcttagtcatggcaaagcttttcggttactaacatcagtggcacctgtgccatgaactctcatcctcatgcgctctgaacgtaacgttatcagcagcgagaggagttctggcgttcccgaggtttttagagagagaactggttgagagacccccgtcatctcaaccaggttttcacaatacacacacacttgagctcaacaaatcatttacctgcgcctcggtaaatgttatatttgcccttcgcggcataggtttgcctcctgcgcgaggacttaaataagaaccactgtacagaggtaccacctttgctagataacctactttgcaaggtctgtccccattctagaattgcggtcgtactcgttcgtttgacataagtagttggtaataactatatcgactgagacagtactagccacccggaaatcaaccaattcgtacgtactgtcccaatctaagttcattatatttttatgcaaactaactaggcagggctaagcaaagctagcatatctggtttgctatgttcaggttatgtattcaaaatcatgtatgactaatgcatagaatataagagatatagaatatagggcatttatgctcaaaggggaggaataataacttgccttgctccaacgcgaataaatccaaggtaggcaacctgattatctgatccttgaaataccacaagttgccatccaaaataaaataaactctactgaagaagaggaagagccaaattcaataaaatccataaaataacaagaaaacgataaacgactaaaagggctagggtttagggtataacctatctcctttataaggtataaggattactgggctaatatgtgtaggttctaaaagattggagactaaagtggataggagattaagcaacatttgtcgcttatatttcatctgtgggttttagttgcttggagagtaagggatataactggttaagtgagtatgtggctagtaatggtcgaagttgggctttggtagaagaatggctaggatttacttgttctcgagtcgatgctgaaataggatagcatatcggctcgtatttcatgtataggttatgagtagttggagggtaaatggttgggatgatattgtagctggcgtggagtctagatagcaagctgattgaggtaggataaatatcagttagggtttaggtgtttgctagtcgttgctagagttgggcagcatggcgactagacttagcatcttctctagccgatgtcaacagacagtataacggctagagggataggaggtttgtgtgggtttagtggggcggaagtgttactccgacaaccgtgagtggcggcggagcggctaggatcacacagagcccaagagctaactgtgcggcgtgctgtggaggtcgagggaatagtgaagctccgaccgctgtacgcatcaaggcgtggggtgccaggagcagcatttcgatcttgggtttgggttttgccaggctttacaaccaacggtccaacgtcggggtcgatagaccgcacgaacgtccccatgaaaggcgtaaagttccaaccggcggctttttagtggctaaaaggtattttgaaaataaacggaaatattcgaaaagcaaatataagtttaaattgtaaattcaattataagatcaaatatttatccaaatggtatttgaataaattaaggaaatttaaataaaatattaaaatagcaaatttggtaccaaaatgtagattttgaatttagatgaatttaggtccaagtttcactggaatcggatctacggtttaggagatatgggcttctaaagattgggttttgaattaaatctagaaaagacaaaaatacactgttcatgggcccacctgtcagcctttctttttctttttcttttccttcttcttcctcccgtcatctccttctctcttctcttctggccgagtaacagggaggaggggtgctggggctccggtggccggggatcgacgaagtcggcggccacgcgtgttcccgcgcaacgcgcatccgaggatggtggtggccagtagagggagttagggaggaggccggaacggcgacaacaagagctctcttcggccggcaaaggaagtggttgtggtggttgctatggggtgggggagaaggggaaaatgggaaaaatgggttcgccggaggtagggggagtcagtggtgcaaggatttggctaggggaactatagaggaggagatcgaccgatggcggcgtcggccggacttgacaggagagagagaggaagagcttcaattcaagctctgataatgtgaggaggggaggacgatctcgccggctatttaaaggcggtggatgtcggttgcttatggcggtttcagaggagaaggcgagaggagacacggctgcggcggcacagaaacaggagcacggcgtcgactctatccgctgattggccatcgaaggcggttcggctcggcggttgatgtcagcggcgtgaggtggcggctgacgtcggcggcagttgcttagcggcgaaggaaagacggcggagttggagggtaaggcacggcgacggtggcggcgcgacttggcggcgacggcaaggaagcggcgacggcgtgtgcgtgtgcgcgtctgcagaaggaggaagggcggctcggctgtggtggctgggccggcttgggctggaggagggaaagggtttcggcccagtctagaaagaaagaaagtctaattttcctagagattcaaataattgatttagaggaatttggatggctagattttaaaaaggatttgaattcggagagggattttaaaataaggatgttctaatttatttgagtgcaatcttttgagagatagaatataacggaatttatttgatgcactcgattgagagggaagggaaataaataggatgttagcctcaaattatttggcaagaatttggagaagtatttgaggctaatgggaaacttggatatttggcgataaataagaataggtctgaaatcaaaggatgggtcgacaattaattccaatgaaattggaattgctttggtttaggttcaaaggtattgttggaggatttcttggaccacaattcataaaagtaaaaaggatttttagactaaatttgaataaaggaaattttggtcaaaagaaggtttaagatgcaaaatcaaatcaaagagaatacctcgatttaacaagatcaatttttagaataaaaaccacgaaaaattttaaatactagacagggattttatgcatgttagttttaggaggtccctctaattataatttcttaagtttaggaagttattaagaatagaagaatcggcatgatacatatttagaaaatagcaaatttttagtatgttacacatagttgccaaaaatttggcaacttactaaaattttgacaggatttcttaaatagttaccaaaatttggcagcaaactaaatgtagccacttttttgacaactttaccaaaatttggtaaggttgaaaatgacaacaaagtgaacaggcccatagtttttatctcttgctaggcttgcccagcctcaagaaaatcgattttgctaaacatcacacgggtgattttttcgttgatatttgacagatttttgcccctacaattatgcgtcgagatcagtacacgattctgcgtcgatgttgtcgtgaggtggagaggagacctcgtgggttacacgtttgccgctgatcacgattcacaagaaatttacatcctagctacgtgtaaatatcctatataactaaaataaaatataaaattacagtcctatttaactaaaattacatatgtaaattcagttgatattaattacaatcctatttaactaaatctacatttgtaaattcagttgatttgacatgtaagtgcactgtaattttgataaaaataatgtgtaagtaaatatgtacttattattttctttaaaatataaaattacaatcctatataactaaaattacatttgtaaatttagttgatttgacatgtaagtgcactttaattttgataaaaataatgtgtaagtaaatatgtacttattattttctttaaaatataaaattacagtcttatataactaaaattacatatgtaaatttagttgatatgacatgtaagtgcactgtaattttgataaaaatattattaaaaatattgtgtaagtaaatttgcattagttattttatttcaaatataaaattacagtcctatataactaaaattacatatgaaaatttagttgatatgacatataagtgcactgtaattttgataaaaatgttgtgtaagtaaatttttattagttattttattttgtaatccgttggatgcaaatccaagggaagaaaaaatctgggtgattttttctcaaaaatcacccgagcgatgcataggcggtcccaaaaaaatttatggctccgccaataactggcagcaaagcggcatgaatttctcacaacgggccacaatattgttgcgggccggaccacaacccatcgtaacaaatgccttcctaactaacaagcttggcccaacctttctcgcttttcctttgtcgtcggtactaggaataagttcaccggagatccctcaacttaagagcgagattattttagtgccttaaccacaaaaccagaaatatatacccctaaacttacacaaaccgtacactcaaggtcctataacagcatacgtgggtggttttgctgacgtggcatcctagtcagaaaaaaaataaaaaaagtacgtggagcccacatgtaagattcacatatattttcttctcttttctcctcctcctcttcccttttcttcttatcctcttcacttttctcttcaccagcggagcggcggtgggcagagcatcgatgggcaagcacgacagcggagcggcgggtgtgcacggagccacggcccataggtcacgagaggttcggctgtcggcggtgccggcccgcgacacaagagaaggggagggcgtcggcgtcggtaggagagctaggcgcggggggagggggagagggggtgggttggggagtcagcaagccgcgggcggcggaggcggaggcgccattgccacggaggtagcatcgtcagcgactggcgtctgatgatgagttgatggcgtacatgaagtattaaatataggctaaaaaataactaattgcacagattgtgactaatttgtgagacgaatcttttaaacctaattgctcaatgatttgacaatatggcgctatattaaatatttggtaatgacggattaattagacttaataaatttgtttcgttgtttactaacggaatctgtaattagttgttttattagtgttcgaagaccccatacaataccttatannnnnnnnnnnnnnnnnnnnnnnnnnnnnnnnnnnnnnnnnnnnnnnnnnnnnnnnnnnnnnnnnnngtcatccaatggcccac

SEQ ID NO: 6878 - DNA, 6069 bp, Oryza sativa
  unsure (1)..(6069): unsure at all n locations
cggggttttgnnnnnnnnnnnnnnnnnnnnnnnnnnnnnnnnnnnnnnnnnnnnnnnnnnnnnnnnnnnnnnnnnnnnnnnnnntactcgtgtctactcagtggaggtacttcgggtaaggtttacaaaggaacgcttgaggacaatacggtggtagcggtgaggatattttccgaggcacttgagggtttcgaagaggcgtttatcaacggagggatgatcctatctcaaattgtccacaagaacatcatcagactcttgggttactgcttgaatgctgattgtcccgcatttgtgtacgagtatgctgctagaggaaccctctctgacattctagatggccgtgaagatttcccactgcatttacgcgtgaagatcgcagttgagacagcagaagcattagagtacctccattcctcagcagctggtatgatcagacatggctatgttgcaccatccaagacacttgttgatgacagtttcacgccaaagctgacgggattctcatgggcgcagaggctcaacaatgatgacagcgcaattcatgatcatgataagtactgtgtgtcactaaaactgaaaaccgatgtgtatcagtttggtgttcttgtcttgacgctcattagtaggaagaactttgcgttttatgcggatcacgaacaccttgtctcgcaattccttgcagcttacaaggcagataacagtggaagggcatttttcgacgatgatatcacaactcgtagcgaagatgttgctctcctcgaagagatagggaagctattgctcaagtgtatttgtttggaaatagatcaaagaccaacaatgaaacaagtggcacaacaccttcggatcattcggagatgttggaagaataattgcacagccgatggagcttcactggtaactaattaaatctcatatatatcactagagctgatcaaggaactgaacttgacagtacacttggttcactctaagtgatcgtgtacaagcattgtgtgtgaattgtaatatattatttgttaccagaacatcttgcagtatatgctgccattcggatgatgttatctgaacttgcatgcaatctgcttcttatgcggtcgatcccatgatgtttatctgaacttggttctactagtggatatagaaaattcatgttcaatgttggtagtggtgtttcccttaatacatgtttataaataatttgcgatcatgaagctatatatgtaaaccatgtactccattgttattcagttcgtgcagcttagtgaatgaacagattgtgctgcacctgtggaccatgtaaggtatcggaggtcctcctcttattctacggaggggctatatcttatagcccgcatccttcatcttccccaggttgagtggaaggaaggccacagtgcttttaggaggctccacaccgatagagtttagccagtcggttagggggaggtccccctatcttccccccaacagtagcacctcaagggctcaagttctggtggactgcaaggcatatcagagggtgacaatatttttgccaaaacaatgacacagttcataattgtttttgtatggattgaattatttatggttcagttcgaatagctagctagttactcccattggccagtggcatatccaggatttcaggctaggtggcccagctcaacaatttttaagaacactatagatttaatgtgccaacgtttttttatttgatcagattgcgtttcgtaaattctacacttgtacgttggcatattacatctatagtataataaaatgaaccaaatatctttaaatttaccattctaataggaaatccagtatcaaaatgaaattgaacctcgagggtgggaggagatgagaacatgttgcctacaggcagcggtcataatatgtctattgatgtcatagcatactaattatatatacttagaatatagtgttatatggataagcagtttaattataagttttgctgaaagtcatcggcatcgcctgacaccaatgttagcattgtagattcgtccttgctgccggtgtttgattctgcttcaaatcgccaccgccggttgccgccgtcgtttcacaaaagacgtgcgtgggaaggcagaattcaagtagacgctgtcatgcggcgaaacaacgaagcatcgatgtttttttagtagtgtatgcaggtaatgggccttggtccattctatggtggtacatgcatcacaaggatcatactgtagctctgcatccggcatcgactataagtattgttttgtcaacatggtcagaatttgttttttcatcaaattccttttacttttagcagaacatgatcaaattctactgatacttactgcaaattaacaaaacaaaatccaattccgatccaattggcctgaactactgtgattttataactattttatatgggccgtgaagttcaaccgttgttcctcaaatggaataagttcatctaagataccttaacttgtcaacgaatccgattttcatcattcaaccgaaaaaccagataaataattctctcaactattaaaaccggtacaatataggtcccatagcggttttagattacgtggccaatttgactcgatcttcatctgacgtggcattaacatggcacatgaaacaaaatttaataatttaaaaaataaaacaaaatatataggcccacatgtcagtcaaataataaaatttaaaaatagtggggccactacctcccccacatcccctctcttctctctcctccccttctccagttctccttatcccctcctcccatcgtggagtacacagcagcatgccccgcgatgtcgggggaggacggcggtgtggatgcagctgccgtgtgccgtccttgctggcagaggacgcgatgaggatgacgcagctgccaagcgtggatccgaaatccgccttccatttgagcatcacgccttcttccacgctgatctcaccggcgaggagctcgatctgcaggcggagggtacgaatgccacgaggacggaagcggtcgaagtggtcattgcgaccaccggcggcggaggaggagagccatccgtgatcttcgccggcgtcacaccgctagcgggaccccaccggattttcgaccatcaccggcgaggcggaccggatctggagaaaaggcgtggctccgtggagatgcagggacaccgccggcgaggacgggtttcctgtcctccctagcgccggtagcccctccggcctccccgtctcgtctgcgcttgccggtgtggagagatgagagagcgtcggtagagagagagaagatagaggttaggagaaagaggtggaggaagtgggacccactgacatgtggatcccactatttttttttgactgacatgagcctcaaatattgtttttaattttttggttttcaattttttattttttattttcttgggatcaaactgccacgtaagtgccacgttaatgccacgtaggacaaatgccgagtcaaacgatccacgtaagtgccacgtcagtcaaaaccggggtcaaatactgccgtggacctcgtttgtactggttttgtaagttggaggatgcgttgtatccggttctccggattgaggatgaaattcaggctgggcgataaattgagggacctaaagttaacttagtccctcctcaatttggtgtaatgggcttgaatgatccaggccttttcccaaagagataataaataacagtcatcttaaagtattttacaactattttctatgaggcaaaaaaatatatattaccaaaaaaaaacaagcactacaacccttaatgaatcgatcttagttgacactagaaaatcaaaatctcatatacttgttaggctgtcatgcactggcgatgcacccgtaatggcagtgccactccccactaactaaaccttgtagcacacacgtatgtagcaaattgattagcaaaaaagaaaaggattcaggtcctaacataatgagattatcaaacatgaaagtagctggacaagtggccaaacttgtcatatatcaagcagaaattaaaccccaattccactaattaatcggacaccactcagcagctaaatcaaaccaaacaaaagctagaaagaaaatggtgccaatttgccgaaccagaagctaacacgcgttaacgtacggtttggtatgaccacactaaagtacagtgctgaggagagccaacacccactcatcacttaatctcgcatcttctagtagaatttgctagaaaaatttggcttttttaggttaaatatcaatttgatttcctgtttttgaaaagaaaaacatatacctttatcgaatttattccgatacccttttcgcatacttgatatatgcggttgtaaaatcctttatgcgtgggaccaatgtaggggcagatccagcatgtgacatagagggtacaattataccctaaattattttgtaaacaccctttattaatttgtataatatatgtttgaggagtaaatgatttcgaattaacagacattgtattgataacctacagctagtatatacttaagagaaaatctcggtcaactgatagaaaacaagacatatttgcattactcatagtcactataaatcgataggtattatccatgtaggtgcgggtcatatatttaaataaatacaattctatatttaaattttgtctcaaaataaggacaatccaactatactacttattattgtgacattaatcacatttaattcaaatttctgttcgtcttacagtcagctaccatctcactccgtaccatttgtcatttaatagggggtattttggataattttccttctattttattttctcatctcacttctaaacttacatttacaatgagatggagcgagtaaatgttaaatctcatccaaccaatcgtttatattatgtaaggcacattgatcttatacacgaaggtacatgaaggtaagatcctgttttggatgtagggactaatttttaacccctgtcggattattgaaactaattagaagtattaaacgtagactaatgataaaactcattctataactctgtactaatgcacgatacgaatctattgagcctaattaatctatgattagtttatgtgatactacagtaaacatgtgctaattatagattaattagacttaaaaaaattatctagcaaattaactctcatttatgcaattagttttattattagtttacgtttaatacttctaattagtataaacattctatatgaaatttagtccctagatacatacaccaccaaaagtatggcagatgtttggcatgttgggcagcaaatcaccaccgacggaaaacggaacaaattttgcttgaaaagaaaaatcagtcgtttgcaggtgcagctcagcctatactccacttgagtgcggttgctattaataaacgcgtctcgtccgcctctctctctctctctccgctgctctgcctgactgcctccatcccccaccgcgattgagatggcagcaatggcggcgccgaagctcctcctcggcctggtgatgttggtcgggtgcgccgcggcggacagccaccgctacaggccgggcgacgccgtgccgctctacgccaacaaggtcggccctttccacaaccccaggtccgtccgtccctccgcctctcaatcttccttaattcggagtttctcaatctttcctgttccaatccccacaacgaatctatacgagtaccaatttaatttgtaggagcaagattagattccttctgaaatagtactgtacaagcgatattctgaaatactgcatcctattaacaaacctgcagaattgttgaaaacaagaaataatttggaataattcaggataaaagaatttaattatgcaagggatcatttgctttctttcagtagggtaataaactatgatatccattgctcccaggacagatactaccgaaatttaagacgcccacggggatcctctagagtcgacaagcaggcatacatgcctagtgtcataggtaactacaagcaggnttacagtc

SEQ ID NO: 6879 - DNA, 1483 bp, Oryza sativa
  unsure (1)..(1483): unsure at all n locations
nnnnnnnnnnnnnnnnnnnnnnnnnnnnnnnnnnnnnnnnnnnnnnnnnnnnnnnnnnnnnnnnnnnnnnnnctgctactagagactgcaaatatttctctagtagcgatgccgtcagttgcgctagatttgtcaaatgcttcaagtggatttatacataatttcttttctactagttgttgatgtatattgtagagtgaatcacagatgtacaaggttcagctttattttattctcacacattgattttgccccttgcagtgagacgtaccggtactttgacttgcccttttgtgccccaggttagattctccctaattaattaaggtgttgctagctgtaatctgccttatgtttacttagtgaactgtgtcatctcccaagtggaggccattgacttctttactataaacaagaaagattctttgcaattaagctgaattttgattcctaacaccttctagtacagaactagacttgtttttctgatgcttattcaattttacagaaagatgaagttctgacttaacctccattctcttttaatcaagttatctgtgttgtcatcaactacagagaaagtaaaggacaagattgaagcccttggtgaagtccttaatggggatcgtctggttgatgcgccctacaagcttgatttccgtgtagattttgatgccaagtctgtttgcagtagacggctctccaaggatgatgtggtcaagttccgacacgctgtttccaaggactactacttccagatgtactatgatgaccttcccttttggggatttattgggactaagccagaaaaggcagatgcaggggataagtattatctttacaggcacatcatctttgacatcctctacaataaggaccgtgtaattgagatcaatgtgcacactgaccagaacgcggtagtggacttgacagaagacaaggaacttgatgtcgaattcctttatacagccaagtggaaggagacacagataccgtttgagaagaggatggagaagtactcgagctcatctgtcatgccacatcacttggaagttcactggttctcaattgtaaactcttgtgtcacagttctcctcttgacaggattcctggcaacgatcctcatgcgtgtactgaagaatgattttgtcaagtaagttatcatttcctatcctttgtggtgattgattcgaagattgaaattttttctagtgacaatatagataggtttttatatattgggattctctagcttcattcataactaagaacaaaatatcctggacacttgtttatatagcttcattcgtagctttgatttctcaaggtttctattcatattattccctttgaaggtattcacatgatgaggaggaacctgatgaccaggaannnnnnnnnnnnnnnnnnnnnnnnnnnnnnnnnnnnnnnnnnnnnnnnnnnnnnnnnnnnnnnnnnngagcagtcatccaatngcccagcg

SEQ ID NO: 6880 - DNA, 8518 bp, Oryza sativa
  unsure (1)..(8518): unsure at all n locations
cgacgccttgagnnnnnnnnnnnnnnnnnnnnnnnnnnnnnnnnnnnnnnncaacatttatattcctacttgcactggtcggagtattctatccttacaaccggggtgcgctttttactgcactcgttgtcatttatgcactcacttcaggaattgctgggtacagtgcaacctctttctactgtcagttcgaaggaaaaaactgggtatgttctattatctatattacagattagcattgcataaatgccttggaatcaggggtcgtattatcttgttattcctattttctgccaattaacatcttagtttcttctgtttgtaggtgaggaacttgctattgactggatgcctgttttgtggacctctctttctgacattctgtttcttgaacactgttgctattgcttacaattcaacggcagcattgccctttggtactatctgtgtcattgtgctcatatggacgctggtcacatttcctttgcttgttttgggaggcattgctgggaaaaacagcaaaaatgagttccaggctccttgccgcaccaccaaattcctgagagaggttccaccacttgcctggtaccggagaaccattccgcagatggcgatggccggttttcttcctttcagtgccatttacattgagctgtactacatctttgcaagcatctggggacacaggatctacacaatttacagcattctgtttatagtctttatcatcctccttattgtcacagccttcattactgttgctctgacctactttcagcttactgctgaagaccacgagtggtggtggaggtatgcattctttcaccttctactgttgtacttgctggattgcatatgatttccattctagcatcaaaacagagttgtcttcatttaaaaaaaaaacagagttgtcttcctcattagatatcacagtaattgtgtgttttctgccaattggttgtctctcaggagttcaagaagccattccctgctatgccttgcaagttctaatgcatcttatcctttcttttttttttcctctgatgcaggtcattcctttgtggtggatcaactggatttttcgtcttcgcttactgcttatactactaccgtgaacggtctgacatgtctgggttcatgcagacatcattcttctttggttacatggcctgcatctgctacgccttcttcctcatgctgggcatggttggtttccgtgccgccttgctgttcgttcgccatatatacaaatccatcaaatgtgagtagactatgcatagttggtgaaggccagagatgaaagaaaccagaggtagctgatgcaattgattagccattattcatagcaaaaggtagtgagcagtaaatctgttccattttgtacgactgatgtggtgaattttgcggctctttttttatgtgttatgtccttgtaatttgcatcattgttgaaggaatcgtgcttagcaattttacaccattccattcccttgatgttgagagacagtgctgatgaattttgtaagaattcagaggagcaacctcttgaatattatagcctgaaagcttgatccgaaacaaaccaatagaaactatgacatctgtaattgttttgttacccttgagtgaccactatagtctctgtaaacactagcaacatgtggtactccatattttaactttcggtttgatagaccagtcgttcaaaatagtttttaaagttaaaattagttatctgaaaacacttgttgcaaacaatggtatttgataaactaatcattcaaaataattttaaagttccaattctgttatgtatatcatgacctatgaactgaaagaacacacgaattaaagcaatggcaatttatggtacttgattaaagcaatgacaagcacacgaataacaggaacagctcctttcaggaatgttacatcgtccagaaacatcagcaggatgctcatagaattttccttcagactaaaacatatattagcaatgcccagaaacaactccacagctggagttgtcagagaagctacagcaatttgcgattcaatgactgaatcgacaggaaagttgcaagatgacgaacagtatagtagtaacatttagaatgcagaggaactaacagctaatataaaaactgatcataatctcccgaccttacatcattaggaacatactttactcttttcactttcaggtcagctaaaacaaaagcagcagcaaatagaagaaaatcaagaagcgacgggcttcaaagctgcagatggcagcctagaagaagtgtgcaggaacacagatggaactatccccaaattatccacagaagaattttcggagtaaaagacaacctggtttctacctcaaacgaatcggaatagctatacaacatttgacagttttttggatgaaaaactttcatatgaatttatacctcaatgccatatgaattagcacacgagcttaaaaacatgtgcaaattcaattaaatttctgtcacggcctaataccatatgattttaaaaaggacaaagttataattgaaagaaaattttatacacagtaaaatttaggagtgtgtgtactccctccgtttcacaatataagtcattctagcattttccacatttatattgatgttaacgaatctagacatatatatttatctagattcatcaacatcaatatgaatataggaaatgattgaatgacttacgttgtgaaacagaggaagtattagttagcaaccctgtagctgtatctcgtagaagagtaaacgaacgccagcaggtttacacagctgaggccgaacatgagccagaagaagcaatccagccgtcctcgattgagatcgtcgggaattcacccgccggcgtcgccctttttcggcgccgtcgcccacgcgaccaccgcgacgatggccgagttgaggtagcttccggccgccacggtgacgaggctcaccgcggtgcacaggctctttatggtgtcgggcgcctggtcgtagaagaactcgagcaggccgacgctggtgaacacctccgccgcgcccagcgccatgtacgacggcgcctgccacacgatgctcgtcgccgcgcgccgccggcggctcgcctcgagcagcgccgagtacgccatggccagcgccgacagcgccagcccgacgccgagccgctgcagctgcgacaggccgcggcggtcgccggtgacgcggcgggcgagcggcatcagcgcggcgtcgtaggccgggacgcagaggaggatgctgaccacctcgaaggtggacagcgtcgccggcggcacgtcgagcgggccgacgcgggtgtccatcgccttcccctgctccacgaacgtcgacgacatctgcgccgtggcggcgaagaagaacaccaccgtcggccacacggtggacagccgcagcagcatcttgacctcctccacctgcgtcaccgtgcacagcatccacgggctcgccatcgccaccgccggcggcgacgccactacggccgccttgtccaggaacgcgaactgattggtgtgctcgatgatccggtagtcgccgtcggggagctgatgcaggagcgagctgtcgccgggaagctccacgccgcgattcctgacggcggcgacgaccacctggcagagccgcgtgagggggctccccggcggcgtgtggaacgcccggaggccgcacagggtggagcaaaagaggaaggcggcgagcgcggcggtcatgaccgccgccgggatggcgaagccgagccaccagccggcgcgctcctgcacccacacaagcacggtggccgccagcagcgagccgacgttgatgcagaagtagtaccagttgaaaaagaacgccctcgccgccggcgccgcgtggttgtcgtcgaactggtcggcgcccagcggcgaggcgcacggcttgatgccaccgacgccgagggcgacgaggtagagccccaggaacacggtggcgcggaggacgccatcggaggatgcatcaaggtgtggggttgcgaacgacgccgagactgtgagcgtgatcatcccctgtcacagattgaaattttataacgaaatttcagaaatttttcgttctttattgttttttcagtccactggtgaagaccatcaaaataatttgtgaaacaaaaattaaatcttaaattttgattgacctttaagaaattcttgattgccataagaagatgttcttttctaaagaacttgtgaaaaaaaaacataatatcttcttaatttttgcttgacatttcgcagaaattcttgattgccataagaaatttattgttctctctctttttcagtccctgtaaagcatgaagaccataaaaaaatttgcccaaaaaaaatcttcttaagctttgcttgacctttaattccgaaattctctattgtcatatttgatatgcttttgtttgttatctaaatcttgttgtaaaaacatttcattcacaaaaatgtctgaataatgaaaattgaataaaggagtatgatatattttcacattaaaaactaagaaaaatctcttcaaacattcagtttttcgcattaacaaaaaacttgtttgagcatacttttcttaataaataaaaaagtataccatggagtagatggagaggaagaggaggatggtggtgcggcgacccaagaaggagtcggcgatgaatgcgccgacgagcggcgtgaggaagcaggtgcccgtccacgccgacacgtccctggcggcggcgacattgctctcccctaccacgccggtgaggtagctcaccaggttcctcgcgatgccggcgaacgccaggcagtcgctcagctccgtccccagtatcagcacgcacgccctccacccaccgccgccgcccttgtcctcctcctccttgccgccgccgccgttcggacgaagcagcagaggcctcttctcctcgtcttctgctgctgctgccgccgccgccgccgccatggagattttgcttccactgtgtctgtgtgtcttgctaggagctactagctcatggacttatgtcatatcgtatttccgagtgaatatttaagaaattttgatgagaatttagtgggggaaatttagattggagagaggagttaggtgtatgcacaagctgcaattgccaaaattgatttttgggatttgactcaaggtagtgtacatgccaacttattaaaaaaaaggatttttgttacgattagcctgttgtgttggttaatctagcgttgctgaaatgatggagtattttaagaataaaaaaaaaattctaaccttatatagattatttttttctttcatctaattttattattggtctatgattacatgagaggagaaatggggttctatactatagagttgcactcatagaattgatagttgacgttttcttttctttcttttttttttgaaatgtgtatgtagtactaatatctattgagttatttgttagaatctggtttccttaacggagattgaactagccattattttagctaatgtatttttcctttcagcaaagaaagctactctacaaaccttattaatttcagcaatgatagaggcaacgcatttcaattatctttagaaaaaatgcgcaagctgcattcgtagaatttgattggttcatgtggaaggtggggtttggatccagggacttaactttagtccctgtctttagacactaatttagagtattaaatatagactacttataaaactaattacataaatgaaagctaattcacttgacaaattttttaagcctaattaatccataattaaagaatatttactgtagcattacataggctaatcatggattagttaggctcaatagattcgtctcgcgaattagttcaagattatggatgggttttattaatagtctatgtttaatatttataattagtatccaaacattcgatgtgatagggacttaaaagttttagtcttatctaatcagggcctgaaatctgagccacgcaaaccaccaaccgcacgacaaggttaattagggcctgttcactttgatgccatttccaaccttaccaaattttgataaagttatcaaaaaagtggctatatttagtttgctgccaaattttgataactatataagaaatcctaccaaaattttggcaactatgccaaaattttggcatagttgccaaaatttggcattgccaaaatttggtaaggttttttttggcgtcaaagtgaacaggcccttaatttccatgtctccatcacactcacagtgccagcggttatactgggcagactagtcattcctctgttcctctttccacgttcatctgtaggatttaagggcctgtttagttcacgaatttttttttaactgtcacgtggcatgtttgaccggatatttgaaggggttttcggacacgaatgaaaaaaataatttcataactcgcctggaaaccgcgagacgaatctttcgagcctaagtaagccgtcattagcacatatgggttattatagcacttatggctagtcatggactaattagactcaaaagattcgtctcgcaatttccatgcaaactgtgcaatatgttcttagacagaaaaagtaggtagtagcacacattaattctagatgaagaaaaaaaaaactatgatatctctcattaaataatatgtggtgaataaaaatattgttgggagtaagaccggacagaagttctaatgattgtagctaacatataaatttataaaaaatgttggtcaaagctaaaaagtttaataagtataactaaaacgacgatgaatttaaaaggagaaagtacacaattaatataactacacatacagatggataagtcaccccaaattaacgtggtctttgaataaacgactgtcgcctattctttttcacgaattagctcaaaccattccctggatcaacttaattattggacatgctattaatcaaccactatctatgactcggctaattggtgcatttcggcattcatggtacatctaatttaaaaatgcatgttttttatgggagaaatttttactgcactttaggaaatttgtagtacaccgaattttacatttaaaaaaatatctccactacctaaagtattaaattttatcataaaaaaatatggtacctttgaatatattctcaagatagtaaaattactctttttacttactgccgacgtggataccccaagacaggatgaatagggttttagggtacgttggtacgatgatctatacgatacaacatcaagcaaacaagaagacaaggattatactggtttagatccctcgtaaggtaatagccctagtccagtttgtatgagattgacatggaaaaccatagattccaatagaagaccgacgattccaagattaccggcgagatccttgtcgagatggtttcgacgagatctcccagcgagtaggcttcacatcctccgatttgtaggctatggtggtggtgttggcgtatgattcgataccttaggacccctagggatgtgtatttataccgtgagttaccttgatctccaagtagaactcggagataccgaactcaccacgatacagtacaatcctgaatcccgatccttttccgagtaggactatgttatacacttgcctatgaggattatttccataatcttttgtcgatttccttatcgggaaacatatcgtacatacgaaggtatgcagtatccgtatattccataagtcgtaggttagaaggttgtatcttacccgtaaccatgacacttacctcttgggaacccttcccatctacacgcaaaacagagtaatagattaacacatgattaattaagtattaactataaaatacttaaatggattaatatgatgtttaaagcaactttcttgtagacactttttacaaaacacgtatcctttagtagtttgaaaagcatgcgcgcaaaaacacagcctaagtaccttttgatcaagagcatccgaaaacatttgtttttaacttccatttgtttcttcgacaacaagtttccacactttccagtcagttgccaataatttgactatagcatatgcatccctgaaaaatcaaggggtggcccataagctcacttctatcacctctttacttattatagatgaaatattaaaatacgtctagtcaaactttcaaatcttaaatcaccaacagataaaattaatttatgaagatttgttatgtgaaaataattaatttgaagtatatgcttcaatggaaaaatacattcatatgattataattcccatatgaataatgtaaggctatgtacaacgttgtgtaataacaacctctcttcattaccatgtaagtaaaattgatgacgtggaaaagagatagaggaaaaagaaacatgggtgctannnnnnnnnnnnnnnnnnnnnnnnnnnnnnnnnnnnnnnnnnnnnnnnnnnnnnnnnnnnnnnagctgtcatcaatnggcgcat

SEQ ID NO: 6881 - DNA, 6025 bp, Oryza sativa
  unsure (1)..(6025): unsure at all n locations
gatcccttccccccatggttgtccttcttttttacccccccaccttataaaaaaaaaagggtgcatatatgatcaagcttttggcttgtgcggttgatttgatttgttcgaacattgaagaaaaatgcacatgaagtatctcgatttgaccctgtttccctttccggttaacatgagtttgtttcaacatccgaagtcaatgacatattccaaggaatgaccttgttattatggacatgtaggcagtgtgtaagcacatttaggagtgccaaaggctaggactcaccaaggctattggtgttatcaacctcagttgcaagaagctcaagacattgctctccttcgcaaccatctttcttgcagcaaatcaagtaaaagttccaaacattcctatacattataataattttcactcttttggaattgcatctatatatataccatcacctagagaaaaacccattagcattatttagtgggatatcaatattaaagaatggaaaaaaatagtgtccacatcggcgattccggtcaagcttcacgatcagctagagcccaagaanttttcctcctcccgaacacagcctaagagttcttattgtctcaactattgtagaagtatagttttctaagtgctagagtatgtatttacctttgtacatgtcttaagtgtgtcgttgtccagaacgacgataagaaaaaaggtaaaagtgtcaggaagcctagagatcgtgaggatcccagacgagcaccttacgcgcgtactgtagccgatccggcaacacaagaaagaaaggaagcagaagaattttggcgtagcgcaacagctagctgcttttctggtttacttccttatataacaaaatgggattacaatgaaatcaaaaccactaggaccgcttctcacgctggcaattcgctgcgtccatccccacagctgctcaacgtgcgtcacgctctcggtgcacgatgcgggctctatgagctaatctcgcgaccctcaactggagcacgactgccacaagtttcggcaagctcatgcaaagctgaatcaaacaaatgcagaaataactgaataactaactaactaactaaggcacacacgttgtatttgcaacaatgagtaatttggaaataatcactgccaacaaaaagcttttggttgggggcggctagttgacgcaaattgagcttgtcctatgtctggcgaattgaatcagagtcacacacgagtcgcgagtagtgaggggacaatgcgctaacacacttttttttcttccccttgatgaaattgtataataattataaataaattactaagttaaaaaaattcaaaatttgagttgaaaggttaaaagtttgtgttgaaagttcaaaatttggatagtgttttaaaaattttctgtgaatatttgaaattttgagttggattgggtaggtttaaaatattttggtaaaagttttaattttgagttgagagttccgaatttgggaggaagttttaaaatttatagttgaaagtgttaaattttgagttttgaagtgttaattgaagtcaaagatttcaaattttgagtatagtttttcaactggaccttgtgcaactaaaaaatttctatccaaatgttaaatcttttcaaaatcacttcaaaaatcaaattacttaaagaagtactcattgaatgctcattcgcacattgggagtcctctgtgcgagtcgtgtgatatgttaagagtcacctgaattaaaagaagtggtgctttagaatcagaagtagcgagcgtgcactaaataatatttccatcacctatgatgcctacactcaactacaaatacactcatcgttaattaaccaaagaacaaacggattaaggaaattcgtccattttactccttcaaactattattcagctcattttactcctaaactattaaaaatgtttcactttattcttagcatttctctttatggtttatattttatatgggttgtattttgaactgaaaattattaagccatttatgacacataaatgacatacgtatcaaagttccaaagtacttcacttttctttcatgattatttcattgaaatttaaaatttgtttgaatcagtcttaggtgttttcgacttatgcaaaaagtggccaaatttaaaaaaatattactaagaggtaagttgtaatatgcatctatcgatcgttttgaatttcaatgcaaaaatatgatttatgtgtgtcgacgtttgatgtttcgactacggtatttggacagtatggggatcgtcggtgctaggatatacgcgagactgaggtaaaagaaacggagacgaggatttttatacaggttcgggcccctgagctgtcaggtaataaccttacatcatgttggccggagccggagttgcttttattcaccataatcacaccagtacaatatgtgggcagcctatctaactgttgtcgacatgttggtctgaaggtctgactcgtagtcgacaacagggtagtcttcctcctcgaatccgtgcccggcgagatcagagatagcgctttcgtatctcctgacggtatccggagacaccgtaggggaatagccatgcctatccctgaagtcgatatccggcggtgtgtcttggcgtatgtaggcttgtatgttgtggcttctggtgggcgtgtgttgattgtcatgggtgtcttccgtggtggttctcccctctcctcctagggggtcttgtatttatacccataggtgtccccttgtccaagtagaacgagggaaaccaatatggatacaatctgagtagtcattatcgtttccatgtagaactctagttgtctttccttatccggaactccctccatatccgcaggttgtttccgtataggacatggtatgtggtgggtcctgccaagatttagtcaactactattaggtatgtggtatccataaccatgacagtagcccccgacttcgatgcaaatgaacgaattcatattctcaactgcgcacagacattggagtaactgttatcgagcttatgtgaccgttctcggtgagattagagataacgttggacttcctttgtcagcctcatgcgggcaccgaaagggtttgtctaagtcattctctgatgtcaaccaatgaagtacatagcgtacgactaagtctcccgtcttgccgtaatcgagaatttggattgaagtcaagaaattctttcttggtgggtacaccatctcttcatttcgtattccttgtcgagatccagcaaccgttctcgagcgaccgagaaggcgtagagtctgcgacggagccttgccaacattggtcgtactcgccttagtcgatcttggtgtagaaccatagagacatggagtctttgtcaatgtcgaatagaattttcctaaaatcaatactcagaaaagaatattagatagaaataacccccgagcgaatgctcaaagggtgacatgttataatatgtatggtaaactgaaaatgaatcaaatttaccgaccaatgttttgtgtaagagtgtgttctcagttaacgactttggtcagtcgtttgagttgtacactctccctagcccccagccttgtcgtcggagaatcattttcggaggagaaggctcttggacccttgacctaccttggttgaataagcactgatcctagcccccagccgtgaagttggaaaagtcaacttccgattacacggcttggttaatacgcacggcgagaactcttacacgaccagatcttacatggtctttcgtctctgaaggatccgacaaggccttatcggctctgggcatccccaacggaagatcccttaggttcctcggaggccttgtcaagacggcgtaaagggacagtaggataggtttcaacgctaggtcgtcgtggtaagggatctctgggtaaaacacttggcgatattgtgtacctgctatcaactttgttgaaatagaggtagtaggagagtcgctacactgctagtcgaggactaggcagtagtcgtaactcgaccacgtaaagtggaaatagtgggagagacgttacatcgctggtcgaggaccaggcagtagtcgtaactcgaccacttaaagtggaagtagtgggagagacgctacatcgctggtcgagaaccaagcagtagtcgtaactcgaccacttaaaatggaaagtgggagaaatgctacatcgctggtcgaggaccaggcagtagtcgtaactccaccacttaaagtggaaagtgggagaaatggtcgtggaccaggcagtagtcgtaactcgaccacttaaagtggaaagtgggagaaacgctacatcgctggtcgaggaccaggcagtagtcgtaactcgaccactagaagcaaatgtacgagagatcactacgattaactggttgagaaccggtgagtaggtgtctctcgatcattttgagtcgtggtacgaggaccactacgttattgctgtagtcgtacctcgaccatctgaagttgcggtgcgagagattgctgcgtactggtgcgagaaccagtgagtgagcagaattatctctcgaacaacgatgggagttgcggtgcgagagattggtgcgtactggtgcgagaaccagtgagcgagcagaattatctctcgaacaccgatggaaggtgcggtgcgagagattgatgcgtactggtgcgggaaccagtgagcaagcggaattatctctcgaacaccgatggaaggtgcggtgcgagagattgctgcgtactggtgcgagaaccagtgagcgagcggaattatctctcgaacaccgatggaaggtgctagagttggtttattgcaagtgtatctcatgtggccagcatgactcacgtgcctaacttacagcatatccggatgtccgttcgcaatcatgtcgggtgatcaagccgacgatgttcgcgaggaattatccattaacaaccttttctcgagtagtccagccatggccggtgctatgagataggtcgtcggtctttgttggtaggttgggtgcgataactccgcatttgtcgagaatgttctcgataatggagtgtactcgaccataacctagtcgagtgctcagttgttcctgaaaaatattttctagaagacaagatatatagcagataatatcgagtatgtattcgaaaaactgcatggatcttctagtattatcaggatataacgagcagattaaatattaggcattatgtaaaccgtaaacaagcatgatttatacagaggaaaacagagcgtgctccagcgttagaccgcagttggcctaacatcggggacgctcgcgcgatatatactgtataaagaacatgctctaggtaaacataataaattatagatctgacaatgccgtataatctgaaaataggtacggtaaattatatataaaatattgcgtacctttgtagatatatgccggatatatctacgaaattagtagattaattaggaaattaatcttactaattaccttagaatttgtactgcggctttttggctgtttagttgatctatttgcttttggcttacgtcaccagaatgagcagctcgattgccaactaggaattgaattctagtgcaatcacaggaactcctcaactccgattagactacaagccaatgaacagatcaatgcctcacgccagccgagtttggctactcgggcagccaatgccttacgccagtcgatgtcccacgcgtcgagggattggtgttggatcagtcttagatgccgctgacaccatggccctctgccgtggtgacgtgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgan

SEQ ID NO: 6882 - DNA, 874 bp, Oryza sativa
  unsure (1)..(874): unsure at all n locations
acagttgggcaatcccggtcccaacgtgtcattgagggtggaaggcgaagcgaactaccccatgccgatgagacaaaattgtgggcttaaagaagacttttaaggctctgaaatgatagtcactttttatttttaataaacctggttcaagagaatttttagggaaaactagttttacattccttatcaagttagcatgcgttttaagaatttgtagtgtattggcaaatatttgggcggcatgttttgcacagctcgctgagctgcttccaaacgatatttttacagaggagtgattgttgggctctaggctgattcggtgaagtgattttcggagctagtaaaaagaagtggcttctgctgattaacctagtgaatcactttcagtcgcagaaacgctcctttcagaaaatcagaagcaggaggaggagctttacgtaccaaactcaaactgacccaaagtgtgtactggcagcagtggcggaggcagctgcccgggctccatgccatcgcaacacacattgctccacagcataaacatcatttactcattaattgcttacataattaccttgcttcctggttccaaggaaggttaattagatgactagcgagttgtaccacatcctaatcttgctttcctgatgtatagtagccccgtactctaactccttgacaataaacaaccaacatttcattgataaattgtaacttggcaacaatcaactttaagtctagataaacggtacaattttccatatatatatatagggnnnnnnnnnnnnnnnnnnnnnnnnnnnnnnnnnnnnnnnnnnnnnnnnnnnnnnnnnnnnnnnnnnnnnnnnnnaatggccgngtcatgcanngngcctca

SEQ ID NO: 6883 - DNA, 7449 bp, Oryza sativa
  unsure (1)..(7449): unsure at all n locations
agtggaccattgatgacagcttgtatnnnnnnnnnnnnnnnnnnnnnnnnnnnnnnnnnnnnnnnnnnnnnnnnnnnnnnnnnatgcctttagttctgccttatacgtagatggaactctgggaccattgatgtcatctttgctatttagtgattaccctttaagtccatgtgttattatttgcacttctttaggaggcaattattggctagtaatctaagtcctatgtttcaaactcagcactttgtttaatcaactttgtgcaaacagtaaacagcagtcaaaatattgcaattacattctattattttttgatttgatgatcttttttgggataaagaaaattacctgtatagtttgaacatattctgctctattatgctgcaagatatcaagctatctgcataaatcttgtcatcctgaaccttcaaaaaatacagtaatatttcacatgttatgcattcaaaatgttgatcctgtctactagggcaatttaactctgtcaaggctaattgcattataaggtatgcatgttctctattttttctatttgtagattacagagaaagtggtgccatttgtaataaatgatgttatgattcagcaattttcttttttataataaagtactataataattagaatgctgatatgagaatgaacgatgatgattaatgagcatcagaattatatgaaatgttagataattaattatcacaaaagctattttctttccaacttcatatatgctgaaatgtgggttgctgctagtttcgtgttgcctaaactgcagtgttacatgagaatattgaatgtttgcacatatgttttagaggccttgagtgccacaaacgatggacagcacctttttgtaaaatgtaaatacccagtaaaattattgtgcaaaatatttggtagtctatgaagccattaggaaaataatgtaattctgagcaaatagaagctaatactgccaatactagagctattgtgatagatatagttcactgatatgatatgtgtgaaacgttataacttgagctattgcgaattgcgatagcagagtgtgctatttatcagcatcatcatcgtacatctgggaatgttgtgttaggtgatctgtacatgtactctagttccatacatgctagctactgctgtttttcttgatctgttctgttggtgtgcatgcgccagaccgatgtatgtagatctattatctgcatttgttgatcgttgtacatgtttttttattttttgaaagaaaagtatgctatgtttagcttgctgagatgcaaatgcaatgcatcatcaggctgagatgtagctgcaaatagttcactgtgatgtttctcattgcttccacagttaccatggaagcagcagtattcccatcataattgccatggaattttgtgtatatgatgtgatatggttttcactactgttcatacttgatgtgttctaaacaatgagagtgtgacactacgtatcttgaagctacaaaatgaataattacccttttattccatctatatatgattgttcttccatttggtcatttcattgtctcgtgtggtcttcacatggcttcattgttacttatgctgagatatatcgaatcctggtcatcattcatccattctgatgcattttgcactagttagcctgcctccctgagcagtttacatcgaatgcgtattgttttgttgtacaaaagattattatttattagtattgtatagaagaaataaacaaaagcagctctaatcaggtgaactatagctgcggctaaaactgggcaagtttttgcattttaacttatggaaaatcttgtttgtgcaactctccaaggaccaaagggatctgtattggccatgtttcagcacacggcaatgaggttcagacttcagaagtccaaactgatttgtgtcttcccttcccaccatgtactatactgattgctatcttgcaacttgaaactcatcattgaccaacagtttcatcgatcagagcctattaacatgcagagatataatatctaatagcatttgtgttcaagttggctcacatcttaagctatacttatatttctagagcataaacagtaataaattcataagatgaagaatggattgtatttaatacgtatcaaatatcgcattgaagtaactcgttaggctctggtcctacacatctaaagccatactactccattaaaaaaaaggaaaaaaaagataaaacattacttttagggatgaatttgaacgaatttggacttctggggacttgtcaaatttaatttatccctcgaagttgattttttttttcttttggacagagggtgtactgtagaatctaggcagcattatgcagttgcacatctggagttgcaattgtaacttttcaagatccaaattatagtactttcagtaaaacggaatgaaaaacatgcgcatataatgattttttaggctcaaatcatgactatacttaccttaatatgcatcacatcattcaaccttattagtaataatgtggtgtcatgtggatctccattctccaacttctaaaaagaagctggaactggtaacaacttccagagatggccaaactaattagcatgttggttctttattaggcactttttttttggcagaggtaatagtaagtaggatatgattatcttgcaagttaataatattaaactcttagtaagatacacagtgatatagagctcagaagacagtgaaatgagctttctctttcgttgttaattgaactgaattatcccaagttactttcatcaatttaacgaattgacaggtgattactgatcatgacatccactgatagcctgctactcatgagaacaatttactactggattttaagtttttgcttataacgtttgaccactcgtcttattcaaaattttttgaaattattaattattttatttgtgacttactttattatctacaatactttaagcacaacttttcgttttttatatttgcaaaaaaaaattgaataagacgagtggtcaaacgttacaagcaaaaactgaaaatcccttatactgtgggacggaggaagtatatatgttaggtcaaagaatgctgcttcgaggtgctgtaataaaggttaattttgttccttttgagatgccaattaagctagccaaaaagaggcgattgcaaactggtaggaacaaactatatgagaaaggttactttctaaaggaaattatgataatgttgtttgaccaaagctagcaaaggtaaagcaaatgcttccttttcgctttcggtaatagcagtaacatgtcgatcaatcaagagaccaaatattgtaattaattaacaaatggtaaacaaaagtgctcctcacaaatggcattttaccgaaactgattggattatgtattttaccgaaactgattggattaacaacttggatccatacaagtcaattgcctcacctgcagagctcaaatattcctaggtaatttgagtgatcatcttttacaattcagcttaatttttttcaggcatgcctcaaaatgagattcatgtggaaatcatgcacaaaattatggaagtttcattaaaattcatgtaaaatttctctcttccaaacttgaatgttccagagttcctagcagatgagaatatgtagtctcctacgcctatcagtctataaatcgagaaagcatggagactgagtagtagtaaaaggcaatgcgtgcacatggcaggatgaaatcaaaggtgctttgcaatcgcaaaggttataatagcagcagtaaactagtcatcaaagtaattaaagggaggcatcttagcttgtggatgtgatgcatcaagcatgcgggcagagacgccatcatgaatgtaattccctttgatctaatatttactattttttcctaaaaaattctcaacattttggtttcagtttcagattcaactctgaagatttttgttctgtgagaaacaacagattccatatatgaaggtataagatatatactggtattgcaaacaaataattaaccatattctctgcaggtaaaagattttaatttgtgtcaagaaatataaggtagtatttacccgcataatttggagatatatgcaacttcaatagcaacgcacaagttgtacatctaggattttggtacatatctccataacaattccactccagttaggaaattgtttttgcctcaacaaaaagaagaggaaattgttgcacactcctaaattatttttagttagtttctctcttttttatttctcattaaagtttttgagacttgccatcagttatgaacaacacctatcttctttttagttttttaattgaatatcacacatgcctgcatggatctcatcagaaacatagccacgtttgtagtgtactgtttagatgctccatactgatatgatgattagatatgtttcttccacaacatcaatcccgacatccaaatcgtcagaagttagcaatgttgcatttgttaattggatttgccaacactaatgcttgtgggggtaattatgattacacgtgcggcgccaaagcataaaagtgactttgagcactcaaaggggacatgaccacccttgttaatttacttgtattttaccaccattagtgggatgtatgacatgcataatatgacgtacacatgcaagttaatgttaattatttgagcaaattaagtatactatgtacataaacatcacattcaccatgtctaggtctagtatctattgatgcatcgtcggtacccaatgtgctcaatgatacatgtcacataggaccatgagatgtttaatgatgttgacctgccaagtttttgtacaattttttcccctaaatgctttccatatttctgtactgagaattctaaaattgatatatataggacgccagacctttttctctgaatagtgtgtgataatctggaaatttattttttttacggggaatctggaaatttatttaatatgcacgcgtaatggtgtgcgtgcattttctacaaaaataatagcaccttaattattagaattctagttattgagttcacaaccatgaaatcaaataattactttattgaagattaatagataaattatgcttaacaatcttaaataatagaattttgttaattggaatgccattggactacatgaatctaacctaattgacccaaagaaaaaaaaaagaagggaacacattgaagttaagaacatcattagtaaacgagattgggatgaggccgtgtgaaatgatctccataattaaaaccacttaaggatatatctttagcacggattattcatgatatccaacgtgcgaattatgtacttcatccaaccttgatctacaccctaccaattaagaattaataagaacaagaacaccaacttgatgcgggtagaatattggtgccatatgctgttatgcgcagcatcagtacactcctagagaagttaatttccagagtaaaaagaagaattaatttgataaaataccactcatttatagatgaatatatatataaggccttgcctaccatacatttcctttatatatagtttgctaattagttcatagaggattacataactctttacatatgaaactgaatatatactcgcataaatattatcatattcaattttgtttctccatcactaaaaaaacataacagacaaaaaaacatgatcttatcacatataaagtgcaataataatgaagatagaaattattaaatcacaagggccctaataggaagcagagtaaagaggggagcattatcatctctaatgccaataggaatttttttaaagaagttgatgtgatgtccctcccctggtagccctcctgtctgtgatggaccactgaattttctccccttaactttctgagtgcatgcagcacaattctgcctttcccatgcacacacatgatttcccattgatccctaagcaaagcaaccttgatatgcacacaaaaatatatatttgcaggaactttaaaaatccctttttctaacatcacatctggtgacaagtaatataatgcagatctccccactcaaccagagacacaatcactgatgttactcgttaaacattattctgcacaaatagatatgtgtctgaactctgttaaaggttttccatatcgtatcaacataaaaatgcttatgtgtcggttaaattttttttagagtatattaaatcaaatataatttttggctctgaaattgggactgtacattgatcgatgtaccgctcgcggtctgcttttggttctccaaggacgctttcaccctggttagggtgtggccgtgtgtttagttgtttgggcataaagttttcgaagtatacagacgcatatttgaagtattgaacgtagactaataataaaacaaattacatattccgtctgtaaactgcgagacgaatttattaagcctaattaatccgtcattagcaaatatttaatgtcgcatcacattgtcaaattatggtgtaattagcctcaaaagattcgtctcgcaatttatatgtaaattgtgcaattggttttttcccacatttaatgtcccatgtatatgtccaaacatttgatgtgacgtttttgaccaaatttttttatctaaacaatgccttaataaattgacattaagttcctccttactgtcccacacatgtttttttattttgtacatgagattttctcagctatttactcgatgatatgaatccagaggtttctcaaagaaaaagaaaatccgagtcagattttatgcatcctctgtgcacttgtctctgcttataggaaaaagtacgaattacccccctcccgaactatcacgatcgtccgaattatatttaataaaacaatgaatgatctctaccaaccaaacaatatctcctaggctagtatgtgtttttcgcgttaccagtggcgcacacgtggtaatctagtcagcattttatttaataaaacaaatgtggggcccacctatcatactcttcttcctctctctttctattctctctcgctcttttctctctcacgcagcgcgcacggcaaggacgggcggtgggagtgggcggttggcgaggatggcacggggataggcggtcggcaaggatggcgtatacggtagcgcggacggtgcggacgtcggcgtggaggcggagacgacggaggagcgtggcggcaaagctagctaggtggaggactccgactccagtgactcggtgatgctattggtgaggtaaggacggcggcgagtagggggcggagccagttgtgggtggcggagggggcccgaggacgatggcggctggcgacggaggcggaggctgacccggcacgcggggacacgcggtgggcgatgggctcgtcctcctcgtcgtg

SEQ ID NO: 6884 - DNA, 9023 bp, Oryza sativa
  unsure (1)..(9023): unsure at all n locations
cccatttgtgggtgccggaggggggcccaaggccaatgggcggctgccaacggaagcagaaagcctaccgggcacccggggaacgccccggtgggcaatgggcctcgtcctcctcgttcgttgggcgcgtggggacggcccggtggccgccgccttcctcctcagctgtggcgcacgggaacaccgggtggaacaccgccgctaaggcgggctcctcctcctcgtcgtgggcatgtggttgccgatggcgcgcagggactccggtggcgggcgggctcctcctcctcgtcgtgaacatccggtgggacaccactgccaccgcggctcctctttcgagccatcgagccgcgtctggtcctacctccccgcgcctcgctcccagtccgtctcacgcctctcctcgtccgccggcaatgcgccggcgccggcgcagagaaccgggcccaagggcggaagaaagagcgtgccgccacgctcgcctcacctcgctctgccgccatgctcctcccccgccgccgctgccccgtgatagagagagagaggaagaatgagacccagatagagaggaaaagtgagagagaggaagagtggaagagtatgacacgtgggtcccacatttttttaataaatagaatgttgactggactagcacgtgtacgccacgtagaccaaaatcaccgcggattgagtaggggggtaattcgtccggtttgcatagttggggtgaagaatgtccggttttatggtttagggggtaattcggatgaccgcgatagttcgggccgggggagggggtaattcgtacttttcccctgcttatatgatcattgtatgaaggcaaggaaacccctgatggctactttggcgcttaggaatttcactgaaaacaattcattttccacataaactgaataaaaaaactttttttcgaggaggcgagcaggagttctgccgtttcatattaggagaaaagacttaaaaaaaaacttttgtacaggagtagcaaatacagtaaagaagaaaaaaaggcaacttcaggctaaaattttggcaaactacatttgggccagctcttcttcctttgatttgaaaagtaatccaaaggaatgtttcctggaccaaaatcccctataaaacccacctacactgatagttgtccaaggcagtatcaatccaactcacaaacacaaaagtgtaccaaagcacccttaactggtgatgttttataaacaccacttcaaaaaaaaaaagaagagaaaaagccatctttatctctcaaaagcagaggattacacaccataagccataatctttctttgtaaaccactgatcatcatcaagagtgaccaacacaacacttgctctcactcaccctctgtcactcttttcttctccatccatccatcctcattgtcccaacattgcatccacatgccaaatggacattctcatcccacttctcctctcctcgatctacgtgtcgtcgtcggcggcggcggcggaaaccgatgcggcggcgctcctccgcttcaaggcgttcgtccacaaggatcctagaggagtcctctcgtcgtgggtggatcctggtccatgtcgctggcgtggcgtgacgtgcaacggcgacggcagggtgacggagctcgacctcgccgccggcggcctcgccgggcgcgccgagcttgccgccctctctggtctcgacacgttgtgcaggttgaacctctccggcaatggcgagctgcacgttgatgccggtgacctggttaagctcccgcgcgcgctgctgcagctcgacctctccgatggcggcctcgccggccggcttcccgacggctttctggcgtgttaccccaacctcaccgatgtcagcctcgcgaggaacaacctcaccggcgagcttcccgggatgctcctggcgagcaatatccggtcgttcgacgtgtccggcaacaacatgtccggcgacatctccggcgtgtcgctccccgcgacgctggccgtcctcgacctgtccggcaaccgcttcaccggcgccatcccgccgtcgctgtccggctgcgcgggcctcacgacgctcaacctgtcgtacaacggcctcgccggcgcgataccggagggaatcggcgccatcgccgggctcgaagtgctcgacgtgtcgtggaaccacctcaccggcgccatcccgcccggcctcgggaggaacgcgtgcgcgtcgctgcgtgtcctccgcgtctcgagtaacaacatctccggctccatcccggagtcgctgtcgtcgtgccacgcgctccggctgctcgacgtcgccaacaacaacgtctccggcgggatccctgccgccgtgctcggcaacctcacggcggtcgagagcctcctcctcagcaacaacttcatctccggctctctcccggataccatcgcccactgcaagaacctccgcgtcgccgacctgagcagcaacaagatctccggcgcgctcccggccgagctctgctcgcccggcgcggcgctggaggagctccggctgccggacaacctcgtcgccggcacgatcccgccgggcttgtccaactgctcgcggctgcgggtgatcgacttcagcatcaactacctgcgcggcccgatcccgccggagctcggccggctccgcgccctggagaagctggtgatgtggttcaatggcctcgacggccggattccggcggatctcgggcaatgccggaatctccggacgctgatcctgaacaacaacttcatcggcggcgacatccccgtcgagctcttcaactgcaccggcctcgagtgggtgtcgctgacgagcaaccagatcaccggcaccatccggccggagttcgggcggctgtcccgcctcgccgtgctgcagctggcgaacaacagcctcgccggcgagatccccagggagctcggcaactgcagcagcctcatgtggttggacctcaacagcaaccgcctcaccggcgagatccctcgccgcctcggccgccagctcggctccacgccgctcagcggcatcctgtcccggaacacgctggcgttcgtacgcaacgtcggcaactcgtgcaagggagttgggggattgctggagttcgccggaatccggccggagcggctgctgcatgtgcccaccctcaagagctgggacttcacgcgggtctactcgggcgccgtcgtgagcgggtggacgcggtaccatacgctggagttcctcgacctctcgtacaacagcctctacggcgagatccccgaggagttgggcgacatggtcgtgctccaggtgctcgacctggcgcggaacaacctcaccggcgagatcccggcgtcgctcggccgcctccgcaaccttggcgtgttcgacgtgtcgcgcaaccggctgcaaggcggcatcccggactccttctccaacctcttcttgctcgttcagatcgacatcttcgacaacaacctctccggcgagatcccgcagcggggccagctcagcacgctgccggcgagccagtacgcccgcaacccggggctgtgcggcatgccgctggagccctgcggcgaccgcctcccgacggcgaccatgtccgggctcgccgccgcggcgtcgacggatccgcccccacggcgcgccgtggcgacgtgggccaacggcgtgatcctcgccgtgctggtgtcggccgggctggcgtgcgcggcggcgatatgggcggtggcggcgcgggcgcgacggcgtgaggtgcgctcggcgatgatgctgagcagcctccaggacgggacgcggacggcgacgacatggaagctcgggaaggcggagaaggaggcgctgagcatcaacgtggcgacgttccagcggcagctccggaagctgaccttcacgcagctgatcgaggccaccaatggcttctccaccgccagcctgatcggctccggcgggttcggcgaggtgttcaaggcgacgctcaaggacgggtcgtgcgtggcgatcaagaagctgatccacctgagctaccagggcgaccgcgagttcatggcggagatggagacgctgggcaagatcaagcacaagaacctcgtccccctcctcggctactgcaagatcggcgaggagcggctgctggtgtacgagttcatgagccacggcagcctgaaggacacgctgcacggcgacggcggcagatcggcatcaccggcgatgtcgtgggagcagcgaaagaaggtggcgcgcggcgcggcgaggggcctgtgcttcctccactacaactgcatcccccacatcatccaccgcgacatgaagtccagcaacgtgctcctcgacggcgacatggaggcgcgcgtcgccgacttcggcatggcccgcctcatcagcgcgctggacacgcacctgagcgtcagcacgctcgccgggacgccgggctacgtgccgccggagtactaccagagcttccggtgcacggtgaagggggacgtctactccttcggcgtcgtcctcctcgagctgctcaccggccgccgccccaccgacaaggacgacttcggggacaccaacctcgtgggctgggtcaagatgaaggtcggggacggcgccgggaaggaggtgctcgacccggagctcgtcgtcgagggcgccgacgccgacgagatggccaggttcatggacatggcgctgcagtgcgtcgacgacttcccctcaaagcgcccaaacatgctgcaggtggtcgccatgctcagggagctcgacgcgccgccgccggcaactgccatataaattcatttctgcagagagcttgtgattaatcgaccatctctgatgatcacaaacgaacacataaaaagacgcaaatgttgcatccagacatgcatgttccttgttgttggctgtttaatcttgatgcgatttattcatttgtgagctctagaatttccaagttatgactaaattttgaataaatttaggctggaaaaattcaaactggatttgaatacgtttaggaacaaaaaactggtagatttgcatttgaaaaaaatgagagtacattctagtctttcagctgttacacaatatatataagcaagacaactcagtggtatattggaccaataacacaattcattgctcttgagcagcccattaacaggtttttagttgtggcccagtaatctcgccatcccaaaactcatcagtggttttgtatgggccagattcgtggacatagaaatcacggtttcccctgaattccgggagggcgcttatctcctggcgatcagcatcggtgagctcccaatcaaaaatttcgaggttctctctcattcttctctcattgaagctcttgacgattatgcaatcgccttgctcatgcagccacctcaggcatacctgcaatttcggtgaaacttatatacatattggaattattcctaaaaactttgccatagatagcatggtgttcaataccacagatattgatgaattttttgtcgactataaattatctttacatcactgaaaatttagtttatcataactgatccaaaattaagacgtattgtagcattatatatgtacctgggcaaccgttttgcccttctgtacggcgatatgtttgagaacagggcagtccaagacggcattgctgccccatatagtgccacttgctcctaaaggagagtaggcacagagctggatttctttctccttacaaaactcccttagtttgttctgccggcaataggggtttatctcaacctgcatatatattgtagtcatgcatgcaatcccaacgacaattaataatacaatatatgttccaaaatatgtatgatgggacaaaatataggatgataatgtattgtacagtaatacctgatttgctgcaggagggatggttgcaaatgagagcagggtgttaagcttcttgcaggtgaaattgctgacaccaatggctttggtgagacctagcctctggcactcctccatgtccttccaaactccctccatgtccatcatcacaaagtcattgtcgtacaccggcgaaggcgtttcttgttccactctcagtcttattggccagtgaatcaggtataggtcgatgtaaaccatctgcaggttcctgcagtagtacatgaagactcacgcaaaacaaacaaaataatggtaattttatcatcttcaagaaagtaccaaaaatgctatattttctattttaaaaacatgacacaattatgtactagttaccttagatgtatcaatcattttagtgtaaaattgattaattttttgagaggaacctggacgagtctacgggtcgggctcccgatcggtttggagaaaaatcggggctgaagcgtccgatttacgtgcaaaactattttaaactaatttttctcttaaattacttatccaaattatgatccgattgcactattaaattcgttgcaattaaattttcaaaacaagaccacacatggatatattccgatgaaaaaagttagcttattattgaattatttttaaatgttgcacgatgttccatcaagtatatcggaattgtttcactaagtagatcgaaaatgtttcattcatttaaatcgggtgttgtttcaccttatataaaaacaatgtttcagcaaatagcgaaagaatgttttagttcggtgcaacatttgatccatacatagtgaaacattataagtacactaggtgaaacatttttcggtggaacaaaaaaataaaacgaattacgttaatagggggtttccaaaatatgtgggttttttcattgcaatggaatatttcacttcactgcaatattaaatctatagatagtgaaacatttttagtggaacaaaaaaataaaccaaattcttttaatagagggtttccaaaatatgtgggtgatttgttgcaggtggaggcagggattgtggtgggggcccaggtggcatgcatgcgcgcggggcagggggcgggggagcgcctgatttttttctccccccaccggtcgactgatctctatcattatcggagcaacgtagctaaaatttctcactaaattaataaacatacaagtgattgtttagaggttggtttgtgaatgatgctgacgtaccggagcgtcctcctgagcgccggcaagacacggccggggtgggtgtcggagatccagagcttagaggtgatgtagaggtcgtcccgggacgcgaccatgccggcgcgcacggccttcaacacggcctcccccaggggtgcctcggtgccgtacgccgccgccgtgtcgaagtggcggtagccggcgtcgatcgctcgcaggacggcgtccctgacggtggccggcagctggggcgcgtccaacgggaacgacgcggtgcccatgccgacgagcggcatcggcttgccggacctcaacgccggctttggtatcgtcgccgccgccgcggcgatgcttccacaccaccaacagccatgaccgatagatggctagcttagctgtcgtacctgatcgagtgaggtaaaaagatcttaaagaaagagagggagtggtgcatgtgtcagtttcatcttcgtcagttcagcgaatttagtagtagcatacatgcatcgcgacaggtatatgattgggagctggccggagacaagataacacaatgtgattgcggttgcgactgcgacacaaaactgtcactacttgtattttcacacacagaaacagacgtaatgtatgcatcacggaaatttatagcatcttggacaaattttccttcttcagcagtgaaatattaggttgtaagttgcgcgctgccggccggtaatctcgatcgccatcccaaaacttgtcagcggtaaaatgttctatagttaaacatgatatacatatgcatattgatatgttgttcactactacgctctctccggttttcaatgtttggcgccatggaattttaggcagacttttgattatttgtattattcaagttttgtttttaaatatgtaaaagtataaaccctacttttcatcaaagatatattcgagaagcttgaacgaagatagctgaactattgtttcaggggcgcgcgggacacgaccagaaggctgggttgagtggcgaacgtgtcccactgccagctgtgggcaagcgttcactaccataaatgaaacatgtttatgggggaaaaccccaaccagcctgaggtcaaaaagacgctaacgctgagtcattaggagcaacaggcgtctggatatgtgtcgcgcctgcccagtgacacccgacttatccaactgagaagaaaaatagccgtggcactatcttggataggttgaggatcgccaggcccaccatatgccgcgtggtgggcaggatggaaacccacctgggccagatcaatgcccagggagcccggggcaacttaatcatatacttttggttggtttctcgggaagattagaagggaaccaactgacagcgacaagacagctgagtgacaacacgaaggaagagcagaaaaatggcactgtgagcccctcggggacgtgctatataaaaagggatgcttgttccttagtttgaaaaaggtctagtttataatttccagatccagatagtgacaaaaaaaacaggagtaggggtattacacctttaggtggcctgaacctgtataactgcttgtgttcatttgtcttgtggggagctggaccctatcttggagatcttttccacgtcgtgcacaactaaccccctggacgagttttcactcaaggaaagatctgcacttcctcgctgctggagaatcgctcctccaacacttcccctttctagcgattagaaatttgttacctacttgagttcttgctaagtattactccctccatattttaatgtatgacgccgttgacttttcgaacaacgtttgaccattcgttttattcaaattttttgtnnnnnnnnnnnnnnnnnnnnnnnnnnnnnnnnnnnnnnnnnnnnnnnnnnnnnnnnnnnnnnnnnnnggcgacaatcaatgtcca

SEQ ID NO: 6885 - DNA, 1432 bp, Oryza sativa
  unsure (1)..(1432): unsure at all n locations
cactcaaagggccgccagtagctacccgtaaattaagcatagctgatatattgaatagaagnaaagntcnnncntangcnnaaaannnnncggcgtcatacattaaaatacggaggtagtattacttataaggtggtttaattgagtgttctaacatgtagcccttatagatataccatattatcaaattatacatgtttcaagtcgacgcgacttaaataatgttagataggtacttgagttgagagaaggtttagtcataaaaaaaagggtttgttggaaccatgccaccctaattttgcgaaatttgagatatgccacccgtatctcaatgacatgtaggaaccacatgagtcaatgacatatgggtcagggtggcatatcacaaattttgcaaaatttgtgtggcatggttcaaattttccctaaaaattatatgtgctgggattcccttattgccttctattgatggtatctctaatcaacaaaatacaaatatcggctatgggctcttttagtgaagcattggatgttgggcaacctcatgcaactcagcgctagtcatacttactacaaccctatgaaccatgcaacaggtcacacaaccacacctgacatctcaaatgattttctattagacaacgcttggatggatgtttttttattaaactaggtgaaaccccgcgcgttgctgcgggagtttatcatgagaacaataagtaaaaaaacgtgtaaaatagcttaaacaacataagcttatataaacataagttttcataaattgatgagatttaaattgaaatagtatgtagaataatgatttagatgtaaaagtaagatgatgtggctttatgaggcggttggacagaggcggcctgcacccctcggcggcgggagacgacgggaggtaggcggcaggagacgacgggaggtaggcagcccgcatccctcagttgcggcaggcagcgtgcggtggtgggaggtggtgcgacggaggcggcccgcgccggatcaggaggtgtggcgcggcgaagacagcaggcatggaggtggggccgccagcaggaggtgcgacggcgtcgaacaacggccggcgatccatctttgcaaacgaacaaataacccccccccccagctcaatccgctgtggttttgatcctacatggtagtccagtcaacaattcattgttaaaaaaataggtgggccccacctatcagtttctctatctgtcttgtgtctctttcccaatctcttactctcttctccattggagctgcatcaagaagggcgacggcagaagcagtgacgaggcgtggggagcacggctgcggaagaggcgaagctaggcgtcagcgtcagcgagacgagcgtggcggcggtgaggcaaggcggtgtggtgccggatcccaaccgcgatcggtaggtgcggag

SEQ ID NO: 6886 - DNA, 11463 bp, Oryza sativa
  unsure (1)..(11463): unsure at all n locations
cggccaagctatgcctccgctgcgggccatctaagcgagcggcctccgcttaagacgacgacgacaccgcctaagagcgggcggccgagtaagagagaaaccaaagggattggggaggggagatggatgacatgtgggtctaggtgtttttttaatgttatttgcttacaggattgccacgttggagctacgtgtgcaagttcaagtcgaaaacagctcaaaatagtgcttggggggggggttatttgttcggtttgcaaagttgggggtgaaggatgtccagatttttggttcaacggggtaattcggtcgaccgcgatagttcgggggagggtaattcgtactttttccttttaagattaacattggtgtcagctgagtaatcagtgccgcattcattgtgctggttgggaaaaccggtacctaagccggttttccaactggcacctatctgtggttctgtagtagtgtaagtaagaagaaaaaggaacagtgtttggaacacttccagctctatctagcttgcgtgctaccaagtatcattggttatcgcgtcatgctacttatgatacctatcatgctactatcgagtatcagctgatactgttaagtataatgctgtgatacgtattaggtatcatgggactactaagtatcacatgatactgataaagtgatactaataagtatcattagtaatcacctgatactagtaaaacaatactagctagtactccctccgtcctaaaaaaaaacacaaaccctgggtttctgtgtctaacatttgactgtccgtattataagaattttttttataatttctatttttattgttgttagatgataaacatgattaatactttatacgtgacttgtctttttaattttttttcataatgtttttaaataagacgaacggtcaaacgttggacacggaaacccagggttttttttggacggagagagtaagtatcattagtaatcacctgatactagccacgtaagccacgcgttgcgtggctcttaaagacccgtttgaaaatgtgtatatatggctcaggccaacggtgccctactattgatatctcgttgatgggcaaataaatagtgacactatagctggtaggtttacagatatcaatcagcagttttttctaaaatccaatggcactgtaaattgaaaaatcaacatacaaacagcttcggtaacacattctgaaagtaacagaagcataaaggaagtagtattatattaattagttcgcttcataatataagatgcaacttaagtatgaggaatcagtcaaaggataacgttgattacaactttaactaataatctgcaatcatatattttctcagcgatctaaagtggtaagtaaaaccatccttattttcattcgtcatttgatcagcctcaagtgatgtgcacttgaatatttagtatttagcagcataaattcagatatcattttagcccttggaaaagcatatatgtaaactgctgaaaccctgtctatgaacaaaactatttttactgtaatcataaatgaatacagtaattcactctccatggacaaattcagcatgatcataaatgaacatagtagcttagcttatttttatggaagaacatcaatcaattgttgcagaaaatagttgagcttcaactccttaaaatagtatagcatgtaggacacagcaacaaaatctagcatttaccgagagaagtgtaatcctaagttttcatgctgttggtggcatgttacggttagggaaatacacccaggatcatttgtgcaaacatcaattgatgctagcgacccaatccctccaaagatattgctgggatattttggtgtgcttgcttgtaatttatgaaattgatattcagaattaattgaaaattttatatacacttcaatgcatcatctattgtgagctgagaagttaatttgagcaacatatattggtcaattttaatttatctctagttaaagtctattagttacatccagcaaacagaaatttctaattaaattgaaagccattggctttaatcttatttggcttaaagggtaaccttccctggtttctgttcaagcaatttatcaagcacgaaacgtgcaaaaactatatatcaagatgggacaactaaccaaatgtttgcatactggctttggccatcttcacacaccgtactttaacactgactcgcaacgaattacctcagattctagcatgctattccagctggtacacaagctttactgggttctagcctccaatgctgcccatgtagcatcttgaagggcgatggccaaccacgcctcaagcccgtcgtcacacgcatgtcgccaagaaggagagcaagggcaacgcatgatgtggagggggaagccgatgcctttggcttggaggtgggggtcgacttcgatggctatctccgatctgccatcgtggatctgattttacagcaccaaactcgcctagaggcagcggcaatagctgggaggaggcatggctaaggcgctcgagctcactggtgaggtggtgcaggatccagtgcgcctattctgggacgcggtcgaaactggtgatccacttcatggtggcggtggggaggttggcgggctggcggcggcagtgtggccgtgtgcgatgaagagacaaggaggggaacattctctcctttttttttggttacctagggacgtggaaggatgtatttgaaaaagagctttctcgaaggatccagaagagattttgcaaatagagagatctgacggatgataatgtccggaggatatatcgaacggtccttgatttctcgatgatgtggcccaatcagattgcaagaaactttagttctttcaatactttagattggtgaagtgatactaccaagtatcaccggatattagtaaagtaatactactaataagtatcactatattagtaatcaactggtaccgatactactaagtatcatctgatactattgttccattttgatctaacctaaccgtttctctggagaggccaaagcagcaaagcagccatcaacggaagaacgaggtgttgctccacttcttgcttcgtcatcggcttcttcactcgttgcatgtttgcgccatcgattatcccgtgcggtccacagcccggcgctgggattgcctggtttcagatagagccacttatggcccgcctggaacctaaaggggcttgcgtctaggaaaatcacatgtgtagtagtgtcgttgccatcaactagtaggtcaacctcttacaggtcacggcggtggcagcaacggtggccgttggcaatggtaccatgcacttggactgtgaggagagcgagcagtgccaaaggttgatagtggtacaacacgtggtcagatcaggcttgcgttggttattagtcttatctgatggaaaataagaaaataacgttcctagatttaaaacgatctctatgatgtggacaagattggagattttgacgactagtatactttcattcacaaaaggacataacatgtgtgcatcatgaggaaaagtatgttggactctggtacacgaaatttgaattcttcttgagcagtccattcattggctgggctagcattgatcagggaccattagaaaaagtcttgtcaccagtaatctcgccgtcccaaaactcatcaactgttttatatggaccggttttgtggacgaagatgtcaagagttcccctccactctgggagggtgcttatcttgtgacgatcatcattggtgagctcccaatcaaagatgcctagattctctcttaacctgctcttgttgaagctcttgacgattacacaatctccttgctcatacacccacctcaagcatacctacacttccagtttgtactttcagttctaaatagtttcatatctagttaataaacatgatatgcacgataagattcactaaacaatgcaacataggtatatatagtattcaccagaacaattattaccataagtttcatgtatcatcttatcggccattaaacaaaccacttttgccttttgtttttcctgctacggtctctaaatataattgcatagctggaagcttaatttatcatagcacatataaaaaattgacatatattgcagtgttctgtttacctgggcaatagttttacccctctccatggcaatctgtttgagaagaggacaatccatgacagcattgttgctccatggtgtaccctttccacctaaaggagagtaggcacagagctgaattcctttctccttgcagaactccctcaatttattttgccgacagtaggggtgcacctcaacctgcaagtgttcatgtaatcccgtgaacaatattaataaattaatcaatgtacatgttgaaatgttttggacaaagagaatagagaaaaaaatgtatatgtacaactataatataaacagtaccaagtagtactaagaaaatgttgtctccatactcataactaaaataccatttttcctttttcctcgcaaaaaaaaaactaaaataccatttccctttttcttcttacaacccctcttaatcttttatgtccttgtctctctcatctgtgcatggccatgacgagtaactacttaaaaaaatactacctccatattttaatgtatgaagccgttgactttttatccaacgtttaactattcgttttattaaaaaaattatgtaattattatttattttattgtgacttgattcatcatcaaatgttctttaagcatgacataaatattttcatatttgcacaaaatttttgaataaaacgaatgatcaaacgttagtcaaaaagtcaacggcgtcatacattaaaatatggagggagtatttgttaagatgatccataagtgatttacgtgggcatttttccaacttgcctgcaaccaagctagggcctatagaaatcatggatttgtgtaggcaaattccaacccgtgcagaaatcaattttcacggtgtggctctctcaaggacccacccatgaaaataaaattccagtttaatttttatagacataaaaaacccacaaaaatgactaaacttcaaaatgttatagaaaaatcactttatgtccgattgaggtgaaccacggttctccatgatccttgtaatatttttcttcatatggttgggtccatatttacttaaaatatttattttaatatggttgctcactgccgtggtctttatatgagttgatatatatgttatgcatcttgacattaatgaatgatcagacacaaaaaagtattccatgaaagtattaatattgtcatattacagaaaacactaatagaatatcgtataactttggtttacctcaatcaggtttaaaataaatatctagaattgtttttaagtttggactttctaaccctcgtaaaaaggaaaaagttcatataaccccctaaacgttgaataaaaatccatataacaccctaaactttacagtcggacatcatccaccccgaactttgcaatacaattcatgttacccctaaattagtttcagacagtggttttgcatattttaaagtttaaacgagcgatttaaaaaaactcgtataacatacttacatacctcaatcatcggtcttaaattatagtatatagtaacatcatattagtattatattggtattcatttattcaagtggagatttaacatatatgtccaaggcatatgtcacatattcaaaatcatccatcgaatatgcaaattatgtagtaatcattttgtaaaaccaccatatgggttacatgaatagtattgtaaagtttaagggttggatatccggttttaaagttcaaggtgctagatggaatttcatctaaagtttagggggtatatggactttttccttgtaaaaatagatatcaaagcttgtaatgaatattaggcacctaaacgatctcatatataaaaactttcaactataaagttgtagatctcattgggatctacaatttcctggtagaacatttctccatccgaagtcatttgaaaactaaaacaaacaatttctaaaatatatctgagaatgaaaaatgaatatttgaacacacctcaacaatctgaaataaacgaactttcaactgcaaagttgttgatttcgtcaaggtctacaattctcatatagagtttgccatcatctaacttcatttgaaagagttacttttttttcatatttgaaattataaatgatctcaaataaaaagactatcaacacaaaagttgtacatctcattgagagatacaattttcatattaagtttgtcgtcatccgactttatatgtagttgcaatttttttttcatattttagtggtattcccatattttatgatggttttcttacttacaaccatccgctaaatatcgatttttaaagactgatttcacaggtatctgaatgtaaaaatagacttaccttcatagctagatggatttcttagatacccgtctgtaaaaagtaggttttcgtaggtgatttatgacctgagacagtgtcaattatttttgcaggtgtattttttcttggctgccggagaaaaaaaatgatatcttcctagaaacgtttcttagtactgagacatatatgcaacggaggtgagagggcgaggcttgattggacattatggctgagtttgacagttacgtgggctctagctgatcgtgaagcttgaccggaatcgccgatgtggacacttttttttttcattttttaatattgttatcccactaaataatgctaatgggtttttctctagttgatggtatatatatagatgcaattccaaaagagtcaagattattataatgtataggaatgtttggaacttttacttgatttgctgcaggagagatggttgcgaaggagagcaatgtctcgagcttcttgcaactgaagttgctaacaccaatagccttggtgagtcctagcctttggcactcctccatctccttccacactccctccatgtccatcatcacaaggtcatccttggaatatgtcattgactccggatcttcagccaacctcatgctcaccggaaagtgaatcaggtacagatcgagatactccatctgcatcttcctacaatattcgtacaaatcaaatcaaccacacaagccaaatgcttgatcatatatgcaccctctattttttttaatgttggttagttaaaaaagaaagacaacaatgatggtgatggttccgccatcctaccaccaccgccggttttgctaattggcgcagatgccgagatggtcaccggggcatgcacgcaagtgctgatttatcggtagctaattggcctaatccaattaggatggtgcgattagcgccagcctccaataatgataacggttagtatttcctttttccttttttgcgggactttccttttttaccggagatgtttactttggttagttgtagataataaccataattaattttttttatatttaatgatcttcttttactaatagattaaaaagaaaactatacgtaaagttaacttttgaaaactttttcaatccagatttaaaaacttaaaactttcaactctaatttaaattttttaagtcaaattttaaaaactttcaacttgtagtctcaaatttgaaaaattttcaactcaaatttgagacttttaacgcagatttgaaaactttcaacttaaaaattgaaactttcaacccagatttaaaaactttcaactcaagatttaaatttttttatattgaaaaatttttaagttaagatttgaaaacttttgaccaaaaaattttttggtaacacgtgtgctaccgattaaaaattcgaaaaaaaaacatgaaaaaaaagaaggaaaacacgtgaggggagaggaagcgaaaaaaagaaaaacgaaaaagatggaaaaaagaaaaacgaaaaaagatactagtgcccatgcaccagttagcatcctggccaccaccgccgctgtcatgtgaaaccactcacccatttccatgcctccctcccacaacctgctgctagtaggctagtttctagcctatttcatttttattttttactatttgtcttttcgtatttctaggcggctagctattagaatttcttgacgggtctcagattatactacatggatcaaatataatattctagctaggtatatagaaaatttatatcgactggttagagtagctacgcagctggacatgaagaatgacacgaataattaatgatcccggtgcaacgcatgagcatatatagctagtccaacaaaataagttgcagttatactcaccggagcgcacgcctaagagatggcaggacatggccggggtgcgcgtgggcaacccatagcttggacgtgatgtagagctcgtcccgcgacgcgacgaggccggcgcgcaccgcctccgccacggcgtcgccgaggatggcctccgtctggtacacggccgccgtgtcgaagtgccggtagccggcctcgatggcgcgcaggacgacatccttcaccgtcgacgggtcggtcgcgccgagcgggaacgaagccgtgcccatgccgacccgcggcatcggcttgccggagctcagagccgcctccggcatcatccccctcacatggtcatgggatcgaaccgatcgagagaaattgaagataaggctcgacagccaattaatctggccatatattggtacgcgaggcctcatatcagcgactcaccgtgtgacagctacagcccgaacgacccaagttcttcatatttttttttgggaaaaggaaaagagaatatttgggtgctttttgtcgacggcactcgctagttgcaacactatctccgttatttaatagataatacagttagtttatttttaaatttctaatatttattcatttaaagtaaaacgagtatcaaaagttctacacgaagcaaacataatatatttttctatttgcacaggacttttgagaaatgatgaatagtcaaacatattaataaaataactacatcatatctattatatactaaaagtccattaaacatcctataaacactattaagccgccacatagaactcccacaatcgctcgtacatcgccacgtggcatttaatcatctagccatcgattttcactaatatacggtgggcccattattttataccattagatttatttatctaaatagaaagggataaaaaaagtggccctcatatcctacccctcccgtccagtacatatgcttgtgtacgtgcgtatgtgcctcccccatatattttatttctcttctatcttcctcttttagttagatggaaaaaacattttatgatttatccaaatacaatgataaaaaaaaggggcccgtataccttccccgcctatccagtatgcacttgtcttttctctcctattttcctcttttagttatatggaaaaaaatatcacctcccccacatatttcttctctcctatttccttcttttagttacatggaaaaaatattttataataacaaattttaaacaattatattatctaaatcatataaataatttttatttgtgctcactattagattattttctgtaaaatttaaaattgaatatccaaattaactatattaattattaaagaaattcaatacttttagtcatatatattctacgaattatagctattgttcattgatccatacattttttaaaaaaatataatatattttaaacgttctgattaataatatgggtgggcaagtttgaccgcaagaaaactaaccagttgaactacgctcacttcataatgttggatataaagacaaccataatttttaagctacatttttaaaatactcctatgccttttaaaccggtagaagcattatttctaaccgttagatctatcttatatagaaaaagtgtttattcatggtacatgacatttcaaaaatattactgtgcaatgataatacttcgtcgttatcgtgttatttctaggttgcgtggagtctctcatctactctacataaaatgttcatagatagatcgcttcttaaaataacccatgtatttagtggagcttcatttcccacccaacatcctttaacatattatgataatatattatacatcaaaagaaagaaaaacaccttacgttttattttacacttactttactttcgttgacatgttttctaagaaaataaatctacattcttttgaaatgattaagaagattataaataattgcttataaatattacttatatatgatataatataaaactgataggttaaaatattattaaacaattaattaacgctaacaaaaataatttatggagaaatcgtggcggatgttctccggttaatatattgcttttataaatacgtcaaaccactactggtgaaagggttttcactcacggttcgtaaccccatatagtcccgattatacaactaggaccacgaatctatctctagtcttgggtaaaataaccagaactaaaaattatctttagtcccggttcctattcaaaccgggactaatgtggtttttgcaccacctagcaaagatcacttctccagtagttaacatagcgtatgacgtacgcccgcgcgaatgcacgggctacctttctagttttataacatttaaaaggaggtatagtccaacacatatttttcatttgctgatatatacatcacatgtactgctagtgtgagagtactccatccggttagaataacatcacacgctgctacttctaatattacgcaatttataactgtgagcaggcagatcaagcaacgcatatattagattacttaaacccgtgggatctttggaaggttagggacgccacgtcatcggttttttcaaaaacaccactcacctctgattaatcacgttttgggttaatcacgttttggaaagtaagtgtgccacgtcattgtatttttttgcaaaaaaacgcctgcacttcctgttaattgtgcgttggttcctgccgctatggtccgttcgatcacgcgcgagggactagcgtgtcccagcgtggctgctcttccaccatcgtgagatcgttggatcagaaacggacggcctagatttggcaagaaccctagccacctcgcgctcgcctctcttctcgctcgtgctgccccaccctcctccctcgtgcgggtcgccgcctcgttatattataaaccaataggtatatagttaatttaggctgtgttcttcccccaattttcccaactcatctctcttgtttaccgcgcgcatgcttttcaaactgttaaacggtgtgtttnnnnnnnnnnnnnnnnnnnnnnnnnnnnnnnnnnnnnnnnnnnnnnnnnnnnnnnnnnnnnnnnnnaagcatatgatcaaaaagggcacag

SEQ ID NO: 6887 - DNA, 641 bp, Oryza sativa
  unsure (1)..(641): unsure at all n locations
natgagaaatcngnccatccnnnncnnttggaataggcaacttccaannnnccgnnnnttatgaggaaaacanaaatttttttttcccctttttacacagggggtttgtaaaaggaaaggggggccccaaaaaaaaaccaaaaacccnnttttggnatagtaaaataaaaaaaaaaaaaaaaaaaaaaaaaataaaaaaaaaataaaaaaaaaaaaaaaacacataaaaaaaaaaaaacaaaatgaatgaaaaaaaaaaaaaaaaaacaaaaaaaaaaaaaaaaaaaaaaaaaaaaaaaaaaaaaaaaagaaaaaaaaaaaaaaacagaaaaataaaaaaaactaaaacacataaaataaaaaaaaaaaaaaaaaaaaaaaaaaaaaaaaaaagaaaaacaaaaaaaaaaaaaaaaaaaaaaaaaagatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6888 - DNA, 41082 bp, Oryza sativa
acttgtaccagttaggagaactaatggataacatcagaactgttcggatttatcaaatgcacaggctaaaggacaggtccatatagcaatcattttacaattataatagcagtaccaaaggtcaaatgtgcaattgctcttgtaaggcatccccaataagacacttgtttcttgaggtatatcagattctgaacctacagcattactaggacatatctggctgttgccatatgaaaaatacagtggatatgtagagtgcagatttcttgattgattacgtagctatgtaacagggaaggaaaaaaatgccttttccctgaaataatactctgatattttatcagctctcatctgaaaccatttaagaaataagagctgacctcattccttgaatgtcatttctcgcttcatttggtgtatcaccacattcaatgttgatttctcttggaatctagaaaatgaaagcaagtactcagaacaaaaggtgaaaattaacaaaagcactattttacatgacaatgtgcaatactatgtaagtatgtaactgatatagagggaagctctcttttaaaatgcttgaagtgaaaaacttctgataggtttcccgattgataattattccaccaattacagaacaatgcatatttcaatgaactcatgttgaacagttatttttttataaataacataccagtggtagctgatcaatgtctggatcattttcatgttccagaagccagtttattgcagattcaagactggaattacctgataaagaccgattgttttaaccaaaccgattcggatatgtgttgaagaaattcacaaacaggattacagccatgcaaccatagacgaaattaaatatcctttactgttctaattgaatactatgccattcagcctaccataaaatagtttattacaatatgtctaccttgtattccttttgaaatagacataccagaaaaatggagtgccctaattgaacgagcagtagggaatcccataagttcaagttcgctaagaattctcttgtccaattgtggggtagccatcctagaagatacatatatgaataagaataagagcattctactgaccataaatgcaaaattagaacaaaataggaatgaaatgttatcctcatgagaaaagttggtacacttgaagctagatctcccataaaaattaaagatctaaattgcgaactagcctttttaaggacaaagaattagcaaatgttaccagtaaagtgaagttgagatatctttggagtgatctatatgcaaatacttctaactcatgtttagtaaagttacaacattctgaagtttaatgtctacaatctgtccacgcactgatctcattccatagcctatttgtgtaattatcattcttggttgaataggagaacggaaaactgcctggtaagcatagtctagaattacaggctattatggcacagttagggaactgaagaaggctgagacatttgcataatttggcatcacacctgtgcatacttacaggatggtaatatggtagaaacagcaaaacataggattcaagtagttgggcgaaataatcaaagcattttccaggttatcttgacagaacatcaaaggaaaatgttgaaagttttcgactgcatgaacaagatgaatggtgaacagaatttcttaccttttcaaaatttcttttcactttcaaactttggacccaggtggctgtacgaatcctctataagtagtgcagaaagcaatgcattactccaaatgcagaaggaagtaagaaaattatttgaggaggatcagagcttttgcttcttctgcacttcattcttatcttttcttcccagatggttctttggacctcaggagactctagtgacatcttccttcctgcggttacttatacctttcttcctacttaagtttcctcttgaatcaacaccatgcttacagctggatcagtaacctcttctggggtgaaaagctcataataaatcactaggaagaccaataaggcaacaactcagcaggaaatgggactaatgaggagtaaatttcaatttgcaattttgtagcagtgcttcaaaagatgggacataggttagctttgtttccttgagcacggccatgccattgcagctgctgccccatgcttgatgaatcaccgactgttgtccatactaactgttgcaccagtgcagccacattatgctgttcatggatcccaaaactgtccaaaaacacataagaaagcaatttaaagtgtatgtaagacttccaagagcaaaaccataattccctttagaatgaccaatcttatattgcacatatcgccaaagcctatcgtgccatcaccaattcaccatctcaagaactagtgctttcgtcaaggaagctgcattgcattgtcttataggagtatattataattagcagcgaaaaccctttaacttgcaggcacaaacatttggaattaaaatccccattcctatgtgaccactacttcgacccataaacaaaggcaacaagaactatacggcgagcatgagcggcggacaacctcgtcgccggctgaacgcttgcaatctccgccgccaagcagagatgccgatcgttgccccacccccgactctgctagcatggcggcgaggaagagggggcatggatggcgagcagagaggcggaaggggggggggggcttcactagttgggggaaggcggcagcggcgccgagccgtagaccttgaggaggacgtggtggtggtggcggtgacgatggggaggcgggggctcgccggctccggtgggggaggcgccggcggcgggggaatggcttgtactggagatctaaccgttggtgatagatccaatggccaggattccttccctcttgcatttttcaaaaaggaacccttattaccgctaccattgctaacggtccatattttttttacaaatacccctgcattttgttttcaaaaaggccctctttcgcaccttatagaaggcagatatttctcatatttctgttgtttttcgctgaagcttattcatttctacttatgttgtgcctggacgaaactgatagacagatgagagatgtttgtctgattagtttgaatgcaatttaacaaatagatgcctgcgtcagtagttagtgttactgttactctctctgtttcatattataagtattttgacttttttaattaaaattctttacgtttgataacatctgcaatactatattagtttaattaaatttaacattgaatatattttaataatatgtttgttttgtattgaaaatgtttctacattttcctacaagcttaaataattttgactaagaaaaaaatcaaacaacttataatatgaaatgaagggagtatttgttattgactgttccatttgtttcatttttatttgctttttcctaatccctatcctccttccagtattttcactgtttgggctcggggaggagcagcctattggcagagatccattcactccgttgctgacggaagacaaatcgacaagacgtggcagaggacgaagtgaagaggcgcgttggacgacagatggacgaggcagccgatggttgcaactagaggaggtgattgatgctgctgctgctgctgctttgacacaagagaatgaatacaaataatggcaaaaactgctacaactgacgacgactgatgactggatgacgagaaaatggctcgcggctcggcggcggatcttttgttacgataccatgtcacaatttggggaatgaatgaacagttttaattggagttagcctaataggcacatatatagtagattacaagactagaggaaaagaccaaaatgcccttcacatctatacccttaatgaatttaaggctctatttgggggagcttttagctgttgcaacttctcccataatcagaagctcccccaaacagtccatcttttggtccagattttgagaagctgtagttataaaatccagaaaatgaactaaaagctagaagttaggaaacccagcttttccagattcttagaagctagctaacaaccagccgcttctcatatctcagaatcttaagctccccctaaagccctaagcctttagtgtcctagcttttgtaaccacattttgggtagaggcataggttgaaatatcaaatatgcatgatagaaatagctccactctttttttgaatgtttgtttttgtgaaaaacgctttcttggctatatcataacatgtttgcagagccaaagcttcctttcggaatttcttcatttgtattttacctgtgttgaagttttaggtcatttatgacaacaaatcgatagagctaattgtgagagactcttttcttgacacaattgttgtttatgtaggcggtttcttactatgatttgggctcagatgaagagtccaatcaataatccatagatattggctcttctcaacaataatgtggtaaatgcggtcaaggtcttgaggtcgttactactaaacattgctggataattgaatgagagtttctgtatttatgtattatttgctagtctgttgaatgttctaatttcctcggttacaaagtttttccattcatagggttcaacatgtcttcgttatttgaagcacccacctttacatgtctcacctgtactagccacgtagtcgcactttgcacgactttcaatcccgtttaaaaacttatgtataaacttatcttttaagaaggtggttttaataagttttttatttataaaatattgatggcccaacctactacagatttagctaagttatactacatatttataaaatgaatcattggaaccctctaggtatttttcttccttcattgtctttgcgttctctctatttgtatcatgtgtttaataggagcactagagaactctagaaattcccacatacatacatactatatatatatatatatatatatatatatatatatatatatatcaattcatttgtgttttttttattattgcatgtatcattttgatccgatggtcattgtttatctaaactctttatccaatggccaatatattttttatgatgtggcacatccttatacaagaaagtttgttgctttcattatataagatatactatgggcctggtgatagttcttctttttggatgtttttaaaattttactcactgctgaagcagagttgtaagctcaactgctgatagttgttttgaatcattttctttacaatatgcttcacagttggttttcatctgtgtctatgtttatacctctgctaagggtgtgttcggcatcccttttctcaacccctctctctcgttttctgcgcgcacatttttcaaactgctaaatggttcgttttctgtaaaaagtttatatacgaaagttgcttaaaaaatcaaattaatccattctttgaaaaaaaagctaataattaattaattaatcacgcgctaatcgattgctccgttttccgtgagagagggattattctcatcccctgaaaccgaacacagcctaaggagttttacattccttgctcatccaagcgctgactttttgaggaattacgggatgaatatgacagttcaaaattaaatccaatacttgcagctaaggttccaccaactcaagccgtaaaaatggagtgaaggcctactaaccatgcttggaatcttttgagtgctaacggagatgtagaaaaacaatcagagtagtggcatagcctctttgccttttagcttatgttttactaatttcttcggtagctagatgatttgttggaacagctagtcaactgttctcgttcatttacagtacgttgcatgtcagtactctgtacatactaccagcgcagaacgtttgtactgaactcagagaaacgtcatgtacctggggaagctgtgttgttctacagttgtaattcctccgtcccataatacttggctctttggcatttaaaatttgtcctaaaatagttatcacttgcaagtagtatttgtcacatcaactacttcaaattcaaatatctccccatcatacccccaaccaacattccacatttaactatataatattttattaagggtattatagtctttttcttctaatcttagcacatgctaaacaatttagaatgacaagtattttaggacggaggtagtagtaatttgtaatgttgctttgaaagtacttgtcctcatcaatggagatcattcaaagtcagaccaaaagttgtaagttctctttacacattacattagagaaaaatcgtttcacagtgtatccatccagaaaacgagaggaatgaaaaaatgtggttcttaatcatcttgcatacattgtacatttgccaccagaaagaaaaaagaggcaaagctcaatgtttcaaacaatatgttccagatatttccacagtgctgtaaaaagcaattgcaaaataacagtaccatccgaccaagctgtaccagcggctatacaatcatctttctcagtttctatacttgcacatgtcctactatactaattgcatgtctatccaacaaacaggggaagaaagaaaattaaacgcattatcaagaacaacatcgttacttctctctaaaggatatctccagaagtcaacttctatcaacacagaactacattcctctgcttcggaggataataatatctcctaatctctctaccaacagcccatccaacaatgtttctcttcaatgtggagaaataactggaagcgtaagcaaagatactatgctctttcttcttcttctttctccgtagttcatgaggctctataggatttttttatcagtggaacgtagaagctatcgaacacatcaaataatacccatctgataggtccatcatctgcacaattgtccataattctaacgtagagctcatttgtcctgctgtcaacccggtatgcaaaacagacaacgcaatgatggtcccccgaatctggatccttttgtagccctctgtagacacggtctccaaacgtttgtgcataaccatcatctgtccaaagggtgctgagaagaggaccataggcatacagcaggcgcataaactcaagttttccaaaagctacatttctctctagccaaaaaaatccatcaattgcaagctggatgttattcggtactcgttgcgtgaggataccgcctttctccattatcattaaaagaacgtcgggagtccaggccccttcctcgctgctccaaatcccttgacggtagcaggccttcttcagttctttaggcactttagctttgcatgggaaagaaccttttccgtacagccgttcaaaggccaacctgtgttgggcctctatgcacactgtggcagctgcgatggtgcagcttcctaaaataaaaacaattcattcaattaatgatccatataaagataggaataactgaaaatgaaagcattgatagcaacacttaccatcagtgttaataacgggatcacccataacagagatccagctaaattcaggctcaggggcttgtggccctcctcttctccaaaagaagccgcacgggagccagctgagaactgaatcatataaggatagaaaaaccagctgcccaatccttattgtggcaagtagtgcagataagaaagatttgattcggacatcaggtggttcaatagaacttgctgcttttactcgatgacctctctgaaactgagtgtaattaacaaacaaatcagttattcagtctaataaatagaaacatccatcattgtaatattcagttgaaaggcatcaaaatttgttaaagaggaacatggacagaaaataaaaggtgaaggtgtgaacttactttgtagctcctagaaaattcagaggtccccttaggccctggtgctcaacaacaccaactggactatgcgaattatctttgtcgccagagctgaagattagagagaaaaatgatcaaagcagacataagacttcagctcatatagctcgatgtaaacaatagcacatctttcttggctaaatatcagagtgaaggttttttttaaggagattgtgattcttcaccaaaaagagaggtagccaaagaatagtgaatgatactatgctacagtgaattgactttggccagaacgatggatattatcaacaaaccaataattgttctaaggatgtataatctgactctaaaaggtaggaaagagcaagagtagagtagaatcaaatcaggttcttaacatcacacaaattcaaattattctaaaatccaaatcacaaccaattccccaaatacagttaaaacattcagattgtcgccttgtttaattgtttccatttcacaaaataacagaaccaccattcaaaattactagcattagatgaggcatctagatgacaccttcgcacatttagtggttagcattagatgaggcatctagatgacaccttgacacacacagtacaataattcatatacccatagcaagaagatgtgaaaaatggacatacaaagattgaccatcaagcatcaatgcttgtgtcatctgaaagtagcctgttgcagagagatgtcttctaaagcaaaaggaacaaattaggaaaaataatatttattagcttactgcaaataagaaacttgattaatttgctgtatataaatgccaattgttatatgttttcgaaaagaaaaaaaaaacagatgcagttgtcattacctggggtccatgaacagtcccatatcaaggattttctcaaagctcacatgtcctataaccttacgagaccccaaagatctcttcagatcatctgtttcctctatggccacatgggtcacatcttccagttctaaaccagtgatatgagaatcacggccttcaactattgcttgaacaatatctgtgttacatgtgccaacctctgggaatagtttcttctcataagattgctcactttggcatattatcttctctgaatgttcactctggtttccatctgtagtgtcccccttggtacttgacatgatgggctccctgtattcaactagaatgatggagcagttctcattggcccattctatcatctttgcttcaaaatgcagttccaagcactcaatcgatgcaagagattcgatatcctgtgccttgtcataaacaacatcgctaatctgagttttccccttgtcttctgtagtaacttttactgaggaagtggttctcttagcttctgtactaacttctggctgaacagcactgtcatttttctcatcatcactgcctgatgctagtgcattctcttcccttagtggagaaacaaatgattgtgaagcaggatcttctggaatgagggaatctgctgttgccacatttattctgtcaactttgacatcatacaacactttttggggaaggacatcaacagcctttccttggaccttatccttctgagtcttcaaaggaccatgaacagcatccttgttttgtgtgatctgttccattttagtagaatctgcagaatcaagcatatacgtttttagttttgcgcacatcagctatttcatgcaaccagtaaccttcattctctacatggtctgaacctttatccactacatttgattatttgaagcttcttttcttcaataatctccacaatttgtagaaaaagtattatacgaaaacaaggacgactcaaaaccctgagttatctcccctgtggcaataatgacagctacacttgtaacaaaaggctataccatgtcaaaactgctgaaacgtccttctaatgtaaacatgatgaactgcaatccaagtaagaatcaagtccttaaacatttttcttcatgtagctagtaaaagagtgtcgttccgaaaaatgcccttgtttcttatcttgagcaaaaattaacacaacaatagtggtactatcacaattcgctgtgctcattcatgaaaagttctattttctgacttctgacacacgatgcacgtctgtaggcctgttaagcattgttttctcttcctttagttcagcacatgagtgcataacttaccaactttcaaaggctctgatgttttcaccgtgaccacatcttccaattctgaagcaagactatgagaatcacctctttcagcaatttgttggctgtcttgcatagaatagccttcaaactctgagtcctgtatgaactgccccacatcaaggatttccttaaagctcacatgtcctatcaccttcttaaaatcctccaaatatctcatcagatgaatggttaatacaggtggcaacttgcgaataagacgtgtttgaatgggacattcattcttatctttctgctcattttggttttcttccacttggtatgcactcttctctgactgttcactctggtctccagctgttgtgtcctccttggtacttgacatgatgcctggcttctcaacaactttggagcagttctcacaggcccattctctctcctctgtttcaagatacaattccaagcatttctcaatcgatgcaagagagttgatatcatgtgccttgtcataaacaacatcgctaatctgagttttccccttgtcttttgtagtaacttttgctgaggaggcggtcatcttggcttctgtactaacttctggttgaacagcactgtcatttatctttacatcactgcctgatgctatcagtgcattctcttcgcttagtggagaaacaaatgatggtgaagcacgatcttctggaatgcgggaatctgctgttgctgcatccattccatcaactttggcatcacacaacactttctgaggaagagcatcaacaacctttccttggaccttatcctttctagtctgcaaaggaccacctatagcatccttgctatgagatatctgttccactttggtagaatctgcagaatcaagcatataaatttttagttttgtcctcaacagctacttcatgaaaccagcaatcttcattctctacaaggtttgagaacctttatcctctacatttgattattcgaagcttcttttcttcaaagatctccacatgtacttaagttaaccaacaatttggagaaaaaaattattatacgaaaacaaggactcaaaaccctgagctattttcccttagtgataattattgccacacttgtaacaaaaagctatgccatgttaaaactgccgaaacatcctgctaatgtaaacatcctgttgtgcagtccatgtatgaatcaagtctttaaacatttttcttcatgaagctagcacgacagcgccgttccagaaaatgccctttttcttatcttgagcaaaaactaacaaacaatactggtactatcaaaggttgctgtgctcattcatgaaaagttctatgttctgacttctgagacagcatgcacattgtaggactgttgagcattgttttcccttcctttaattaagcacatgagcatataagcttaccaacttttaaaggctttgatgttttcaccaagaacacatcttccaattctgaagcaggactctgagaatcacctctttcagaaattttatgagtcttttcattgtctgtgttttttcaatgccacagttgtgtcatgccacactttcctacccttaggtcccacatgtcatactcagataactagagctaacattgccacacttgtggctaactatttcttagccatacttttgccacatgatacaacttgcctaagcttagttatggtaagcttaggcatcaaccaaataaccccttaatgaaatctcgtctaggctttcagaaaatgaaaaaaaaaaacttagactaacataacatccataagcgatgggggatattcatcgatcccgtggcgattgttgtttatcgatccggtagcgaggatgccggtaattgcagcgatgcgactgagcaatccgggcggccaactcggcgtcggtctggggacgatcttgccgccgctcgcccatgagccacgcccaccaccccaccggccgctcctcctcctcctcctcttcctcctcgcggtggcggcgaccccggtgattgcagcgattcgactgttcaataatccaagcaatccgggcggcgaactcggcgtcagtcttgggacgctctcgccgccgctcgcccatgggccacgcccaccaccccaccttctcaatgcgggcgtccacgaacgagcgcagcgcggcgtaggcggaggacaccacggatcccatcgcttctcgctgagattcaaccgagcgtccaaagaagaagaacaagagattaattgattgattgattgatcgatctggtagttgtagggggaaggggacggagaggccgtatcggaatccagactctgatcctaatccccgtctcggtttgagaattgagatgggccgaaacccactccttttttcctttggaataagtccacttaggctccctagagttataggtagaatttaattcatatccctcaaccagaattgtactctctccgtttctaaatatttaacaccgttgactttttagcatatgcttgactgttcgccttattcaaaaacttttgtgaaatatataaaactatatgtatacataaaagtatatttaacaataaatcgaatgataggaaaagaattaataattacttaatttttttaataagacgaacggtcaaacatgttttaaaaaagttaacgatgtcaaatatttagaaacggagggagtagtataccagatatcttgacaataccagtacgatttgacttcatcggtggttttgtaggtggctttaactgatttggcgtcgacaccctcaaatataggtcgaatatgattcaatatctcttaaccagaatatcaaatattctcgttaagcgatataaattatattcaacctatactttttgagggagccaacatgtacttatcctttttttgttttctcctcctgtgccgagacaaacggagcccaccaaatcccaccctttgtctcaccgacagtgggccccacctacagaaaccgcgtcagggcaagttttatagtacaggtagttgtcacatctaattttatccatgtaagataagaggtgatatatataagggaaaataatacaccacatctacaccacctctatcattataacccaaataattttattttatttgtttgtccaatcccctttttcgttcatttcctttttcttcgggtttatatggaggttgccccttgcatgagaggtggcgcaccttctcttttctcaattattactgccacctcatcatccaatcctacatgccatttttaggggcaacacattaagcatcatgttacttgccctcatcgtcatcaacagcaatagcatgacctatatttgaggtcatggagaatgcaacttggcaagtaccttctctcccccagtgtcttgaaggcttgaagctacggagaaatatatcgtgtacatgtatttcaacttcgactaaattttctagtgaaaccttaacctgtttgaatcttcattgtaaattcgagccaaaacgttggaaggtcatggcagaacagcagttttgaatctccagagatcatgaaatctgcattgctacaagtgttcggaatcatcgctatattcagattactccaaacattcacgcatcggtcggagtaaagcttttccatcttccaatttggaagcaggcatccaaaatacagaaagcagacgacaagcatgcaccagtttgctaaccaaaagaaatgagtgagacatctcattcaacctcacagctccacggctccacctgagcacattagctgactatgaataaagcgaaaagataaatgacaagttaaggaaaagatgcacaaacccacggaaacccccaaaagccgatacaaataaaatctccttatctccctagctgtgcacgctaataatgggctgggtttacatgatacgggaaaataattccgatgcatcatatgttggcatctaaatatccgcataatatcagaacataactcctattgacaagctgttaattgcctcacaacagcactgctagatcacagttctctatttgtacatcatctcgatggaaatcttatacaagaaatggggttacttgggttgatcctggcagtgcacacatccaaatcaacatgtcatctagctactacgtttaaagatgcatcaactattcaactggtaggtaatgattttgataatttcttcttcttggaagccaatgctgacaatatctttttccgaggcccctgaaaacaaatcaagatatctaataaatatggacacaaaatcaaggcatataatgctgcaaaactcaatgatatcgctactcataaaggctgacaaacttgaaaaataaatatatgtaagtagattgcaatcggaaggatagttgtacactagtacacaatggacactctagcaattgttcagtttcgttacggcatgcacgcataccatagacaagaaagatcaccgacatgcatctaccaagggcacaccggaattgctaaattttagagcttataggcagttagcaaagccaacatttatgaagtttttacgaaataataaaaaaccaaagtgaaggaatacttagctatatatacaaaagaaaacagggggaaataacacacaggagataaccacttgtacttgctttgtctgcaaccagacgcatgtcatctatgaaatatcattagtggaacactaaaccctaggataaaatctgaaagatgcaaaaggtacacaaaggcacatatgacagtacttataccacttcattcattttagagaatcatcatttaactctattaaaagctactagaaatttggattagtaaccgatctagattatactatctaacaagatgtcaaaagagagacaggtagcttataaagaatgcatcataattctaaataatttgaaacatcttagtaataattctgcaagacaacccctagccccaccccagctcacccaaacacacaggagaataggggattaaatcaagttaatcctcactcttcagggaagttatataacttaaacctgctctaccaacttgcatatttaaaattatgacagtaggaaaggtggcaatacagaggcatctagacactcatttgaaaaaaaaataataataaagaatggactagctcctgcatgtaaaacaaagttccaatccaaattcgtacagtaccattggaattcctaaagacttcatgtcttcctcattcatgtgaagcagagccttcatatcaacctgaaaaatgattaagcattaacaaaatgtagtaggctagtaacacatgaaaaacttgaatacccaaataagtcaaacatgcctcttcagcctgaaaatttattgagtacttctctacatcaagagacttcagtaatctatcaagagaggaatcagtctgcacattttaaacaaacacattattaaaatgttcaactgataatatttaatgatgaaacccaaagtaatcataaaagcatctggacagataattacattggtacaatactatgcagatgaagtttgtattttttaacaagcagtcaagcagattaaacatagataagattatatacaaaaagacaataattcagaataaaggttggagaaacattaaatgctcaagaacaccaccatcacatcattacacacgcgaaatacataaaagggatgtagcataatgatacattattgtcccattagtctagaacaaatatgaaagcatattagttgatcaggacgagagtttgtgagaagataatatgacagtgtcaccaccttttcctggcattgctttggtgcagatggttcgttcactttcttagtagcaggaagggccgcattaacagggggttccctcttttggacaggttccctcttttgaacaggtttagcgctcgttgatatctccggtacagactttgggatctgtacagtactattcaactgaggccgctgaactccagacaatttttcacgaagatctggaactgatgatttcctcataacctgagtgttttgctgcaaatgtggtttctggtttccttggatatttctggaaggaactccagcttcaccgtgcaaaacgaaagtaatacagtaatggtaaatcatcatgcaggaagcaaaaatgaattgtatgtttagaaaatatactatgaatgtcccttacatgaactttgaactcccacagagtccatataaagttcacgtctccaagtcccatctgcctgacgaaacctgtccaaaccacaaagtagaagatataagcaataggattgtgtttgcttctgtgctcacaattaatctgggaacatataaaccaaccgatcataccaaccatttgtgaatcttacacatcaggtggaaacactgcagtgatgcagcaatttaaacatgacttaatgatgcgataactaaagacaacacaagaaaagtgacaatactatagtaactataccaaggcgtgcatgcatatagactggcagatagtgataaaggttagctgcagcaacaacagacgacacggctgtccaaaatgctacactctccacagtttcaaaacgaatttaaagcaaatgcagtattctaaccaggtcactggctatcacatttgcagtaagacaaaaataaacacattttcctctcagtctgactaatcaatccgctggtcgcaaccacatgtctcccctctaagtgggtcaacctggaatcaacatgcaaaatgctcatttaagtgcgccctaaagctacaatcaccacgcacgaagccacgaactccctaatttccacgccctaagcggcatttcccaaacccacctcgatccccatacgatccaaccacgagtcgcaagcccgtaacatctagcagcgcatgtacagagacaaaaagcaagcgacgatttgagcctatagcgagctcgaagtcgcacctcttcacggagtcaggccgcgggcgagagcctccgccgcctccaccgccaccgccaccgccaccgccaccgccaccgccgcccgatccgaggcggtccatgacggagcgcttccgcccggagacactatcggagtacatcgcggcggcggcggaggcgatgccgctagggttttcgtcggcggcgaggggggcagcggtggagaggccggaggaggcggaatgggaaaagggggcgacgtggaggtgttcctcggaaattttccttcaaagggaaaaaaaacattaattttccattttttttagaggggaaataatataatgggcttgggcctaactgggctggactttgaaaattaaagcccatcaagtaaaatagctgaaacttatattctggcccaaaattagcccagctcaattggctccacaaatctaagcgcttgtttggtttgaacccaaattttgccataccaaaatattgggagtcaaactgctactcccttcatttcaggttacaagacattttgactttgtcaaagtcaaactgttttaagtttaatcaagtttgtagaaaaaagtggtaacattttcagcccaagacaaatttattatgaaaatatattcaattattaatttgatgaaactaatttagtattataaatattaatatatttatctataaacttagtcaaacttaaaacagtttgactttgactaaagtcaaaatattttataacctgaaacggagagagtacaatacaatttatactagtatggcgaacatttgatatcaaaccaaacatccataaagtacggttgaaactaccaaaaatttggtaagacataaattagcctaaatccaaacaagccctaggaaccaaattcaaacaatgcataaagttaaatcccttgaatttgacagtgagcaagaaaccaaactacataaatgaaatgggggtcaatgcacagtttgactatgcaaggtagaggtggtcaatggagaggagaggaggagaccattcaactcaaggcacttgttgtaccaaccaaccgtgcagtccacttgtatctacacttacgcgggagcattgacttgccatccatccatgcgtctcctcgtcgtcgtcgtcgtcgcagcaagaggacggccggtgcaacgaccggttgatcaatcgatcgattgatcgccggtaatctcaccgttgaatcagggaggaaagagtcgccggatgggaccagatgatggttaaattaacttgttaattaattacgaataggttgcagcagtgtacgtatgcatatagaacaggacagaattaatcgtgtggttagttcgagtaaacaaagaaaaaaaatgagaatgagatggaggtgtttagcttggaagcatcgaacaatccatccgtcgattgggaagctagaggaagaagacagcgatggagttggcgagccggcgaatggtcaaagatggccaactttggtttaaggtgttaattgttaaatcgttcgagctatagtgtgctagtcaactgctccatctgaccaatattttttcactaagaccccttatattttgactattttcgtgaaatgaacttggctctatgataaggatctatatgcagacgcggccttataattgctacctactggcgataagcagtgaactattgaagtactccctccgttacatatacaagtttataaaaacaatataatagtattttcaacacaaacaatcatattataaaaatatatccaatgttatatttaactaaactaaactaatttgatattacatatgttactatttttttaaaacgtaaagaagtttgattagaaaaaaacgacttaaaatatgaaatggaggaagtagtagtttttcttccggtttcgatgtgttaaacaaaattaaggttaaatatttataactttaagtatcaatagttttaagtttatttattttaaatacactagaataacatatatagatttaatttacaaagtattataataaaacaaaaacttgtgatacatatattataatagaaggacatggttaaagatatatatcagagaccgtatcattatttaaaacttgtcaattatataaccagagggagtaggtgttgccatcttccataaccactgaaaaattgcaacgattaaatattaatcatcatcaagagagactagggaagacttgaagtgacattaattacgaggactattaagcaaaatcagagaaatgagagggtacatagcaaagaagcgacttggctgggccttctgggtccctttcgtggagtttataatcccaggctgcagctgcaagccagccggcctgagagagaggagaggagaaggactccattggcgacaagctaagcttagctatagctatagctagctagcttagcccctgccttccaaggaggaagaaacgaggcatacatacccatcccctcctcctcgacggctagctgctacctcgtctgatcgatcgatcgatctcctcgtcggccatggcggtaagctttctttgctctttcttcttgctcttctgttcttgggcatgggcataccttgcaattgcatgcgaccatgttcttccatcgctctttctgccacagtttaccgttaggcgtaggctaagtttgatctgtccatggttttctggttcaatatctgaacctgaaatttctgaaggaacagttctcactttcttaataacttcagagtaactcgtttttatctgtccatggtttttggatgcgaaatctgagcctggattttctgaaagaaccgtaacaggatcaccacgattttgtttcttgtcatccagtgttagctagttaattagttggaacaccggtttcatcgcttggaaaacaaagtcctctgttgttgtgctcttgttctgcttgaatccacctagtttgctcaacttgaatggtatgaataacttattgcttgtgtgaacgaaggaatatccttgacgtgttcatctgcaagaagtctttcttgatggttgagatgtatctttccatcacattaagttgtttttttttctttgtgaataaacatttaagttgtagtattgtctccatagtattcataccacaattaatcaaactgccatagaagatagatgttgtctgcttaactcactggaatacgacgtcctggataatcaattgttctcccttaatcgattacattattcaaaatctgttctaacctgaagattgaatttgtatataaccaaaactgaagagataagggatgcatcatgcatgatgcatctgtgtctctttgacttgaaatttctcccactttttgtaatcttaatcaaacgtagggtgtcagcaaggtagacctaccttgcgctgtcatttctccagaagctttgacaaattggcacacaaaagagattaattgtcagacctgaacacccaaccgccgcattagcccggtcctgtctggccagcctgattaatcagtccaagtggtgaagccacagcatgtgaacgattgattaattccgattagaaaatcagcacgttccatttgattagtccggccatatacatcaaatgtatgcagtgtgtgtgcaattgaccagttcctggtctccatttttcttttgctaattttttgctggtcagactgctcatttacaaccacttgtagtaggcagtagtacatgattcagcaagtcagctctgtcaagttggcatgttcaataatgtttacttcagcaatgtccttatgagtatgacttttgaaaacaaaatcaaaatctcgatatgtttgatgaattcgcacagctgtttttttgtagttgtatatggcttcttgtagaagttgatctgacatgcaaaagaaaatgttcttttttaggttaaaattgtggcagtggtcatgtcagcgatttttataattcttaagaagacatcgtgatataccatattttatagtctaatttttgttttaccatctagtatactaaaactgtatagtagttactgggattcaggatccactatctcagtatacctaaatttcggatcggaaaaaaaataaacattaaacaaattctgatcgaatttaaatacattttgccacatacgcattttttttttgaatttttcgtgcgaaatagtttcatgcccgggccaaaaaatccccaaaattgtgagaaggggaagaaaatgcatggcggcaatggctgatcatatatagctttgcatttatgcagcagcagcagaagaagaacgcgcacgtgccgaaattcggcaactgggacaatggcggcaacgtgccgtacaccgtctacttcgagaacgcgcgcaagggcaaggtcgccgccgccggcaagatgttcaaccccaacgaccccgtcgacaacccggaggccttctcctcctccatcgccgcgccatcgccgagccgagcccctcctcctccgcggtcccaccacgagcgcgccccgagcgacgcgccgccgccgccgccgccggccccctacgccggcggctcgccgtaccaccgccacgccgctggtggtggcgagacgccgccggcaagaagaggaggcgggcggacaagcggcggcggcgggtcgtcgtacagcgtcgagcactcgccgtcgccgtcgccgctgcacccctactccgacagcgggagcggcagctacggcggcggcctcgtcgccaactcccgcgccaagggcggcggcggcggcgccccgcgcggcaacgagacagtaagctagcttccctccgctccgctcgacctctccgccattgatgacgcttttgcaagcttcgtgaccttgttgttgtgatcgccaatggcagccgacgagggggtcggcggtgccgcggttcggcgactgggactcgaacccggcgtcggcggacggctacacgcacatcttcaacaaggtgagggaggagaagcagaccggccaggccgccgggaagccggcggcggggctcggcaagggcggcgccgccgccgccggccacggcaacgccgccaagcgataccacgacgacgacttcgcctccacggtgagccactccaccaaccaaccattgcacataggggcctcatttttagttgcttatatttatcagccaaaatttaaattttcaaccttaaatttagctgattttaaggttttttatcaaaatttattttttagcctttgcttttaaatcgctagaacacgtatataaaagttttattaacaaattattttttgtttgtaaatatagtgtttcacttattccgcgaataagcgaaacgatggctccgctaggttcttgatttcttttacatttctgatctcatttgagctctacatttttttttaatttgcagaagtgctcctgctttggatggtgcaaatagagatggattttgaggctgttatcaatgtacttgtaaattgcagagaatgggattttcgtttccccagtgcgattcatcagcttcgaaactgcatttggtcatagattatttatttggaagtggggaaatatacattacagtatagttcatgcctgctgtaatggtagattacgtattggattgtttggttccttctgtactggatttacatgcttgtaatggcaggttaaagcttgggctgtttcttgttcttatcgtcatttaatttgtcccttgtcaacacagaaagtccattatgcacgtattaatctatgaaactagatttctggtagatttggagttttttgttttttggatagctttttattgctgaagctggcagtctgctgcagagctcccttaatctgaagactgatgaacggtcgcatcacatgcactctgatcctcaaaagttctagaagcaatctgttctttttccttctgaatttacttaaacaaaacagtgtaaattgaattgcttgaaactattatcatacaaaaaagaaatgcacatacggtgcgtactggatcaagaacactcaaaacccaggggctattcagattgtagccaaaataaaccttaccaaattttggcaagttgacaatattcctaaaattttagtagaatttcttatatatttaccaaagtttggcaacaaactaaatatagacacttttttggtaattttatctaaaaaaaatatagtatgattgaaaatggtatcaatctaaacagcccccaatcggatggcctagtgagcgtagctagtccatctggattcaaatctagttttacagttttatccggcccatctacgtgtgtgggccgtgattgaggcccatcaaaacgagtccgagacgaggagtggtcagcaccggggcccacctatcagaagcccagcgcgggaggagaggaagaggagggcgccaaagtccacagcgactcccctttccttccgatccgtcccgaactcgaagcgaaaccctagcgagtttgcgccgcggttcgttttggttgttcgttcgagaccgattcgggtaaggtttccccctcgccaattcaccccttccgtttattaactgctctgatgatttgcctcatctgattcatctgttctttgctctgggattccgccgcggaagcaagctcgtccggtttccatcgtcgtctgggatcgggctcgctaagacttttcttgatttagtaagctgatccccctcagttcgttgtgaattgtgacggattcgggaaaaattcaggcactcttgatcagggtttggggtttagcagtctcggtgagcatttgtttccccccaaatctttctttctttattgttgttgcgcatctgtgtgttgtgataagttctgcgaaatgtgatataaagttatgtgtgtatagatcgtagagagctgagattagaggatatcattgtaattgatatttgacaacacctaaaaaagaagttttttaagtcggcaggagcatgagaattgcctgattagatgatctttacaggttctttatataccacatacttgaaatttcccagtgcttgcaggcatttctcatctcgactcttgttttgccaaagtattgttgaattgttcccttccttccaaatttccagggttctcagttttgtttttttccccctcttttgctcttctggcgtgcccaggatcgcaatctgcgttttttttggtgcctatctatctttaatgcaatgatacgcaaatcttgtgcatgttgccaaaaatgggcatttcttgtagaaactgttaagggaattagggtacttaagctgaagattcagcaataagtaattgtggctcactgatttccaggttattccaaatatcataagaatcatgagtactgcaagtactgcacgctctaggaagcgagcccatgatggatccagacaaaaagttgatgttataaacttggaaacaactgctccagtggtgaacactgggagccagcatgaggctctgatccttaggggtacacggacctcacccatcgatgttgaagctctagatgataaagtaagcttttgctttcttctgtctccaattaagcgaatgaataactgaaacctttacaagaagctgaagctgatgtttctttttgatagaggaggagcagaaaaattatgaggcgctctgtggctgtagtggatccggagaaggatactggtccgggaggtaagtacattacttatgtttgaactccacatagcttagtctaaaagaactatttggaagtcttgtgttactcagaaacatttggatacttccaagtgacataagaaatgtgcaccattaattctaacccatagttctgtactgtaggtgaaactgaaacttgatagtacatcggtgtactgtcttatagattattattacaagacactacaacatatacaataattatgattcatacctcacaaatgttcatcatgattccctgttttccctgttccccaaggttatggcgttgctggagctatattttcccggggcagaaattttcagggtgctgtacatgttatatgcctttctccagatagggaagaagggaccagcaaggttgttaatctttttaagttgatcttctttgtactgtgatgataattgcaattccgcattggctggtgtatgtatattgttttcttaatgcttagtattgtactcctacatgcaactcataatatgctctcacctttgcagccgaaaaatgtggcccaaaccagtacgacgcatgccaaggttgctccaaaggaaccaacctttacctgtcctgtgtgtctgaacaaactggacaagccatccacgacaaattgcggtcatatcttctgcgagaaatgcatccaggcatggctcaaggctcagaagaaatgccctacttgtaggaagagtctagggatcaagagcttccatcgtgtttacctccctactcctgctgattatgattaattagtttctgctggcctgaacctcactagtccactcctgcacattcatcttgtgtgcaaaagaacttgagcagtagttagagttagacatttagtctttgtttgttagccctgtaggctaacaatgtggtaagaagtgcacaacacgattcttagctcattgactacatctgatctgatttgtatgtaatggcgtgcatttttctcctgtgggttctgaaaaagggaaaatatctagttttccatgacggcatgacccatgaggttcactataacaatggccttcctttacaagtgttacaaaccgctgttctgactcgatcgtgaattgattcatgatttaactactgtacagccactcaatgtgatgtgagatgctaaattctactgtaatctatcggcacaaacttgttgctcgctttcaccatcttcattctacctctaatcgatgccaacctgaactgaaaacaacctgatattcaatgtttgagtctttatataaaaacaaaaagaattgtgggttttatgatgaactcatgaactcatctgagttcacggagcagatagccggaagaggcgccggggagggtcagagatttaggggcgtttggttcactccctcactttgccaaactttgccacactttttaggatatttgtgtatgccaaagtttttcgattcaaaggcccacatgtcatacactcatcttttagccaaaccttgtctaaggtgtggccatcaatttataagccacacatttggctagttttggcatggaggtttggcaatgttcggaagtgaaccaaacaaggtccacaggaaccgtgttggatcgagaatgtacggtccagatgcaagaggggtaaaaaaagccgctgatgctggttcacgggagccattggatcgcaggaatcgtccgatcgagaatgtgcggtcaaaaatcatgcggataaagtgcggcgatgcctccgaaccccttgagtccatgaaatccgttggattgtgatgatgcggtgaacaatcaggcacacagtgtccgtatatttcttgacttcttgagtactgataacttaagcttgataactatactttgggggtttgatgatcttctgattccacagctaattagggattaaatcgccgtgacctgcatggaattaatgcagttcagtcaatgcgagatatctcaagctcattgtggatccaaaccgtcggctctcttttatctgcttctaggctccaagctccagcttccctgaaatgatgtgagagtaggacgtgctcagtacttaatccaagaaaatgacattggtgaaggatcattcattggtgtcatttctgtccatgcaccatgcatgtcggtgaacacaaatcaatatctcctctttgtattatcttcttcttttcgagcagattaacaggttcaggagaagttgcatgatccataccttttcttttccattttgtaattttcttcatctttttttttactgtatcttcttattttcctttgagtattggcatcaagaaagaagagcaaaagactagccggatgcagcataatttcacatgacaatatgcccttcctctgcaaaaagtgtcaggaaatactagtccatttcaatcagcaacagagctaagtacaaggacaaccctgtccggaccagatactgcattggatttgattgggcttgtctggatttggacagccatgtgttggccggagaaaccaaacaagatcaagagcaaaatgaaattaatcattgagtatacactccttggatggatctttcactcatcatgattcatgcatccttgctcatgttcaccaatgcaaaatgcatgggcctgaacctgaagcttcttccacaacatgccatgagaataatagaggtgggatcaatggcaccttaagatcaacattccatcatggtctaaagaacagaaccttccatcatcaacccatgaacccccaaagctgtgggccccggccatgtgtgagcctagccagtgggccacccccctgactggtgacctattgctcctctcatcaggcgtgactacacactacaacaagtgaaaaaagtgaaaaaaaattctacttttaatctttgcatatggcatcaacattagcaaaagtggacatgttgccaggatcatccacgagtcttgtacatcggccaatatattcagaactttcatccacgttaatctggcagatgagctttgtcaaatgcagttctaacactagagttcagctccattcatggagtgagacaggagcggccaccgacagactgacagaatcgctcgtagagaaagagtgcagttcagatgattaatgttccatctgcatacagaattccaaatactagattatggcctagtttaaaatagattattgactaatttattatagtagattatatgatataccacacctgttaaaatatagcaacttttagctatgaatttagacgcataattgtctaaattcatagctagaaatgcttgtattttgagacggggtagtaagttaaatgttttgataaataacttaacaaacgacttagaacaaatgcattagaacaagaaatgcatacaatgcattaggaattttttttaagaaacatttttagagacgtggatcaaatttttctctcaataataatcatgtgagtattccctccgtctcaatatatagtaacttagaatcgaatttgatatattgtagaattataaatttggacaaaactatatctaaattcatagtcccatgctaagcttactatacagtagaacaaatggagacattgagtagttgaaaagaaatagaatggagatcgggtccacagcacatcactagcagctgatccagaaaatatagcaacttttagctataaatttagacgcataattgtccaaattcatagctagaaatgcttgtattttgggacggggtagtaagctaaatgttttgataaataacttaacaaacgacttagaacaaatgcattagaacaagaaatgcatacaatgcattaggaaattttttttaagaaacatttttagagatgtggatcaaataattctctcgataataatcatgtgagtacttcctccgtctcaatatatagtaacctagaatcgaatttgacatattgtagaattataaatttggacaaaactatatctaaattcgtagtcccatgctaagcttactattcattagaacgaatggagacattgagtagttgaaaagaaatagaatggagatcgggtccacagcaaatcactagcagctgatccagaaaaacgttttgtgcacattttcatatctttggcagcgatcacaatgcccaataatatcgttttcaccgaacatagtataaacagtaatactatcaacattttcttttttactcgagagagcctaaaaaattactggagtacagtaatacaagtacacctttagcaatcgaggcaaaccttggacctaaactggagttaagtagatctcctagaccgccgtgttttcacagtaacacgctcttggtatgccctgtgggacagagtcttcatcatcaatcatgtcattaccacccacaagcgagatttttgaagtgcgggaagattttcatgatcgagtgatagaggtatgggataagcccgtgaaagggcaaaacactgtccaaagatggaacaataagatgaatgccttatggcgccatctaaaaggctgggcaactaacactagtggcttttatcatatagagaaaggacaattgcaacacaccattgatactcttgatatcaccgcagaaagtcatgttctaactaatatggaaacagacactttcaatccagagatcggttggcacacctacttgggggagaagaaactaaatggtatcaaagggctaaatctaccgatgttcttcttggtgataataatactaaatattatcactagattgctaatagcaaacatagaaagaaacagattattagcctagaccgggatgaagaaaaaattgaggggaacgatgcttcaaaaaaattacatcacaaaattctataaaaagttttttagaccaccggaagtaagttccctttccctagatgattccaaattagatgacatcccccaagtgtcggaggcagaaaatgatcatcttattgcccctctctccgaggaggaagtaagagatgcggtttttgggatggaaacaaatagggcgccagatccagatggctttcccgctgaattttagcgaaaattttgggatgttctcaagcatgatttattgcttatgttcaatgaattttatgctagagagttcccaatttttagccttaattttagggtaatcaccttgatacccaaagtaaaagaggctaaccgaatacatatacagaccgatatagtcttttaaatgctagctttcaaatcttcatcaaggttgccactaatagaatcaattcagtggctgatcgtatatatagtgagaccaactcagacagctttcatgcgagggaacatctatctcagacagctttcatgcgagggaacaacatctaactgaaacaatgaaatactagtgctcgataggagcaaattatatggttaaccatgtcattataacggaaaagaagcatttcatagttaaccgtatcattagaacgaacaaggaaagaggttatcgactgttcgagtcccacgaacgtccgcgaactagacccaccccgattacgtggtgtcaaagacgttaaaatcagccctgttatgtcatttggccttgattcgcacgcagtacacaagttcgtgcatcagtctgtgcactattgcatataccttgcgtcttcatgtactgctaacttcatttactcaataagcatgggccagtcagacattcatcatgatatgacgacagtttagttcatgtacaatataaactttccaaagtgtttatacagtatatatagtcatagctatttcttaaacttttaataaatgcaaatatatacaatatttaaagaggcagactaaggagtataaaaaaggatgcttcacaacacgattgtcacaagatgaaaagttcatcttgctctccatggtagatacaaggaattgctttggtgcagctcctgtcctgctaatgtaaattggtgtttttcatattattaagagaaaataaggaaaatgccatcgaaaagatacaagctgcaagatatcatcgcctatgagaatggcatgtggggaatgtcaataacatatatgttggcattttccaactccgttattttttagatgccaccaagcaagctgtcattaattaccacgttcacattcaatatgtttcctaactacacactagcacaagtgttgcaaattttattttccctaggtatacataacaaaattgaaaaaattacagggtagacatattctattcaagcaaaattttattatgagaatcaatttcatttgctagattttaataaaacaaatactcagaaaatagaggacaagttcattgttcagtaagtatgtatttttttatctgtccaattaagtttgaatttggactagaaattttgtctgtcctagcttggtaatttctagaccgagttgaaatgaaatttgcaaaaagtgtaccatttccacatgatgcttccccacttaattctttaaattgttgattcagttactcttctccagaaattttacatttgtaaaaactattggatgatcttcagccttcacattatcaacagttcaaatgcttaaaagtatccagaaatatgcagtttatagacatgtcattagggtaatgactcaccgaagtgatcttcaatcaagcctcagctgtttctgggagtgtaatcaatcgggatgcagaatcgtataccaatgaactgctacaactgataaacatacaaagtaaccacattagttaaaatataagatagaatgcatcagaaaccgaggactagatttcaaatccatactttgcacatttcacactgtttcttgcaccaccgctaggcacagacagtatagtcccaaagaaggaaagattttcattgccacagttcgggcacggtccctagttatcaaaaaatttgtcattttgtaccatacttaacatgcccacgatgtatgataagacaatgaaaataccttcaaaattaaaaagtccttcactatggcactcgtaattgcctgtgctacccaaaatattagaggcagtgcggcaaaccatgtgaagatgaaactgaaaggctctggcaactgcatcattcatgaatgtaatcagtaaataacaatgtttattatctaaaaaaatcagtaaataacaaagtttgttttatggcatcagatccactgtaaggtctgatgtagaattagacagtttgttccaaaagtgacgtatgatatagaattacaggagtctaccatgctcagtattcaaaaacaacattgtaggttactattagatggttatcgtggcactgctataatatttattttctggaaaaatccatacatggcatggaaagcatatatcaggtatggcatcatcaattgaagcccaacagttaaaacaatggcgttatttgaacaagccaaactccaattacaaggaagatgtttcgtgaacatatttcttatagcttgttggaaaatatggaagaagcataatgacattagcaggttggcaaagaacagttaaagatatttactctgcttatgtagagggtaaatgatgttcatgaaaaaaagaccaacacaatttctgctatattataaaccatttattttttatttttacttttctacctcccataggtgcctcactatattcccatactttccatattacccttactggtgatgatgcacgttctactgtatgagggcccacattgcatggatgctttcaaacagtgccataccactgtcagatactacatcggatatgaatacagtgtactctaattagcatcagatatgaatattacatcggatgcggatacgccatcaattattcttggtcactaataagaggtagcgaacataatgttcgatgcagcatgcctacatctatgtcccaactggttgtgaaccgtgaccttgtgttgttggactaatatgttatatcaaggcccatgtattgtaggaccatataatctatgaacacttcatatattctatcaactatcatccctaaggggcaatcatctcctcaaacctctgatgtaagtgacaataatttgtgatttctgctctacttctactcatttatgaaattgtgtactgttgaaataaagttagatgaggccaccgaccataactttgatgtcaaaaatgcttgtgcttggtcaccctgatggactctctctctccctgtgcagtgtgcacagcctgcaccgacctctctctgtacatgcatgaagctccctttgcaaccttcaaatatttttttctcctaaattactaataatctaatctacaatccaattagaccgttgtattcatcgcaattaaatcacgacaacaagaccgtacatgattgtattatgatgaaaaaaatatatgtatgtttcaaccattgtaatttgatgtttcatgtacaagtgaatgtttcaatttgaattcaactgtattgcacattttaagtctttatgttgcaacgaatctgttttatgttgcacatgatgttatttggatgtttcaatgagtattttctaatgtttcactagttcatttgtaaatgttgcacatggtgttttttggatgtttcagtaaatattttgtgatgtttcaacaattacaactcgatgtttcatatattatataaaaatatttcaataaggaatataatattttctattttttcatcaaaaattaaatcatatgtgagatcttgttgtaaaaatttaattacaacaaatataactatgtaaattggaccgtagattgcataagtaatttaggagaaaaaaacatttaaaatttgctaatgaagtggttagaggaggggtaagtgggagagaggatggagtatgcatgcaatatgcagaggggcagaggcagcaaagcatgcggtgcatgtggtagtggttagagggtgctcaatctttcccaaaattcaggtgcttgagtgagacgatgaaattgaaaaccatgtatccaccacccattacttctatggaaagatgggcccaaacaagcctgccctcagccctcccctcctgtctcctatgcaaattacaaattctgacccctcactccctccatcatatcactcctaactctcacttcctagctggaattaccccccccccccccatcatgcacatgtcttagtgcgcacttaggtccatgcagcaaaccaagccgggcagccaaatcgtcgtctttaactgccacctggcccattgattacggtaaaatagaggtataaaggtcgcacctaattctgacttttcaaaatctattcaagtgagtgaacaaattataggactataatgtatgtttaattctttacatgtataaaatcctgaggatgtcatatatataacatcctcagaattttatacatgtaaagaactaaagaaacattatatattggtgacttagctactccctccatcctaaaataagttcattttttacccatcccacacatacaaatacaaaaccaaaaaagattataatactctcactttaccaaatcccagtgcaattataccctactttcacaaattacgatacaatgattgcttaaaagtgaacttattttaggacaaatgggaggcaaaaatgaacttattatgggaaggaagaagtattattatgagagagggccccacagaccctcgggcccacatgtcagtgagcagtactgtatggatctcaattggtatattatcttgaatttgttagaactaacctcaagaagatatgtgatctcaaaacctgtcaaatcatccaggaagaagaatctgtgaagacgaaatctagattagatataaacacagtatttagtacacataaacaaaactgccaaaaacaataatgattcttcatcgaagtgaaaaatgaccataaatctagtcaagaaaaaatatattaaacatggcgtaatgcaaaaaaaaaatgtatctctgacatcatgtcatatgattctcacagtgtcagagctaaaactgctgctggaacatttagcaggaacatcttgaagtaatcgacagtcaagtcactgtagacctgcgaaaataacaaatttgttactccaggatagattaactaaacagcatcacattagcacccaaaatagtgatgatgtgaataaggtcatgtctctacaaaatagttctctaagctaaactattcttgttttaattttgacatgacatggtttttgacactagatcatagcatgttgctggaaatattcttatagatatctacacaggggaagctccccatgtagggagatgtgaccatggttactattaatacaaccgtcgctcacatcaagatcaagttgaccaagttctggaatctaattcggccacctgctacagtgctgacttcaaactaccgccaaatgtgcatacaagctctgttttgggtccatgagtacttgatggaaagcatttggaatcctctttccaacagatccaacctcatctccaaattcctagcaagtcatcggcaaatagagaaataaggtattgcgccacttgtcatgggcctttgggcttgtaactttgtttgggaccctggcccaagtgaggcccatgtggggtggaccccaaccaggtggaacacgaccctaggggcccctaggtcgtcaacccaccgccttaaatagctaggtaccccttcagggtttatagggttttgtttatattaaagtttagtttcgctactttgctgtgtaatcccgtgatcggttaaatcgctgatttgctcattacgaaaccccaacttatcatttgtattcaattcttatttgcaatttagattgcttttagcttgttcttgcttgtttcttcgatctacttgcaggattaaggttgatctacaccagctagatcaacaacccacggagagatgtatcgatcgctaaggcgcaacacaacaatgtctcgtacggttgtagggggtcgtcaacgtttctcccaaatcgtagttatattcaactcaccgaaagatcgggtcaatcatagccatgagtgtctcgaatggagcttaggatttatcatcgggaggattggctttcgtgacctttcttggccccggtttcatatacttcttaattatactaccctggggaggtatttccctttggggccgagttcttcgaagaggcataatttaaacacaatactttttgttaaccagatgattgcagcatgcttatcaaaatggaaattgcttaccgtacttttcatgttcaacagtttttattccacaacaatggactgctatttggctaactactttttagggctgctaaactgaagctttactattgtaaattccccatatctgttatgttcaatagattagtgtaataactaaactgcagtttacaaaaaaaaatgaattagtataataaaacaaataagtcaatcccaacctttcgacttcgaagactgcatcttggaccttcttgtacgatttcacttccctctttctggccaagagaaaaaaataataacagattgacaggtaagttcagtctcggatttacattactgctacaatgtatgtcttttatatgtatggtttcatctttaaatctcatttttacactgaagctaactgacaaccaaatatcatgatagaaattactaaaatttaccgtttaactcaaaatgctgagccttataactcatgttttttataaggcaactttagcatcattaccatgctacagcactgagaagtacaattagcggagccccaaatctatcgctgatattaaataataaggtagaatagcattcattttttacagcacttaatattacacattttagcaagtataaggttactagggacaagaaagaccaacccttaatctcagctttagttcatcaaattcagcatctgtcataatggggttgccagccacataagccatggatgcttccaaaagtctttgctcatcagggcctgacgaaaaaaaatattaaataaaaagcaacgattaagcattaacatgacaacattagcatgactgaattaaaaaaaaacctctcctagtattttttttatataaattggacacaaacattcctctgtttgcagttcatccattttcctgtctctcctatcgttttaatgttattggagaaactcaaaatataaagtgtgcagtgttgataagaatgcttacaatcattttctctttttcctgaaaattagcagggatgtctcgcattcacttaatgatggatatatgttgtcttaagaattgagcttccaatgttacttgcattgggtggacataatataacggcaccaatccagcgaacgctatcacaaactcactgtcgtatatcgaacacaagacgatatgaactagtatatccagaacacaaggtatttgtgctgcgataagatggccattttatgtttctcttccattgcgatatatgcggatgggcaaatcgccacgatccacaccttagtgcaccatgatcggttctcagtgtgtgccatcccacacgccccgatcacggcgcatgacacgacatgcgcaaccagacagccagaaaatgatagcagctaaataaactagctacagggatatagataggattatctctgaatttccaacaataatctttttcttttcagcggcatgcacacttatagtgtacagtaagggccgggatctcgtacaagctagaagaaaaggaatattttataccacttacttagcatcacaacgctgcttccttcccacataagctcctccttgaggttatcgaactcctcattcgacattacggccttcttgtcgtaataaaaggcctaaagagaaggaaaaagaggaatctaatcgaattaaattgtgactcaattgacttgtaagtatagtgtatgtaaggtaggaggtagccggattcaacaagagggaagggcagggcagggcacgggcctgcagcgcctggagaaactcctgctccatctccccaatagtcttcttctccttccggttgatgctacagtaggggagcacgttgctgtcgactacaccgtcttcattttcttcttgttgttgctgctgctgcacccctccttgctgatcagcagcctgggcggcccaaacccggtgatggagtctccagccctgacagttggaccaaccgtgcgccgaagatgacgttgtgatgcggcaccggcaccggcacctcgaggacgaggatgtggacgccgcggcggcggcggcggtggggaacaccggactgggtaggagcgaggccatgaaggcacgcgacgccggccaggccagcagctagctaggcgaggcaacaggtactggtagtacaagagagcggcaacgggggaagcggccggatcactgcgcgtgtgcgggagatgcggtcgtgcgaaagggataaggtggtggtggtcttggtgaacgggggagcgatgtgtggtggtctggcgctcccctcctttatactgtgatgatcggaaaattacacgccaacgacaaaatcagacattgacgattggaagaatcgcacggacgaaacggattgacggacgagaaatcttaatcttaactaataataataataattaataataattattaaaagattgatatttttccaatcgtcacccaaaaattatcgtccgtaaatccgagtggcatcctccgtcccgcacacatgtgttcattgcgtcgccaaacaaaaaaaaaacagagacagattcaaaatccttcgcgtaaataacaaattttcccgttcgtcacacagaaattttcgtccgtcctccaaaattttgaccgattcagtgcgcatgctttctgcacgacttgtaggagtccgcatcaaatacaaataatccaaaaaaaaaacaaaattgaacaaatcgatttttaatagaggcaaacaaaaacaaaattgaacaaagacaggcagggaggataccagattcaacaggaaaggaagttggatgcggattcgatttgaactcaaaatcgaataaaattaaccccataaatacacgaaagagttactacaagcaatcgaacaagtcacggagcaattggtgatatctgacctgatttcacggaggcgggtttaattcatctccccatagatgggacaggtcgtaggcggcggttggttcgtgaggaggtggagggggttcggtgggcctccggcgaggaggcggcggcagggctccgcctccgatggggcggaggccatgaggacgtggcggccctcaacggcgagctcctggatgttggggtgtcgagggagccaggcaatgattcctggaggatggcgcattaggagcggcggctcccacatgcgaagacgtcgagaaagcaggcggcggtggcaatcgtgtgaagcggaagcaaggcggggaaaaggactgtaaagtagaaaggggatcgatctgatctaatcgaaccaaggagtggtttttcttcaccgggaaaattaaaaccgaccagttctttttttacaacagaccggttcttttcagaacatggaaaccgacccattatattcctgttctttttctattattttattatgtaggctcccacaaagtaaaaaactactgcacagaaaaaaggaagcaaatcttatctaatcgtatttttctgttcatcacgaaggcgctttcgtccgttggcggggcgtcttcgcagcctccaaatcaatagctctgagtcggatacaggaaacacatcccaaaatcgacacaaccaaaactcaaccactctttgcccaaaaaaaacaaccacaataatcaccaaatcacaaaatacgtcacaaaacttcacaaaaatatacataaaaaagaagaagccgccggatccgccaccagccatcgccacagccaccctccgccgttgccatagccgtcctcggccgtcgcaaccgccgccgacgccaccacagccgtcggagggagtcgccgttgccggatccgaccgcggccgccgccgcctttgccgtgggaggaaggcaaacgggggtggaggaagccgccgccgatccgcccgcggccaccatcaacccgccgcaaccgccgccgtatccaccgagggagaggagaagggggcgagagtggcgagacagtgtagagggagcggctgccggcgagggaggcgagacagcgtggagggagcggccgccgccgccgctcgcggggagagggggaagggcgccacagtagccgctcgtggggggagggcgccgccaacgctgctcggtgggggaggtcgccgctactacgggggtaaggccgccatcgcttttcgattcgagggagagaggggatcggggcgagtggggaggtggggagggaaataaaatctagggttagggtttggctacagatatttatgtaggtttggatcaatctgaaccgtccattcgatcggatggttccgggttctcccgctcgggccgtcggactattgggcctccaaatagacctgcaagtttgcgcaatcagagaaggagttaaaggaggtaaattagactttatttacgggatgagacagtaaaaagactaaaaatggcccatagagaaattggggtttttatttacatttttatttaaataaatgctgaaatgatgtttgtattgtcaaaattagcaatgaagctccgaaaattccaaaaaagtttcaaagagcgttattaatcatggttaatttaataaaaattaaatccaaccatatcatattattttacgacctgcggtgggaaaaggcgcagctactgtcgcttacgttgggagagaaggggtattgtttatgtctagaactatatcttataactcccatggaactataaaataactgtaatcattatcataacagtatttttttcccattgcaacgcactattaaataataatttattatgagctactatattactctctgtcattggagacttcggttaaaaataactttggttaaaaacaaatatttttagtttttttttgaacttaaatatttttagttttaatacaccgtaccgaagcacgggcatttaactatctggtaaaattactaataatcttttaattagttaagattaagattctccgcacgaatctcaatgaacattgaacggtgtagatatgagttgggtttgcaaccggttgcacaaaacgcgcttcccaactccatccatcacggtgcgtcatctcagcctcgcgcatgtagcccgtatctaggtagtttccaaattctaaatttcccgagttaaacacgaaactgaaaggaatcaaactctaatccacccaataaaaaatcagcacaaggatacataggagaagaccatatccaaatttccatctggaaaaaagaaactaaatgactaaatgaatc

SEQ ID NO: 6889 - DNA, 39069 bp, Oryza sativa
attacactattactccatgaccagagtgacatgattttagtacgcttcaatcagtgacatgctatgttacttgttgaagtaccaaagagccttaaatccttatctcctatgcaggcagaaagaaggcgaaggcttggtttgccaatggaaaacccagtagcttcagtcccaaccttaactccaacgaaggtctaaaatttccagagcacctctatttttcatgcgaccttgaaacaacatttctcacctttttagctcctcagataaaacctgttgaacctgctgtgtcaccagaacaactgagagactgcctacgaaatctgaaaaagaattacaaggtaaaacagtattctgattgcagatacgaattatgcctgcgatcattttgacaccgaagcattgagctattgactgttactggacactgttgatatgatgcttcgtaaacacaattgtagtttatcgtatatatgttcttccacatcatcgttcagagaaaatgttgatatgttctcaaaagctcaccctcgtagaatccaacaatttgtgcctcataaatgcaaaatagcattgcgttaggcagcaaaactcttgtgtcatgtttcagataccgtttcatgagttacatacatatcaactttatttgtaggatgacactactaaagtcacaagagcattccaaatactgctgaagataattgccaacatagtgaagaacccagaagaggagaagttcaggaggattcgactaaacaatcctgttttcaaggtaactatgaaaagcgatgtgcaaggaggcatagaattccttaattatttcataaaaactttttcattcatttctcttatcctgaatccaccattctcctcttaaacaggaaagagtgggcaatttgcaaggaggcgtagaattcctggagctgtgcggattcatgaagctcgcgatcagcggctacctggtaatgccgagggataatatcaacttggcacttctcaatgctgctggagttgaggtagcatctgcaatggaaaacccctactttggcctactctccaagtgaatggaagatcctttcggctacttcatcatgaggaggcagctggtgctgctgcttctctacatcgtacaatcctcctactagtgatcagtgaatggccgccactacaatgggtccatcacagctgctagaatctgtttcctgtcgccaacattcgtgtacgatatctctcggttaatttggaactaacgacagatctaacacctgggtaaaaaacactggtgcttctcaagttgtaacgcatacgatgtgtcatgtgtatgttcatccaggaggaataaaaaatgaaaaatatatacatcacctgcaatgctgttatggtaactacagtaagttgcattggtttctctcgttactgactgaatgacaagcagatcagggccatccatccatataaatggacaggtagctttgtctcaaaatttatagccatctcaaagaaatcaatagagagggaaaaagatcaaatacccattgttaatagaaaactagtattgtcagtggtagataaatggtatcgaatggataaaatttctcgatttgtggacaggtggtagataaaagaatagaaacaactcattttaaggataaattttgaactctaaaaatcgaacatttatttttttttgcaactgagggagtatgtcactgttgcttgtggagagaaacattaattggcatctgtcctcaagggagataggaatgaaagatgaaagaaagaaagggagaggtgtgctaggtcagctgcattgctgcttgccggcacatgacatgcttggctcaactgtactgtctctactgtacttggtgggcttcaattctggcagatgagaattgagatgtgagaggagccgtcatctcatctcacttccttccttgctggtccctcctctctactagtctcctggaagagaagagtgaagagaaggatagtgtggaggcaggggaccagcttactctgaagtctgaagagaattgggagattgcttcttgtcttgttgacaagctgcttctgctgctgctgatactgataatgatgagttggttctaatcatctggccattagtaggatcttgaaatgagaagtgtatacatgtgagttgggttgtgcaagttttttgtctttgagcaaggttagctaggaatgttcagggttggaacttggaagtagtgtggcaagaatccaaaaaactttgcaggcaagagtacaaaaaacattgcaggtaggcaggcaggcatgctgatgaatggaacgtacgtacacatgggcagatcaatcatcaatcttcaagtcatcaaggagccctattacatgtctgagaaccgtggcaaaatcactgtaccagcctgctatcacctaccagttttaaaatataagcatttttaggatttaaaatttatgtaacgatataagcgattccaggacactgattcctatgtataaaaatccaaacattttcaactcgtcagaagcttaaaaaggaaatctaagcaattcaaaattcaaccaataatacgattgaaagagaaatttcccatcaatcttaatcattgctaaataatctagaaatggtttattttaaaacggagggagtattaatttgggaggttctgttcttggatctatggtccatggaggcatggagcagtactgcaagcaccagcagtgtatagtactgtgacttgttaaaagcccttgatctgtctgcagcctgcacaacccatccgatcttctcgacttgaatactatgggtgtgtttagttggggaacaggaaatttttgggtgtcacatcgaacgtttgaccggatgtcggaaggagttttcggacacgaatgaaaaaactaatttcagaactcgtctggaagccgcgagacgaatcttttgagactaattaagtcgtcattagcacatgtgggttactgtagcacttatggctaatcacggactaattaggcttaaaagattcgtctcgcgatttcctccataactgtgcaattagtttttctttttatctatatttaatgcttcatgcatgtctccaaaaattcgatgtgatgtttttgggaaaaaattttgagaaactaaacggaccctatatcatcataatgtatgatcatatcatatcatcgagataaatttcagtaccatactacacctgctgatactgtactccacgaactaattacaaatgctgcttgaatcgatagatccatccatcatcgaaggcacggacctggatcacaggcaaaaatcacagaattaatccctttaggagagtagcgcctttcggtttttattttacggaccatgtaaatactttgttagtgtttttttccttctctatcaatataaaagtggtaaagctttcgcccttccttaaaaaaaaaaaaaagcctgccggcggcattaaatcacggaaatcagattaggttccgacaaaggcaagcaggcagcgatttgacacatatagctagctaagctagctagccatggcgatcgatggatgattgatactataaactggggatgggcgcacgcgtgcagatgcatagaatccaatgtcgtcgtcggctgcattgcttgctgttcctcgccagcgatcgagatcgaagaagaattagggccgggcagtagtgaatgcgagcgtacgtgaagcaggaggggacatggccatggctatcctgcagcttcttgaatgcctccgttgatgcatgattgatccgttccagaacccctggactggacttggctggatccgttccttctccttccattgatccacttattagggtttaccagaccgatgaaaaccagttagatttcacaaaaccagatttcccgccgcggggattggggtgctagaacggaatggcgggaggtacaactcgcttgctttactctactctatttatatcgagttcacactgatgcgagtgtctgaatttgaactgaaaggatgcatatatggtaaaaatagacaaactatagaaaagaaattaagtcaggttatatattgggcactgtcctaacctaatgtagctcctcctctatttcccggactagttggagattacaaccgctcagtttgtttatcaagtaaaaaatttcaaacttaattttaatattttttgacaaaatccgacctgatttttttcaatgcttttcaaacggttttcatgaacccctttttggtgaaaaccgttgaccccctttttttacgatttggtgaaccctgccacggatcgatccctaatgtgctaggatgatactagtaggagtatagtacagtatgtaatatgcatgctagtttttttaactcatcaattttatttccattttagaaatatagtagtacatgatttgaaatgcaattcattgcactgaaatgacttctcaaagatctagctctaattagttggccatgagttaattttcagccaaaatagcttatcaacgataaaaaaagtaatttatgactaaaattttttatacgtttcctttgagacttaaaatccaatattgagaacgaaaactatgttgaaaactaaaataaactccaaagttacgttttaaattttaaattttgctagctgttgattttatataggggaaacgatgaggttgctagtagcataaaaagggttgctaggattgacaagatgcgagatgttttgacattcataataggattgacaaagctgcaagatgttttgacgatcataagctaaaggattcaactcctgcatttttataaggactcaaatcgacgcatgggctcttgtgtagctcccacagagcgacccaggagtgtcttggctatggtgatagggcgaggccgtgatggatgtgtcagtattcaacaatggtggcggtggccgatcgactaacgtcaacagcaatgatattgtaggtggtacaatgattccaatggcattcggggtagatggaaggcggccattggtgtccgaatctatcgtgcctcggcaagctgcattggagtggcttcttcttctctgcattcattggatagcatcgccaagcaaaggcactagaaggtagagacatgatggcaaaggaaaaggagccagccaaaggtggatgaaatgtggagaggtgcaggagcttagacatatatgtggtgttcttttctcctgtaaataaaaatgaagatggagattaagtgttttacgtaaaacaaggtggtattaacatatggttggttaagttttagttattacaaacttgaaaaatagattaatctgatattttagagtaaatttcatattaaaagttttcgcacaaaacacacatcgtttagtagtttaaaaaacatgtcacggaaatttttatctttatctaactctcgttggagaaatgaatgagactgtaatgatcgattccttgcgatttttgatgtagtaggtctcatcatgcagcataagattgaagcctagtatttccgttttctcttaaaactagaatataattattaatgtaacttttgattgtgtgtattcatttgtggttataaataatgaccgaactttcatccattatcttaaacaatactgccgcattctcacatcctttatccgctagacgattcatttctctagctaagctgttgatcaagtgactgattagcgcacctcaacaaccaccggtagctagttactccctccgttcaaaaaaagataaaccgcaggtttacgtaccaatgtttgattgtccgtcttatataatttttttttataattagtatttttattgttgttagatgataaaacatgatgaatactttatacgtgacttatctttttaattttttttataatttttttaaataagacggagagtcaaacattggacacggaaataaaggtttgtcttttttttttttaagtacgtctgtcactcactcgacctgtccgatccaaccggccgaacggacagacagccatccagccacccagccagctagctagccctctttctttcgatctttcttgtgcagcaacacggcaaaaatgcagccacgaataagatggcccggccagtcggtgcacacgccgactcatggtcaagccaaccgctcaactcatactccttcctaatccaaaataaaatcaattctagctattcatctgaatgtactaatgcatagctaaatatattcatatttaaaatggtactatattcgtcctaaaatataaacatttctagctataaagttaaacaattgtttatctagatttatagctagaaatgcttatatttgagatagaggaagtttttttaaagaaaaaatatttatatttaaaaagttatcgagttgtacagttataaactttttcttcaaactttcaacttttccatcacatcaaaactttcctacacacaaacttctaacttttccatcacatcgtttcaatttcaaccgaacttccaattttaacgtgaactaaacacacccgatgtgtgttctggttacgtgtcagctgcttattgttgttggaacacatggttgtggttgctcttcaatgggaatggggttgcattgaacgttcaaaggcattattattagcacatgctgcacattcatatataggagatacatgcatcaagcaaacatgcataagtatgtggacaacaagggtaaagcaaatgtgtgtcgagatgttggtgcgatgcatctcgatccatgtgaaacgtcaccaccgtctagacggagtaacataggtagagagatccattacaatttcaggactcattcgggatgtaggattgaaaaaatataggaataagaaaaacatagaaatatgatagaaatgtaagtgtaaaacagagaatttgaaaacataggaatttcatgtgagtaggtgtttggatggagtaaaggaaaaacataggaatctttaagaaaataggtgcactattacaaaattatcacatgctactagtgaattaaacaacattaatcaacctaataatatgctttagttggttgatggcatgatttgcctcgttcccacgcagagggagagaaaaaagaggtcagcgtggatgtttttttcatgtgatcttccagtgatatggctagcgcaggaattttccctatgtatttcctacggatgttttcctgtgatccgaatgacgccacagtaaagtaatccataggaaccaaaaaccttcatttttcttgtgtttctcctccattccaaataagccctcaatggttaacagtatagttttggccggaggtataaacgagatatagtattttttttatgaataaagtccaatttacaccgttaactttgcgggaaaaaaataatttacctctcaactctttaataccatacgaattatcctctcctcccatccaaattcgaagcgattctaatcctatgtgatgcacaggacacatttgacatgtgtcgtcataatcagcttggtagaaatagacattatatcatctctctgcttaaatccacaccattgcccatcctttttctcctattgtacaggctagctcaagctctagttgtctttgtaggttgccatctacagcttgcacatagtcctgtttcttaagccatcactatttgttcagccttacttcttccgtttcacaatgtaagtccactataaaacggagagagtacttaagttgttgattggatggaggtcctcgtatcaaatggatatggaggctaagattgagtcatcatttttttatgtgaaaatgtgtcatcgggcttgttcactttgctaccatttttaaccttactttttttttggtaaagttaaaaaaaagtggctatatttagtttgttgccaaattttagtatgtacatataaaatgttgtcaaaatttgataaccttgtcaaaattttagtaaccttactaaaatttggcaatgccaaaacttggtaaggctaaaaatgatagcaaagtgaacaagcccatcatcggagggagtatgtggtggaggtggcaacttgatcttgatctagctattatgagcttgttgtcaatttgtcatcagatttgcgctagccgctgcctagtcatggctctaagcgtaagatctgaggccgccaccatcacagggatccaaaccaagattcattttattgtcgacttccttcaagctctaaagctatcttcagctatgggtctcatttaagctctagagccacttctagtggtacacttgtaagttactatagtcattttccaagccatccgagagcatctatatacaacatatacttcttccgtcccataaaaaaccaatctaatactgaatgtgacacatcctattactacgaatctggacagaggcatgtctatattcgttgtactagaatgcgtcacatccagtcctgagaaagaagagggagttgataataagaagatggataagagattgacacgtggggtaaaccacagttgctagctggattgcgaatagatgggaccaaaaccatactgcacagtactttgggggtaatttgtccagtgtaaaagaaattaagggtgaaggttatggaagtacagggtaaattaggcttttgtaaaagttgcgtactgtaaattggactttaaccaaatctttaagctgtgtttagttggatctaaagtttggattttggttgaaattggagatgatgtgactaaaaagttgtgtgtgtatgacaggttgatatgatggaaaaggactagtttagatccaaagaccttgtttagataggactaaaacttttaagtacctatcacatcggatgtttggacactaattataaatattaaacgtagactattaataaaacccatccataatcttagactaattcgcgagacgaatctattgagtctaattaatccatgattagcctatgtgatgctacagtaaacattctctaattataaattaattaggcttaaaaaatttatctcgcaaattagcttttatttatgtaattagttttataattagtctatatttaatattctaaattagtgtctaaatatagagattaaagttaagtccctggatccaaacaccacctagccacaaccttattcgcccgaaaaggaaacagtactacaacacttggcctgcaaattctgcactcgatgggtccgattgctctgatgaagcatgcatggggagaagaataatgcagctagtagtacttgtcgctgccagggttgtttttaccattgtgtttgtgtcatctgttgtttggttgttcgcagaattccaagggaaagcgtcaaacagccggattttgggcagctttcttcctgcgagattgatgattttttatctacttgtacagttctactcctactaggttgatagggttggtagcagggtgtcagctgaagtagtagtatgcttttggttttggaccatctaattaaacatttttatactccttctttgtttgatccttaaacaggatgcaataatgctaacaaggttggaccatgttatacagattttggccttagatggggtttctgtgatgttgatgttatgtcattattgtcagtatatacttaagcttacctaccaccttgattacttaagcagaaaaagatcaatattaccctgaacatgaactctccaattgtcaaaatcgcctaattatacacataccaaggttaaacaaactgagggctcacaaataaagtgtaatccggttcgaatttttggaccggatcaaaaaacacaaaccacttaatttttcgtcatttttttaaaaaaatcaaactgaaattttaatttttaacaaaatttattcagaatttattggtttttgtcgatttattaatggattatgcgaaatccaatgatacagcttgcaagcaaattttgattcagtatcgggactgtgaaccctaaacatagaatactaaagagaaacgtagcatcgcgtatcaatatcaagaaacaagttgaacacatcgggaacgatccaacacggaccgtctagcagcacgacggctactctcgccatctgcactatacacagcctcatactctcatccataaaataaaaaccttggttacgtcagattgcactcgagaaagatcacacaccttgcaaagtaaaaaatggaccagagggaaaaaaggaaaacttccagcacagtggctttgtgcctttgttcttcttaaagagctaggagctcatcttcctagggattgcaattttgcccatgggtccgggtatccgcgatacccgacccaatgggcacgggcgtaggtgtgatattttacccgtgggcacgcccgcccgagacccgtagatatcgtgggcaacaactgggtttcattttttacctgtgggtaacccatgcccgacccgatacatatgtattagctaattttgacttatctcttaattcttatactcctttctcatggttcatttgtgatactaattagtaataagttgtgatgtaattcaaattattgtcgataactgataatttagtaaattgttgattttatttctctttgttaaattatatatctttcgagttattattcatgtgtgatccattgggtacccaccgggtatacccgtgcccgtcgggcatgggtacgggtatagagttttgcccgctaaccctagtgggtagggtttgggtgagcgacgacgagcatggggtcaggcatggttttgctctacccgtgcccgacccgacccgttgccattcctgcatcttccacatacgtaaaacggaacgacttattagtacataattaattaacttttttagaaataaattaatgtaattttaaaatcaacttttctatagaaatttttgcaaagaacataagctctgttcggcaacaatactctgcagctgtaaccaggtgcgttgtatagccggtgtatatattttctttaccatgcactgtagcggttgctgctgtacagctgcagtttagctatattgaacagacccatacttcctccatcccaaaatataagaatctagtattggatgagacgttttcaagtacatagtatttggacagggagtccgtctagatacgttatactaagaaacgttttaacttgtcctagattcttatatttggggatagaggtagtaccgtttaacagtatgaaaaaacgtgtgaaaaatgagtgagataaagttgagaacacgtaggaaagaacacatcctgagtcagtcagcaagtgcggtgttcttttattttcgttaaagaaagaaaaaaaagaaaaattgcgcggatcaaacccatctcctctccacaatccacatgcgcgcagccgcgcgtggcgtggcgtccggcttgcgaccgcacgccaggaatcccgcggtctcgatccaccaccaattcaccgtcttccaccggcacacgcaccccgcgacgcgatccatcccaattttttttttttggcaccgggatctcaccctcgcaaaaccccgcgcggcggccacgcgcgcgcgcgcggggaggcgtggcgtgccggccgcggccaccgttttttgctgtcgcgctccacggtttcctccgctcggcgtgcgcgacgcggtgttggggttgtgttgccgcccgcccgcgccgcgacgacagaatcattggcggatgcacacacacatgcataaaaatgccggagcgtatgattgcatcttgaccagtaaacgggcaagcgtccaaatccacggaatattacgtactttgttcctgatgctggaactttacttaactaaccagatcagaacaaccctacttcttccgtcccaaaaatacccaaccttgcactagaacataataatacattagacataatcttgtatttagattcgttgtgctatagtatatcacatctagtattggattaccttctctaggacgtagggagtacttctcagccaaaaaaaggaagatcctcatgagcaatatatagcatacacttcgttgcataataaatcaatttttatagaagaaatctgaacataaattatactcccttcgttctataatataagaatttttgactttttacttgcactgtttgaccacccgtcttattcaaaaaatttatgcaaatataaaaaataaaaagttgtgcttaaagtattttggataataaagtaaatcacaaataaaataaataataatttcaaaaatttttaataagacgaatgatcaaacagtgcaattaaaaagtcaaaatttcttatattatgaggggaggggggaggggtattcagattcgtatatgaaaaataatttattttcgagagagcaaattcttgtaccaaatcagcctttagaaaattgtgggattgtaggactggttgctcttgttgttggccaaaaaccgatcacgattggttgacatttgcgagcaaaatttggtcatttggtgcatctaaataaacatttcttacgcaacctcgtaccaaaatggatggaggtggcaatctgctcacaccctttttcaaaagataatacccccaaaatcgaacctaattatccaattatgctacattgagatggatggatataggcacatcgcgacagtgctctatcaggcttaactctgtcacatacatatgaccacctgtcaggctgtcacggccccagcattgacatttggatgctctcgaccaaaccttttggcgtctgctttgccacattagtccattattatgaagaaaaagaaagggaggattagtgcaaaggaattctttttatcaggtcaacatcattaggccgatgagtaggacccctagaatgagattatactagtatgctattagagtattagtgctatactgctactaattgtactcctgcgtcggtgtcgcgcaaatttatgagatttcgacttctggtcataaatttcgccaaatcatgtgacatcagagggtaatcagcatttgaaatggcgctccctccgtggaagtaaatgagttcataccataggaatgcacaatgaagtgaggttgataattggaagctttggagcaataaatttggagttatttaacgcactagcactgcagccagtatattgatttatttctactattactcaaggatttaccaaaccgttttggatatggttcccgtcacctcagtttgactggttatcggataccaaacacgatgttatcgcgaggcatatcatggtttcaaaaactgtattatttaccaaaccgttttggatgtggttctcgtcacctcacagtttaacggttatcggatatcacgaaaaacacgtattaccgcgagtcacatcgtggtttaaccatgcgaaaagttaccgcccgagataaccgtgaggttttgtaaacctgctcttactatagatcttcaaacattgcgtagctggagcctggacaagaactgaaaaaaaaaaaactctgccagatttacaattactactaatctgtactccagtagtcaaaagttttactaatttttaacctaccaccacccaggcaagcaggcacccacccaccatctgctgatcttgatggttgaatcaaatgcgttcctacaggacgcaagaacaaaccttttgatcgatccagggtactaggtttttgaattttggggggaattgaaacatgaagagaatgtttgatctcttgcaagttgcaacaagctgatgaacaggttctaatctttgcagttttttttttgcatttgcatttgcgaagaactgaatcaagaacagaggggagaggagaggagagatctatctatgtctggatcagtggggttcttggctcgagctgagggaggcaaccttggtcgccggcggcgaggtcagaagatgtcgaggacgtcgaggatggcggcgttgcagagcgggcagcggccgcggccggcgaggagctcgcgggcgcaggtgcggcagaaggtgtggccgcacgggatgaaggcggcgcccttggcccgcgccatgcacacgcagcagcagccgccggccgccgccccctttcccgccttcgccttcgcctcgtcctccgccgccgccgataccgatgccgatgcggcggcggagggagacgcgagatgctgctgcacggtcgcgcccgagccggcgctccactgccgctccgtctgctccagcagcgccatcagggacaccctcttcccctgctcctcctcctcctccttccccaccgttgggggcgacacagacggcagctgtcgcggcggcgtctccggcggcggcggcggaggaggaggagtcgccgtaaccggagcaggcagggagaccgcgcggcggacgagggggtcaccaccttccccaccaccaccggaagacgacgggagctggtcatcccggatgatatccagcaaggtgcgcgccgccgccgccgccgcggcagccgaggacgcatgcgccaccgtcaacctctcgggcgccatggccgacgcgagggtgaccgcggcgcggcggcccgcggcgaggtcgtcctcgtcgcggagcttgaggaggtcgcggaggttgcaggaccccgcggcggcggtggcggcggccgtccccgcgggccccacggcggccagctggtccgccagcgtgacactccgccgcagcaccctcccttccatggatggatcgagctcactctctcgttcttgctgcggccaagcctgcctcgccgcgtgtgtccggacaaggcgagggggagagagagaagcagctgctgctgctgctgctttgggttaataaaagcaaaggaggaaagggagggaggagtggtcgcttggatctcggcgaggtgggggatttttcttcattttgcgggggtttttgtttgtcaatgtgtgcgccggtgcacggcacggttgcgtttggcgtaaccggttttggtttggtttggcaggtggtgggggtggtggtaatggagggacggatggggtgcggccgtgcgtgcgtgcgtgcggtcggaggcgtcggccggagacggtttctgcgtgccaatttggcccaaatggcacgaaaccagcgtgccaatttggcggtgtactgggctgtatgcccgtagcccactttgttggtcgtggaacatgacggcgatgatgatactgctgcattgtctgcccagtgttcaaaaaaaaaatcgctaggtcccggtttataaaaaccgatcaatattaaccttttttaatacattaaacaaaatttataagtttttattggtttttggttggtttacggtaaactgatgaggggcagttttcatttaaaagttttttttaaaaaaaatatcgccaagtcccggtttataaaaactaatcgaaattaactgtattctactacgttaaacaaaagtcaccactttttattggtttctggttggttttcggtaatacaatgaggagtggttttcatttaaaaacggaaaggtaaacccttctcctgactctcatcagtgagagtttcaatgcgagctgcagtatccagtagacatcagaattgattgaaaaaatgaaagaaaacgattagaatctgccgccgaatccgcgaggacagaatcgaagttgctatcctgtattgattgatgcatcagaacaccgaaattctaggagagttccaaagcagcaaacgagcaagtactactcaaagcatgctgcacattctccatcaaggaaacaagaggcctgaaacaatgttgcttagcttgcacatccaaaaatacttgggggaccaaagctcaagacatatcaagtagtaatatcgttgtattttctacctagtgtaaagcattaccaagcattagtacagtcctgtgttcttcttcattcttttccagggaagaagaacacgttcctcatgagaaaaaaaaaggagattacgaatgtgatcagactagctgattaagaacaccggccaccatctattcagctgggcaggaacgtattacagtcaatttgcaggtcctacaatgactcagccaaagcaaacaaaattggacttgatcacgacgtctactgaatggatccttgtccatccaaagaatgcttgctaatctaacaaatttacttccttcgacgttagcctccaattctctcatagaagaaaagagaggcctcgcacttgagaacttcttctagagatacttgtctgatgtcggtatcacttgcacgataccaaggggaagtgccaccgtcaggctgctcttgatttggtctcacgtaagcaaccatgtgccctgaactggtgctggggccaatgtgttcaatgacaccgactaggtgatagctggaattgtctttgtcctcagaactgaaggttacagaaaaacaaaagcaatcaaactagatgttaggcatggttattttgatctcatatcctcaatgctgcatattgctaacaagaatctcatatcctcaaacatttaacgaataaaggccctttaatgaatttcaacatgccattaaaacatgttggtgcgaaggctgggatatttatttcagtacctaaaaaatctatataattatacccttctaatgccaaatactaaaaccagaataaggccaaactaatatttttgaaaaaatgcatttggaggcacctaatcacctacaaacaaaaaggcagtcatctctaaaacataataattctgattttctaatgagatgtatcagtaaagctagtcaaaatatacaaacaagaaaaattgcttactgtgaatcataaatttattggaactgccacatgcttatatagatattgccatgcagaaatgctaatatgcaatacctggggtccatgaactgtcctacatcaaggatctcctcaaagttcacgtgtcctctaactttaccagtctccttggatctcttcagatgaatggccaatacaggtggcagcttgttaataacacgagtttgaatcccaccttgattcctattttcccgctctttttgttttgcatccacttggtctgcactatgatccacctttacttgtttccacttaccctgatctagactgctggtattttcctggccactcaacaggtcgtccggttcctcagctggaaggcaactagatacagcttcttgaacacgttcatggcaatcagtttttttgttggctatgttatcagaggccaagtcttgttcaccatggatcatcccagaagtgattttgttatggcttggtggtcgacctcggctgcgcaatgagtatgtgtgcttgacaggaggtagtgtgttgattccttcagtaatgctgtccattgcgagcatagctttacgttctgaatcagaaccatgtggttgcttacttgaagtgcattctagtgccaaactttccaaatttttagattgctcgctctggcgtgctaccttgtccaactgcacagtctgatctctgtcaattattgtgttttcgttggtgcttgccattatctgttcaccatctttactaccagtggtgctcagatggtgagaaactccagaacagttatcacatctccattccagcagctcttctttaaaaaatagtgctaggcactcttcaatcgatgcaagagagtcgttatcctttgccttgccataagccatattgctaaactgagctttccccttgtcttctgaagcaccttctacagagcaagcatttttcttggcttctatactaacttggggctcaccggacgtattctcaaaaccagcattgtcattttgccctaaatcatcagccttacttggcgagcgctgttccacttcaacagaatctgcagaatcaagcatatataaggctataatttatctgcatcagcaacaacacacaaccatcaacctccattctctacgatctgaagctgcctttcttcgagaatcaccatacttgattaagtaaaccaaccttctagagcaaaattttatgtatgaagacaaggacttaacaaataaacagtcttccactctaaggtcttaactgctagactacgacaaacaactctgccatgctaacagtgctcaaatatcatacttcttttatgtagccatcctgaaggtttactagatatttcttcagtccatgtgttagtaagtccttacaaatttttctctgtttgactagaattggagctccattccgaaaaaagtgcccgttttctcgttatgatgagaaaaacaatggtggtgtgactacaatactcctctgtttctttcatttattcctcaaaagatgtacatggtctgggaaaccctctatacctgcatatctgttcaaaaatgttctctctccttttatttagaaacacaatgcataaacttaccaccatccaaaggctcagatgttttctctttgtccacatctcccagttctaaactagcgatatgagaaacactgccttcagcaattgctttgacaatttcggtgttactcgtgtcaacctctgggaatagtttgataccagtcttctctcgagacatgcaacttatgtcccttggtggcgatgcaatactttttggcggaggcctctctgatggcagtggaactgagagctcatacattacttcatgggaaactgaattatatgagcaatggctgcaggaaatggtagcagacagttgaacacgaaaaatggaatcaacaactgtaggagatactggaggcaccattgacttctcctccttatccaattcattgagtaaaaagcaaagcaattcatggctatcttgcatatcactgcttatgaaccgtgcatccaaaacacgaatacaagcaaagaacttcgtggggttcagttggagttgtgcgttatcaacgttgtttacctcctgaaagagctctttcagttcataaccaaggatatacgaaggagcatctggtgctaacatccttgcccgcagcttgccaagcacaaataggcactgcaacaacgcattgatgtagcaagtgtttccaagattcggcatccctctgataacacagccatgccccttcactaatccagattcttgaccaaataattccttgccaaacaccatcccctgctcaacagtcggtgcactgagggtcaagtcaaattcacatttgaagcagtaccccttatatggatcactgtaccacaaaccaacccaatggtgttcaaacttccgcgcatgcagccgggcatgtccatgcggttttttcttggcctcagctctagtgcagaaatgcttgttgcatcccgtgcacaccatgatacgggtcctcccattgatcttacacccgggatgttggcacgccggaatgttcttggaggtggtgacctctgacacaatcagagtaacgtcttcctcgtccaataagtgtctgcattccgttctgtcgctttctgattccgtgtcatcgacctccatattcagacaacgttcacaaatgaagcagtacagagtgtccggtttactgaacaatgcagcgacacaatgctgctccagatcggcgtgccaccgggcgtgtccctgcggcttgtccatggtcccgtccccaatgcagaaaggcaagctgcaatcgatgcacaccaagatactgctcttttccaccttgttctcacacaggtaatgctcacacctcgcggcgaacttggaggacctgagctttgatatgaactgtaccatgtcttcctcaaaacgtacgaagtgggcacataactcctcatcggtgttgctggtcgtcgccgccgccttctctcccggcttgctcgcccccggcaaagccaggtcgccgcatccgggatcgggtacggccggagcaagcaggttcaggtccaggtccaggcggggggctttgagcggcctccccttgctcgccttctcttccggcttgctcgcctccggcgaagccgtgtcgccgcatccgggatcgggcacggccgcagcaaacagatccaggttcaggtccaaatccaggcagggggcattgagcggcctccccttgctcgccttctcctcgtccatcccgcctaggggagcaagaaccacaagaaagaatcgagttaatccatccataaaatccacaacgaatcaacacaagccatacgaagattagcatgaaacaagaaggctaaacgatacaggcaaatcatcaaacaggttggccgttaggcgaggacgaccaatccaattccaacaacctcgacgccacgaaccgtagtcatactagggtgaactacgagagctcaacaagcgggaaaaccacgaagaacattccggcgaggaaccacgaacgccgcgccgccgcggattccggcaccaagtaaaacccccaccccaacccccaccgccaccgccacaactaccaccatcaccaacaacaacaaccgagcgatcggccccgcgtcggcgacgaacagagggatttgggggggaagaaatggaggggaaaactcaccggaggatgcgaggaggggcacggaatcggccggcgcgcgagccgcggcgtcctgcgacgacgacgacgacgacgaggccgaggagttgggagggagacggtgacgtggcgttgggcgggttgggtggtggtgggcttttgggcgtgtgaatgcttctgatccatttggcttaaatagccaggaggggaaatcaaggcccggcccagtaggtgtcaaccctctaacaggctgggctgatccaaaccaaggtcctgagtaacacgaccttaagttctaagtttagaagtgaatttcaaattagattatttataagaggctaagttcctaatttaaaagattcattaggttgtttgatgggctaagttcccgatttaagactatatatttaaatggatatagaggccggataaaaaatactcttctccacaaaaaaaaaaaaaagagaaatagccactatcctgctgctgatggtttgctctcacacaagcaacggagagctcaatatccactgtggtcagttatatataaacttcaatgaattgagtctggcaaccgtgaatcgtgatgggtgatatcatataaaaacgaaccaagagttgctctactgatgtagactgactctaagctataacgggttaagaagagcataacatacacaaggcccaagttggagggatgcagtttatctactgcagctttagaatgcctattcactttactgcccatgatattacagtcacacttgcctcaaggctaattatgcagctcctccaaacaaatgttttgatcatagatagaacatggggtttttttttgtttctatttcattaacctaaaccatgctattctgccagaaagaagcaaagggcagttcttcatggcaacagagaattgtccctacggcgagctgctatggcgctccagggccccctcgtgcgtccgcttcttcatgtggattgcgctgaaagatcggtgcctcactgctgacaactttgaccgacccggcaaaaaaagaaaaaagaagaaaagaaaaggagagcaaagggcaggacagcgctatcataagtcgaaaacatgtttctatgctaaagaaaacaagcaaaccatgccaggaaaattcatttgtgcaccactgtggaagcatggttactttgatttactggtttatttcgacaaacaaaaacaaatgtgcacacagtatgcaataattcacatgctcaatgcattcaggttttatattggctatgctgcaaggtactcctaccacaactcatccctaaagtgtatcctttggtatctgtgtccactgcgggtttctgttcaaaatcgctggatagctcacattgtgggatctggcccggtttctgcggaatctagcccaaatcggagaggccagaggctggaggtcccaaagtggagatgcaaataaacacattacaagtatccaccgtccagaacaccgtccagactggagaggatttgttcaccagagattccagtcatcctttcttgtttgatccatcagaacaccagaaactgtaggggacttccaaagcagcaagcaagcaagtactcaaagcatgctgcacatggtccatctaggaaattatatgcctgaaaccatgtcgcttagcttgcacatccaaaaaaattgggggactaaagctcaagatatatcaagtaatatcgttctgtattttagacctattgtaaagcattatcaatcattagtacagtcctgctcatttacaaatggcacatgtcctattccttcattcttattccaggaaaagaagtacgttcctcatgaacaaaaaggagattatgaatgcgatctatttgcagtcctacaatgactcagccaaagcaacaaaattggacttgatcatgacgtctactgaatggatctttgtccatccaaagaatgtttgctaatctaaccaatttacttccttggacgttagcctccaatcctctcgtagaagaaaagggaggcctcgcacttgagaacttcttctagagatacttgtctgatgtttgtatcacttgcacaataccatggagaagggccaccgtgaggttgctcttgattcggtctcacgtaagcaaccatgtgccctgatctggtgctggggccaatgtgttcaatgacacctacaaggtgatagctggaattgtctttgtcctcagaactgaaggttacagaaaacaaaagcaatcaaacaatactctcagatataaacaaatacgattaatcaaaactgcataatagtgcaaggataaaacatttaacgaatgaaggcccttcaatgaatttcaacataccactgaaagatgtaaggattatctatacgattatatgcatttgccagtgcaaaggctgggatatttattcagtatctaaaagctttatatgattataacccttataataacaaaagtactaaaatcagaaaaagccaaaccaatatatttcaacaaattcatttggaggcacttaaccacctacaaacataatggcagtgatatctaaagcataataaaattctgattttctaacaaaatgtattagtaaagctagtcaaaatatacaaacaagaaaaaaactacttgcttactgtgaatcataaatttattggaactggcacatgcttatatagatattgtcatgcataaatgccaatagtcaatacctggggtccatgaactgtcctacatcaaggatctcctcaaagctcacgtgtcctctaactttaccagtcagctgggatcttttcagatgaatggcaaacacaggtggcagcttgttaataaaacgagtttgaatcccaccttgatacctatcctcccgctccttttggtttggacccacttggtctgcactatgatctagctttacttgatctagagagctggcattttgaccctggccactcaactggttggccagttcctcagctgcaaggcagctaggtacaacttcttgaacaccttcatggcattcattttttttgttggctgtgttatcagaggccaagtcttgttcaccactgtccaaattgctagattgctcgctttggcatgctatcttgtccgactgctcagtttgatctccatcaactattttattctcactggtgcttgccatcatctgttcactatctttaccactagtggtgctcctacggcgagcaatttcagaacagttctcacatttccattccaccatctcagcttcaaaatgcagttctaggcactcctcaatcgatgcaagagagttgttatccttcgccttgccataagccatattgctaaactgagctttccccttgtcttctgcagaaccttctacagagcaaacgtttttcttggcttctatactaacttctggctcactgggcgtatactcaagaccagcattgtaatttttccctaaatcatcagccttagttggcgcctgaataatctcccctgggacctcatccttctgaatttgggaaggaacatgtacaccatccttgctttgcgagtgctgttccacttcaacagaatctgcagaatcaagcatatataaggctataatttatctgcatcagcaacaacatacaaccatcaaccttcattctctacgatctgaagctgcatttcttcgagaatctccgtacttgattaagtaaaccaaccttctagagcaaaattttgtgtatgaagacaaggactcaacaaataaacaatcttccactccaagctcttaattgctacactacgacaaacaactcttccatgctaacactgctcaaacgtcatgcttcttttatgtagccatcctgaaggttttccatatatttcttcactccatgtgtttagcaagccctcacaactttttctgtctaactagaattggggatccattccaaaaaaaatgtatgttttctctttatgatgagaaaaataatggtggtgtgattacaatattccttagtttcttgcattcaatcctcaaaagatgtatatggtctgcacaatcctctatacctgcatatctgtttaaaaatgttctctcttcttttatttagaaacaggatgcatgaacttaccaacttccaaaggctcagatggtttttctttgtccacatctcccagatctaaaccagtgatatgagaatcacgtccttcagcaattgcatgaacaatttcggtgttactcatgtcaacctttgggaatagtttgataccaatcttctctcgagacatgcaacttatgttccttgatggcagtggaactgatagatcatacattacttcatgagaaactgaattatatgagcaacgcctgcaggatatggtagcagatagctgaacacgaaaaatggaatcaacaactgtagtagacactgcaggaatcattgacttctcctccttttccaattgattctgtacaaagcaaagcaattcatagctatcttccatatcactgcctgcaaattgtgcattcaacatacgaacacgatccaagaacttcgtcgggttcagtgggcgttgtgcattattcacactgtttacctcctgaaagagctcttttagtgcgctacccacgaacccagaaggagcatctgatgctaacatccttgcccgcagtttttcaagcacaaagaggcactgcaataacgcattcacgtagcaagtgttcccaagattcggaatccctctgataacacagccatgcctctttgctaatccagattcttgatcaaatgcctccttgccaaacaccatccccctctcagcattcggtgcacctaggatccattcgaattcacatttgaagcagtaccccatatatggattactgtaccacaaaccaacccaatggtgttcacacttctgggcatgcagacgggcatgtccatacggttttttcatggcctcagctctagtgcagaaatgcttgttgcatcctgtgcaaaccatgatatgggtattcccagtgatcgtacacccgggatgttggcacgccggaacgttcttggaggcgaagatctctgacacgatcagagtgatttcttcctcatccaatacaaagtgttcgcatcccacttggtcgctgctgctgtcactttctgcctccatgtcactcatctccaagttcagacaacgttcacaaatgaagcagtacagagtatccggtttactgaacaacgcagcaacacaatgcttctccagatgagcgtagaattgggcgtgttcctgggcgtgtccctgcggcttgttcatggtcccgtccccaatgcagaaaggcaagctgcagtcgatgcacaccatgatactgctcttgtccaccttgctatcgcacatgagacgctgacaactcggggtgaacttggaggccatgagccttgatacgaacattgccatgtcttcctcgaaacgttctaagtgggggcataacccttcctcggtgttgctggtcggcgccgccgccttctccttaggcttgctcacctccggcggagccgtctcgccgcatccgggatcgggcgtggccgcagccagcgggtccaggtccttgcggggggatttgagcggcctccccttgctcgccttgtcgtcgtccatcacgcctggggacgcaagaacaacaagaaagaatcgagttaatccataaaatccccatcgaatcaaacaaagccatacgaaaaaaacagcacaaaccaagcatgaaacaacaaggctaaacggaacaagcaaatcatcaaacaggttggccgccgttaggcgagggacgaccaaaatccaactccaacaacaaaccacgccacgcacgaacccgtactcaggctagggcaaaccacgagagctccacaagcggggaaaccacggaaattccggcgaggaaccacgaacgcggcggattccagcaccaagcaaaaccccaaccccaacccctacccccactaccaccaccaccaccaccaccaccccaaccacaaccaacaacaacaaaaaacagagcgatcaaccccgcgtcggcgacgaacagggggatttggggggagaaatggaggggaaatctcaccgggaagacgcgaggagggcgccgaatcgatcgggcgcgcgagccgcgggcgtctcgcgacgacgaggtcgaggaggagttggagaggagaaggggagggaccgagggagggagggagggagagctggtttggtggagagggtggcgttgggcggttacttggcgtggtgatgggctttggagttgggaggcgtagcgcgtaagcgggcgtgtcgtgtgaatgcatctttctgccttgatggggcgtgaatagccagggcccaggggaaaggaaatcaaggcccggcccagtaggcgtcaaccctccaatgtgctctctgaataaatctaccttctcctcttctttctatactttttgccaataaagtttgctcctgcttttattactactatactgctccttataattttataattatatgagagctgaggcaagcctcctgccctttcttgtttacaggagcaaatccatcaaccgttcaacatcgaccacacagatcaagatacagagctgttgagcactggaaaaaataatgcacaaggtattgttcttttcaatcaacgatggtgcatttttttgtaataactttctctatcaacattttttagaatattatttaaatcgactttttcaacttttaagttttaacggttaatttaaccgtccatgtcctcaattattatcaagaactcagtttcatccatcatccgacaccactttagcaagccatgatctttacccagagagtcaaaaggcagtaggttggcaatgcagtatctgaaattctgaatcatgttgcagcatataacagtggtatagattgtccatcacagaagaaaaaaatctggagtaaagctcatcgaatcaagtacgatctcacagagtgtgcgcacttagaagtacaatctcacagaaccgtaccaatgctgatatgatatacacaactttctcacttcattactcctgctttgtttttaagtttttctttttcgttcaaaaaaaccctaatatattcctcatggacaaaggaaaaaaaagaatgtgaatgactgtaaccagatcaaatgatcaagaacaccagctaatatccccaactaggtacgtacatgttggcaaagccctgcaaggactaaatatcattcagccacaacgacaaaactggacctgatcacgaacccacgtcagtatatacaatgattgggtcactgtccatccaaataaaccttgatactctcaaatatctgcttcatttgtgattgctcttcggattctttggtgtgtatagaattcaagacatgtcttacagtcttagcagcccattctctcatagaaaagaaggtaagcctcgcacttgagaacttcttctaaagagatttctttgatgtcgtcatcggttgcacaataccatgaggaagagccactgccctgctgctgattgtttgctctcacataagcaacgcactgcccaatatgaatgctgaggccacggttctcaatgacaccaactaaacgatagcgggaactgaatttgtcctcagaactgaagattagagaaagttaaaaaaatactatcaaaccagatacaaggaactaactcatcataggttgatgtcaacaacttgtctttgttgatcttatatcttaggaactgaatattgttaaaaagaaatctataccttatctaaaaaatacacctctattagatatgagtgaaagactggtatagatcatgttgaatgaataaccatgtaatgtgtttaaacatcgaccagctatttaaacagaacattggatatagattcacatatatccatggtagttaaaagcttcctttatctaaaaaaatatccatcatagcacttgcacttaaaaaccatgaaaatatatcaaacaagttggattcaaggtacgcatcacctaaaatagaaaagcagaaagcaatcatatactagttcagattatttctaatggtatgccacagtggtcaattataaactgctacaacgaattgagtttggcagccatgatgggtgatttcatataaacaaaccaagagttactctaaagatgtaacctgactctaaagggttagaaaaagcataacacacaaggcccgaggggatgcagtttcatctgtagcatctttagaatgcctattcactcactataaagccaagcaattcagtccacttgcatcaaaactaattacaaagctctctaaaacaaatggctccatgatgactggaaaatgagttctgttagtttctaattctgtaacctaaatcatgctagtctgcaagaaagaaacaaggccagtgctatcctaagtcgcaacctgtttctacacctaagaaaactagctcacagtgccaggaaaaatcattttaacatggctacaggaagcatgcttattttgccttaccggttcaattggaaaaacaataaataaaagtacatacagtatacagtgatccacaaactcttaaaaaggtcacagaaaaaaaaataaacagacaaaattactcagtacctggggtccatgaatggctccacatcaaggatctccttaaagctcacatgtccactcactttaagaggccccaaagatctgttgagttgaatgactaatacgggtggcagcttgctaataagacatgttagaatcgcaccttcattcctatcttgctgatcatattggttttcttccagttggtgtgcattatgacccagatttacttgattccccctttcctgatcttctatgctgatattttgacactggacactcaacaggttggcctgcttctcagtcagacggcagctagatgcatcttcttgagcacctccaaggcattcaggttttttattggctatgctgcaagaggacgagtctttttcaacagagctcatccctgaagtctctccacaagtttttatgtccactgcaggcatatcatgattttgtacaccagaaccatgtggctggctacttgaagaactgcattctacagaaagtctgatcaaatcgctagatagctccctttggcatgttttcctgtctgactgttcagcctggtctccataaaccgtcctattcacattggtacttgccatcatctgttcaccgtctttaccacttatagtgcttgccttctgggcaaccttggaacagttctcacaggtccactctatcatctctgattcaatatgcaacttcaagcactcctcaattgacacaagagagttgatatcctctgcctcatcataaataatatcaagacttcgagctttccccttgttttctgaattaatttctgctgaggaaatgaccatcttggcttctgtactaacttttagcccactgaacgcattatcaagaacagcagtgtcagttttctctacatcactgactgatgctatccatgtattctctttcattgttggggactgcaaaggacaatgtacagcgtccttgctttgcacgatctgttccaatttattagaatctgcaaaataaagcatataatttttagttatgtcctcatcagcaacttcacgaaaccagtactcatcattctctacatggtttcagaatatgtatccgctacatttgataattaggagcttcttttcttcaaggacctcagcatgtacttaagttaaccaacaatatggagaaaattttattagatgaggacaaggaggactcaacactctgagatatcttccagtggcaatagtaactgctacagagctttgccaagttaaatctgctgaactatcatgtttgtttaatacgtttgtgtagatatcctgaaggttttgttgtttctgcaattaatatatgaatcaaatccttagacattttctctatttagctagtacaagaccctgctctgatagttaccattttccaatgctgagcaaaacaataacagataatagtgctgctatcacagtttgattcattcacgaaaagttccattttctgatacaccatgcaagtttggagccctgcttaaatcactttcatttcctttagttaggcacacaagcacataaacttaccaacttccaaaggatctgatgttttcaccatgactgtatcttccaattctgaagcaggaatctgagaatcaccgccttcagaaagtacacaaatcttacattgagatataggtctttcattctgtggtggtgatgcaacactattggatggagcaccctttggtggcaatggcactgagagatcatagaatacatcacaggaataagacttaaacgagcaacgtttgcaagaggtggtaacagacagctcactaccaaatatggaatcaatgacggtaggagccacagaactaggagcaccctgttgcttgtttggaggccttattatcttatcctcctcattcaatctattgcgcaaacagcaaagtaattcatggctgtcatgaattgaagtgcctatcaaccatgagtcgaaccttcgtacacaagccaagagcaacgcccggttcagcgggcctggtgcatgcctcacgctgtttgcatcaacaaagagaccacgcagtattgtaccaaggatccccaatggagcattcggtccaaacatccttgcccgcagctttccaagaacaaggaggcaccgcaacaatgcattcaagcaagtgtttccttgattcgatatccctctgataacacagccatgcccgtcagaagacccagatgcatgagaacctgcctctgcgttgactgccaatccctccttgccctcctcaccacctatgaccaaggaatcttcacattcaaagcagtaaccaacatacagatcattgtgccacactgcaacccaatgctcctgaagcaatgcatgctcccggatgtgcccttgcggcttagccttggtggctggctcaatgcagaaataccctttgcattctgagcacaccatcatgtggtgctccccggtggttaggcacgtttcattatcacacattgggtcacccttttcagattcaacgaaatccttgatgataacaatgttctccgtgtcaaacgaatgatgatggcacacgacagcattcttggaggagctgacatctgactcgatcctatcaatttcttccttgccacatgagaagtctccacgctgcatgttgctgacatccaagtccagaagacgttcacagatgaagaagtacagagtttccggctcaccgagcaaagcaccaacacaatgctcctccagatcggcatgccaccgggcatgtccctgcggcttgttcatggtcccgtccccaatgcagaaatgcaagtcgcagtcgatgcaaaccaggatactgctcttttccaccttgttctcgcacaggtaatggtcacacctcggggcgcaatcgtaggagtaggacctgagctccgagatgaacttgagcacgccgtcctggaaagggtcgaagtgggggcataccctcccctcggtgttgctggtcgacgccgccgccgccttctgttccgggctgctcacctcatccggcggcgcagtgtcgccgcatccagattcgggcgccaccgcatactgcgggctcatcccctttcctgtctccatcgcgctcttctcctcttccatcacgcctggggcgcaagacctgaaacatgcgaatccataaatccccaaagaatcaaacaagatatacgaagaagaatacgaactgctactactgctgctgctgctgctgctaccagggatgaaccatccaaggagccttaagaagacagcggactatggcggtgaaattgaccgaaaggcgagggttccatgaattgtacggactatggcggtgaaccatgaaagctaaacgaagcggaaaaccaagagatctctactaataggacaaggcgaaaccgaccaaattccggcgaggaccacgaacagcggccgccgcggatacgggtaccgcaaaaccaccaaccgatcgagtgaatccataaattcccatcaaatcaaacaagctagacgaagaacagtacgaacaagggatgaaccgagaagggctaaacaaggcaagcaaatcatcaaacaggttggccgttaggcgcgacgaccaatccaacccaaccacaaaaccacgccacgaactctagttagccaggctcaacaagcggggccaggcaaacccagagagatcacaacattcccggcgacgaaccacgaacgcggcggcgccgccgcggattccggcaccaagcaaaaccccccacccccacccttccacaccaccaccacccaccaccaaaccgagcgatcaaccccgcggcggcgaagaacagcgggatttggggaagaaatggaggggagaactcaccgggaaacgcgaggaggaccccgaatcgatcgccccgcgagccgcggcgtcccgcgacgccgaggccgagccgccgaggtgggtgggaggagagagagagagagagagagagaggttggggaagaagcgcgcgtgcgaagagagagaggcggagatggtgcgcgtgctttgctacttaacccggccctgtttggatgggccgtaatgggcccatgagggtggccgactggtaaatgggccgtaaataaacaagagtcctaccgggcagtggccgttcttctcagaaagctattttcgttcttgtgttcttcctagatcaacttgttctagtttttcgcttttttgatgatttttatttctttacccatcatatgtaggcaaacttgctcgctggaaattggcaggtcccggagaaaaatgttgccaacaaaaacacatgtggataattgcaagcaatttatacacttatcatcatccatgcagaacattgaaagcaagaggctcaaagaagtaggatctcattgcatgttataacacggtccatacaggaaagcaatggaagaaagaaagaaaaaagctctttagaattttttgacagaaaaaaagctctttagattgatacttcaaggtgtatatctcaatcatcttgccaccagaaaaatatacaggcaaagctgaaagtttcaaacattatgttcgaaaaatttccatggtactgtaaagcaatttcaaaatagtactccctccatcccaaaatgtttaacgccgttgacttttttaaaaatgtttgaccgttcgtcttattcaaaaaatttaagtaattattaattcttttcctatcatttgatttattgttaaatatacttttaattatacatatagttttatacatttcacaaaagtttttgaataagacgaacggtcaaacatgtttaaaaaagtcaacggcgtcaaacatttagaggagggagtaccatccaacagatgtacagtaactgaactgtaccaatgcctatacaatcacctcggtcaattctctaatggcacatgtcctactatgctgttttttttttctaaatgaattcctaattatccattcctcatggaccaaaaaaaatggatacgatcagttggtcaagaataaccgaaatttctcaattggtatgtacatgttgcggtcgaattgaagtcctgcactgactcagccaaaggccaaagcaacaaaattcaactagatcacgagcctacgttggtatctacatactacactgattaaattggatcgttggccgtctaaagaatgcttgacaatctgacatatctgcttcctttgtgattgctattcggattagctgaattccaggcatcttagccttccatccgctcatagaaaagaatgtaagcctcgcactttagtacttcttctaaagagacttctctgatgtcggtgtcacttgcccaaaaccatgaggaagagccattagtctgctgcggaggacttggtctcacataagcaacataatgccctgaatacatgctatggcccaggtgctcaacaacaccaactagacgatagctggaattatctttgtcctcagaactgaagattagaggaaacaaaaaaggaccaaagcagatgtaaggctgtaactcattatagctctatgtaaacaacatcatgaatttcttgatattatttaatacatatcttatgaacaggatattgttaacaagaaatatctatctcatctcacaaaaaatatatcagtttaagtaaaatactactccctcaattccaaattgatctacatatttcataggtacaccaagaccaagaaaagctaataactctctcatactatatttattctagcaacaaactctatgcatgcaccattcccaatatttcctagccaatagcaaatcaagatattacatgtgggttataaatacttgtgtgcatggatgcatgcatcaatgtctatttactccaatgcacaaataacgaatagacttaataaataaacacaaatatgtaaatcatttaggaataacctcaaaaaaaactatatgtagatcaatttggaatggagggagtagtataaatcatcctaagcgaataacaatgtaaagttttaaaaaataaaaaaaatcatctgaaaactatttatacatacccaacatgtactaaaaatattaaaaaaacacaaatatatcaaacaagtcatattttaagaaataaaaaaggttggcaggttaggcatttcaaggtacacatcacctacaaatagaaaagcaaaaagcaatcatacatactaactcggatatttttaacgggatgtcattttcataaaaaaaaagaaaataaaataaaaaggaggataaccacaagggttactctagagttactctatggatgtagcctgattctaaagggttagaaagagcataatatacacaaggcccatgttggaggggatgcagtttcatctgcggcagctttagaatgtctgttcacacactattacagttaacttgcctcaacagccaacacacattacggagctcctccaaaaaaatgtttcaatgataaggtttcttttgtttttgttcctttagcctgccagaaagaaactaaagcaatgctatcctaagtcgtaacctgtttctatactaaacaaaactagctcaccaagtcaccatgccaggtaaattcatttttacatatcgatggctgcatgcttgttttgcttttctggttcaattcgataaacaaaaacaaatgcgcacacagtatacggtagcccacatgctcataacaagagtgcaacaaaaaaggacagactaaattactcagtacctggggtgcaggaacagtcccacatcaaggatctccttgaagctcacgtgtcgcctcactttaataggccccgtatttctcttgagctggatgactaacacaggtggcagcttgctaataagagatgtcttaatcgcaccttcgttcctatcttgctgatcatattggttttcttccacttggtgtagatttacttgcttcctccttccctgatcttcagtgttggcattttggcactggccactcgacaggttgactggcttctcacctagatggcagtcaggtacatcttcttgggcacactcaagacattcaggtttttgattgactatgctgaaagaggatgagtctttttcaccgtgactcatccctgaaatgtctcctttggtcatagtgtcctctgttggcataacttgatgctgtgcatcagcaacatgtggctgcctacttgaagaactgcattccccatccaatctgaccaaatcgctagattgctcactttggcatgttttcctctctgactgttcagcctggtctccatcaactgtcctattcacattggtacatgccaccgtctgttcaccatctttaccacttatagggcttgccttctgagcgacattggaacagttctcacacctcttttctaccatctctttgaaatgcaatcccaataactcctcaattgacgcaagagagttgatatcatctgcctcatcataaactacatcacaatttcgatctttccccttgtcttctgtagtaacttctcctgacaaagtgtccatcttggcttctatactatcttctggcttgatgctatcaagaatagcactcttagttctctctaattcacggtctgatgttatcagcacattctccttccttattggactctgcaaaggacaatgtacatcatccttgctttgtgcgatctggtccaatgggttagaatctgcagaatcaagcatataagttttaggtattctcctcatcaataacttcatgaaaccagcaaccattgttctctacatggtttgagaatctttatcccctacatttgattatttgaaagactattttcttcaaggatctctgcatgtacttaagctaaccaacaattcggagtaaaattaattatatgacaaggattcaacaccctgagctattgatgaaacactgtagcaaactgtttgccatgctgaaactgctggaacatcctgtttgtataatgctgacattctgaaggttctggtatttctgcagtccatgcatgaatcataccttaagcaattttctctatttagctaccaaaagagtgctgctcctaaaatatcctttttctcatgttgagcaacaaaataacaaacaatagtggtagtatcacagtttgccgcaaccatcaacaaaatgttccgtcttccaattcacacgcacgttttcaggcctgttcaacatcattttcctttatttagttaggtacaggaacacataaacttaccaactaccaaaggctctgatgttttcaccatgaccatatctcccaattctgaagcgggaacctgaggatcactgcctccagaaattgcatgaatcttttcggtgttagtcttgtcaattgttggaaattgttcgatggcaatcttctgttgagatatgcatctttcattctgtagtggtaatgccacacagagatcatagaatgcatcctgtgaaccctgtgaaactgactcaaatgagcaatatttgcacagagtggtaacaaacagctgaccacgaaatatggaatcaataactgtaggaaccacagcactaggagcatcctgttgcatgttatcaggcctcgttttactttcctcctcaatcaaactatcacgcaaacagcaaagcaattcatggctgtcttgcatagtattgccttggaactctgatttatagtggcgcacacaacccaagagcatcactgggtccagcaggtctcgtgtatagctcacactttctgtagcaacaaagagatcatgcagtattataccaagcatccccgatggaggcggagcgtccggtccagacatccttgcccgcagctttccaagcacaaggaggcactgcaacaccgcattcaagtagcaagtgtttccaaaattcggtatccctctgatggcacagccatgcccactaccagacccagatgcgccgatgacacagccatgcccactatcagacccagatgcgcgacagccttcctcgcctttgaccttcattcccttatcaccctcctcaccaccaatggtcaagggatcctcacactcaaagcagtaaccagtatacggatcttcgtaccacagcgcaaccggatgcccatcgtcgaacgcatgctcctcgatgtgtcctcgcggcttagacttcttggcaaaccttccaatgcagaaatgcatatcgcattccacgcacaccatcatgaggtgcctctcggtgcacatacaggtttcatcctggcacaccgggtcgccccaggacgcaatcttggacacgatttccgcaacgtcatgctcgctgcaggtcatgtgctcgcaccgctcgccgccgccgccggcgccgcctctggttgccaccgccgcggcctccctgtacacctccagcgaggcatcgccgccccatccagaatcatccgcatccagcggctcgatccgcggggctttccctttccgcgggctcctgacgatagccctatccctttccgccgcccttgccctcttctcctcttccatcgcgcctggaaccgaaacaaccacaagaaatcagcacgaatccgtcaataaaatcccccccaaatgctgtgcgcggggattacggaacaagcgaagaaccaccagaaaataaaaaaaaattgcaagaatccggtaataaaccctagcccaccgcgcggattagggatgagagacaagaacgagaaatcgggcatttccggcgaggagcgaccaaaccaaaaccgaagcgatcagcgggtgggggattgctgggagaaaacgcgcgaggggggactcaccggaatacgcggggatggctccgaatcggcgagggcgcgatcggcgacgagtcatcgacgctgcggcgcccgcgacgacaacgccgacgagatcacgagaggtttttggaggaagaagaagaagcggcttcgctggccggagcgagttgaggtgaaggagagaggaggcggttgctactttgcctgggcttatacggatgggccaaacgtgggtgggctggtatgggctcataagcatggatgatgggcc

SEQ ID NO: 6890 - DNA, 18006 bp, Oryza sativa
tttcccatctctccgtactctatatgtgtctggtcgaagaacgagacatgtggggacacggcgagagcttcgcgacgtgcgtcggtacggcgagctcgagggagaggtcggcagccggaacccaccgccgccatcaccgtcaattaaatacgaataataagaaaaataaaacaaatgcataatcagtctttctcctagcttttcatacgaaattaaataataaacaatactcaaaagatttctctacgactagattatattatttgttcattaaagttaatcgacactatatgatcatactattactagtcgttaaatttagaaaaccattaaatagtctttactcttttttttgttagaactagtagtaataatagtcttcattcattcactatttaggaagcactaaatagcaaatactccatcctttccaaattgatcatcatatatatttatgcaccaagaccaaggataatttaaatcacatcaatcaagacatcatgcacacattctctcacaatgcatgcatcgattaaaacaacatgccaattacatcttagcatgcacacattctcccatgctgtattaattatattatgataaaatacgtgtccatgcggttatatgatgatcaatttgagaaattttgaattttattatatgatgatcaatttgggaagtagggagtaaaacccacgcgttggcacgtccattagttttgaataaatacggccattaaataggcccaatcttaatccggcaccgtagaaaagccagggccggccctgagattttggtggcccagggcgaaactataaacggggcccttaatatcacatacaaaaaataaataatatagatatacatatatgaatatattgcttgtaaatatttaaagttcatccaaaagcaatatttatatgaagaacctcacaaatatttcattgcaaatttcttgagatatttttagacgcgaattcattggtgatagtaatctcatctagcaattcgcttttcataaaaacatctaacgattccttctcatttaatcatttattttcgaggcgacataatgtgaagaatggactaagaattgtaaaaataatgtattagtgttcgaactcatatagattatacaacttaaattattagcaccgattaatccaaacaaatattttcttttctcaagcaccaagaggattgcacgttaatgttaatatattactagaagaaagcaatcaacaacactaaaattgccaatcagctagctagaagcccttgcagagaagagataagaaatcgggatcagctggaatcaggaataatatagttatctacacgtgctgttgcctttggcttttgcgtacagcgtagcgctaatctctagtctaattgcatgatcgcatccctaatcacagaggggtaggtggagggccccaccattttggggggccagtgcgcggctgccccgctgaaaagcgatacgtatatatatctcacactcgccgccactgatcaaaaccctaattaaacccgtcgttaattagcattctttcgctaagccggcaaactcaaactcttaaaccctaaaccccccgccgcgagcagctcagcatcttgccgcgtcggagatttgagcggcggccggtcatcatccaagctccgcccccgtctccaaatcctggtatgtatatatccatctttctcgcccctttagatcggcctctgttatgatggtctccaattctttctaaaccctagctgatgccgattctctctttctttcctctctctccctctcttttctctcgatgtgatttcgaatcctagatcctatatatatatatatatatagagagagagagagagagaaagaggtaaattaactggtgctacatgaatatgcatgctccaagattcaaattgagtatatacccaattttaatgggtatgaaattttttaaaatatttagatataaacattaacttctttactaacaagttcaagtttgaactttctttttgttagattttggttctaagtatataatatccaaacatataattagttaggtatgtaataatgaattgtgaaataaagttgagtttgagttgttttgttgttaggtatttgtatgaatcaaattcatatacctaggtatatactcacaatttgaacatttttaaaaatttgagagaatttgtgtgttttataccttggagcctaggcaccatggagtcccatatgggtatcctatatatatatatgtgtgtgtgtgtttatatatatgtttatatgtagatttggatccgagaaaactaatgccccatttatttcggtttaagattataataatatagattattgagacatattactgtaagctggattataataagtcgacattgaataagatgttcgctgcttgtttctctgatagatagctcttagccacctaataatctaaaaaatatttttagagtggattaattaccagattatagtaatttggcttatagattgtaatgatctattataataaactatctgtttgtttcagcttacttctaataatctacattataataattctaagctttcagtgcctaaatggaaaggtatagatttgtgcgatccgagaatgagggcaagcctgttggccttgcttgccacgaggcgtattcttgttcgattgctctgtataacttcgctctactgacgtggattcccttaccactgataacaccccgatttgtgactgagcaagaggtgaaatattccatcatcgcattcgtagaacataagatcaaagatcttgaaaaaggttggagctcaaatttcgattatctgtatgaggccgagaaagaatgcaaatgtcttgtgcatgctcttccaggtggacttcagatctgtccagctcttgacaggtgcagatatatatgcagtttctgtagattttgtcgtctttgtatttccttttaattgtcttgattcaagttgtgctatttttttctttctttttttagcatcacatcgttcaagacaaatggtggacacaacttatttagtttgctggagatccgaatggtgcacggttggttagctaatcccgaggataacatctatgagacggtcaggtccttctcttgcgatgatctggagtcacacatttctgatgctctgaatgataattctgaagctgcacagaggaatagggatgcaagcaaaagtaagattgtatcatcaaacatgttactcaataaatcccacgatttgatttttttttgttctactaatttttgtgtttattcttattgcaagatttattgggtgcaaagaatcagattacaagttatgggtatatatgttggtctcactagggactactatacacttttatttgatgaacactgcaattcactcatttaatacattatcatctggactacacagatatcagtctttgtgccaaggattactgaaggatgaatatgctatcctttatcgggggagtgacaccttcaatcttattcgcgaggtattaaccctatagatagctataacgtcggtcatcttattatttgaaaatatgatgacgttttgttttaataagctgtccctctaaattgttgatgatattaccgcagaaagatggatccattttgatcctggaaacagacaaatatattagatgcttacccccaagcaaggtggaggattctggaagagataaggatatcctacaacttccttaactctaatgatacaaaactctccaatctactaattttcctatgtaacaggcggatgaggaaccaatttacttgaattgcaaatacattccacttaagaatcaaccccacatcgctaaagtaagttgtagacttgagaatgtactcccaactcaccaatttcatgctaactctcttgcacttaaaaaaattataaataacaagtcatttgatacttattgtctgacaggcaaaactatggtactatgagaagttgaattcaagaaatgaatatgctccaagaaatgtaacaaaggatgaagcttctattcagaagccaacaggaagtgagggaaaactctcaaatcaggaagcaatattgcaaacgaaacaggcttctgatgagacactgcactatagagttgttcagttcaagcatgagaacttgcttactagcattatttgccacaagggatattcactttggactgctctctataaccatttagttttgaatagagctctcgcagtgaaaccatcggaagtaaaactccaatttctgcctgagagagaggtgaaagacgcgatcattgcacatctcaaacttgtacttggtgagatagaaaaaagcgagaaatcaaaacatgaaaagctgtataactgtgagtttatctggaaatgtttcatacgttctacagcagatactcatcagatctatcctgttcttgacaggtgcaaatagttactgtagattgcttgtcattacttctgtatctttgtatttctttttaattgttttgattcatgccgtgctatatttcattgcagcttcacatcattcaaggattcttttggacgtagcttaatttgtgtgctggggatcgaattggtgcatggttgggtagctaatcccgaggataacatctatgagacggtcaagtccttctcttctgatgacctggaatcacacatttcatcccttgatgctcggagtgataattctgaagctgcacagagggatagggatgcaagcaaaagtaagattgtaatatcatcaaacattttactcaataaatcccatgatttgattttttttttattttactatttgttatgtttgatttcttattgcaagatttgttggctgcaaggaatcagtttacaagttatgggtatgttggacactagggactatacttttattttatttgatgaacactgcaattcactcatttaatacattatcatctcaactacacagatatcagtctttatgccaaggattagggaaggatgaatatgctattctttaccggggcgatgacatattcaatcttattcgcgaggtattaaccctatagctataatgccggccatctttttatttgaaaatattttgtttcaatattttatttaatacgctgccccctttaaattgttgatgacactaccgcagaaagatggatccattttgatcctggaaacagacacagatatattagatgcttaccccaaagcaaggtggaggattctggaagaggttaggataccctacgatttccttaactctaatgatataaaactctccaatcaacttattttcctatgtaacaggtggacgaggaaccaatttacttgaattgcaattacattccacttaagaatcaaccccacatcgctaaagtaagttgtagacttgagaatgtactcttaactcaccaatttcatgccaggctctcttacacttgcaaaatttataaagaacaagtcatttgatacttgtctgacaggtaaaacgatggtacttggagatgaagtcaaagaagaaaattaatgaggcttcaagcaacgaaggtgctggtcagaagcagtgttatcgagacacgcgtgtcagtgtgtcgactcgtgtcaggcgtggcaagacacagctgtagtgacaatgctgaacttggagagactagagagaagagagggatgagatagaaaatgcatgcagctaacatggtagcacccctcgagatgaaagagagtggcaatgcacttttttttttttttgatagatccactctcttgtctcctccagttttctttattgtcctttttatcttgtactactattctttactatggtagataaaaggacacatgcaaccgtcatcgtgtacagctgcaaacaaaaatatatgatcttttatgcaaattaatgccccattcacttattaagagaccccaaatttctcttgagatggagggctaacacaggtggcaacttgctaaaaagacatgttttaattgcaccttgacacaagaaaaatagaggcaaagtgaagcggataatatactattcgaactttccacagcactgtaaagcaattgcagataacagatcatccgacaaaactatatcgatggctaaacaatcaccagctcaagtctctagtttgtttttttcaacgaatgcaaaattctcaaggtgtatctcaatcatcttgcatacaatgtctctttgccataaaaaaatattgaggcaaaactcaacatggcgaatgatattttccacagtactttagtgtaaactaattacaggtaacagtaacaatcgacaaaactgtaccggtgcttctacttcaaaaagaagaaaaaaaacctgtgcatgtgcctacataatgattttgcttacttcaaaaagaagaagaaaacctgtccatgtgcctacataatgattttgctcaaattctctaatgcaaaatgtccaactatgccgtttgttttcaaataaattattaatacactcatggacaaaaaagggatatcagctggtcaagaacaaccgaattctctcaactggtatgtacatgttgcggtcaaattggagtcctgcaatgactaagccaacgcaacaagattcaacttgatcacgaacctacgtcagtatatgtacactgattaaaattgaatcattggtcgtccaaagaatgcttgttaatctgataacatatgcttcctttgtgattgctactctgtaggatccagacatcttagccttcaatcctctcatagaaaagaaggtaagcttcgcacttgagaacttcttctaaagagacttctctgatgtcggcatcacttgcacaaaaccataaggaagagccattggtctgctgcgggcaacttggtctcacataagcaacaaaatgccctgcatccatgcaaaggcccaggtgctcaacaacaccaactagacggtagctggaattatctttgtcttcagaactgaagattagagaaaacaaaaacgatcaaaacagatataagactgtacttcattatggctcaatgtaaacaacagcatgtcttatttatctttatatagttactccctccatctcaaaatagaagggcttttgcccggatgtgacacatcctaataatgtgtaacatccaaccaaaaacctttatatttggggacggagggagtatatcttatgaacagaatattattaacaagaaatcagtatctcatctcatgaaaaaaaatctgtcagatctaagtaaaagactggtataaatcatcctaagagaataaacatgtaaagtataaacaagtaaatcccctacaaactatttcaacatatcactttatatatatccatcatatattaaaatattaaaaaatacataagtatatcaaacaaatcaaattctaagaaataaaaaaggttcaacaggttaggcatttcatggtacacatcacctacaaataaaaaatcaaaaagcaattatatataccatttcagattttctttaatgggatgtcattttccaaaaaatatccagtggtcaatgatgaactactacagtgattgagtttgtccttcaagatgggtgatatcatattaacgaccatagagttactctactgggtgtaacctgactctatagggttagaaaaagcaataatatacacaagtcccatgttggaggggacgcagttccatagccttagaatgcctattcactttacagtccacttgcctcaacgcaaactacggagctcttccaaacgaatgttgcaatgataactacaagatcggttttgtttgcgtctatttctttgtcttaaatcatgttagcctgccagaaataggacagagcagtgctatcctaagtcgtaacctatttctgtgccaaagaaaactagctgaccatgcaagcgaaattcatttttagtttttaccacagctacggaaacatgcatattttgctttttctggttttcaattggacaaacagaaacaaatgtgtgcaaggtatacggttatcaacatgctcataacaacagcacacaaaaaaatggacagactaaattactcagtacctggggtgcatgaacaatttcacatcaagggtctccttaaagctcacatgtccactcactttaagtttaagaggccataaatttctcttgagatggagggctaacacaggtggcaacttgctaaaaagacatgttttaattgcacctttgttcctatctggccgatcatattggttttcttccacttgatgtgcactatgacccatatttacttgcttcccccttccctgatcttgttcatcctggtctccatcaactgtcccattcacattggtacatgccactggctgttcaccatgtttaccacttatagggcttgccttctgatcagcattggaacagttttcacacctcttttctatcatctctgcttttaaatgcaattccaatatttcctcgattgaagcaagagagttgatatcatctgccttatcataaactgcatcacgatttcgatctttccccttgtcttctgtagcaacttctgctgacaaagtgtccatcttggcttctatactatcttctggcttgatgctatcaagaacagcactgacagttctctctacaccatggcctgatgctatcaacgtgttctcttcccttgttggagcctgcaaaggaccatgtacatcacccttgctttgcgaaatctgttccaagtgattagaatctgcagaatcaagcatataagttttaggttttgtcgtcataagtaacttcatgaaaccaggaaccgttgtacattgtttgagaatcttgaacctctacatttgattgtttgaagcttattttcttcatggaccatgtacttaagttaaccaacaaagctgagtaacatttattatacgagcacaaggactcagcaaaaactgctggaacatcccgtttgtataatgctgtcatcctgaaggttctgacatttgtgcagtccatgtatgaaccataccaaagaaatattctctatttagctactagaagggctcttctctgaaaaatgtccttgtcatgtcaagcaacaaaataacaaacaatagttgtactatcatggtctgctccattcaatcattcattaatgaaaaattcatcttctgtttcaccttgcgtgcttgaaggcccgttcaacgttgttttccattatttagttaggcacaggaacacataaacttaccaacttccaaaggctctgatgttttcaccataaccatatgttccgattctgaagcgggaacctgagcatcaccgccttcagaaattgcatgaatcttttcggtgttagtcttgttgattgctggaaacagttccatatgagtcttctgttgagatatgcatcttccattccgtggtggtgatgcaacacttctggctggagtcccctttggtggtaatggcattgagagatcatggaatacctcctctgaatctgacttaaacgagcaacatttgcaagacaaggtaacagacagctgaccagcaaatatggaatcaataaccgtaggagccacagcactaggagcaccttgttgcatcttaccagccctccatttcctttcatcctcatccaaaccatcgcgcaaacagcaaagcaattcatgacagtcctgcatagcaatgcctcggaactgcgggtaacgaaagcgcacacaacgcaagagcatcgccgggtccagcaggcgtcgagcgtagctcggaccatttgtaccaacaaagagatcatgcagcaagtcaccaaggacacccgacggagcgcccggccccaagatcctcgcccgcagcttcccgagcacaaggaggcactgcagcagcgcgttcaggtagcaggtgttcccaagattcggcatccctgtgacaacacatccatacccttcctcgccgcctccggcgccatcatcggccaccatctggctctcaattgccaatgaatcctcacactcgaagcagtaaccctcacacggatcctcgcagcgcagcgcgacccaatgcgccctccggtaggcatgctccctgatgtgccccagcggcttggccctgtgggctagccctccgacgcagaagcaccagccgcattcggggcacaccatcatgaggttgctcccggtggccaggcacgtctcgtgctcgcacatcgggtcgccgcgggcggccatgcccatctcgatgtcagcgatctcgtccatgtcgcagctgaagtggccgcagtcctcgccgtcggtgtccctgatggccaccgcctcgcaatcccccggatccttcaagggattccgtgacggaacgcagccgccgcgtgaaggaccggcctccgccgccgccgccgccgccatcgcgcgtggcggtgtcggcggcggctccaggcatggggccttccccttccgccgtctctcggcagcatcccgatctccatccccatccctcgcccttgccttcttcttctccgaatacatcgccgtctggactctggaacaggaagaaaaaatcgcaagaatccgataataaacattccggatgaacatgaaccaagaaaggcgaaagaaagatgagaacaagagaggaaatcgagacaatccgggtgaggaccaaccaatggatcaagcgcgcatcgggcaacgccgcaacgtgcagcgggatttggtttgggggagaaatgcgcgacgagggctcggaatcgacgagaacgatgccgagaggttttggaggagggagggaggcggtggcgttccggctcgtgttgggtttggaggacactggagtcgggcagagttggggttggaaagagagattgagatttgagaaaatcccagaaagagagactgagagttgaggttggtaattaataagcatccaatttcaaaaatattagtattgagttgcatgcaagtgtggaatagaaatgggcagcaacttttatttaattgcgcgacagccagatttgaactcgagacatctggctctaataccatattgagttgtatgcaccgaccagttcaacccaaaaatttaagctgatgagaaaaggcgggcaattcactttatattccaacaaatatcatggataaatacaagtttgatgtaatatcaatatacaagagattttgtctctaaaatatcatcgttgttagggttccgttagcatccttccattaagtgctatagaataaacaatgcatttaacggcgtaggatggacgaaaccttaacggcaatggcatttctgatactaaatcatttgtacgaatattttgtggaaactcggactcgtcaatagcatgttttagatttgggtgtttgtcaatggtatttcttggattttctcttgagataataggtgggtccatggttcatcgggttcacaatgacaaacacacgtttctttgaaggtagaggtgcctaatcccgaaagaaagagggagtggattttaaactctcgagaaggcatatctctattgtttgcatgctatctaaataattataaaaaattaagaagtatatgtgatatatcactgttaaaatttaacttctacaaattaaaaaaaacaaattaaattataaattgttaatgtatattaacagtaaaaatagtttttttggcaatatgtaaaagttaaattaagaatgttcgtattaatttatcttgttaaaaaaattaaaaaaaatttaaatagtttcctgttagagaggtggtcatgtgcgtggatcgcatggttgctacctaaccctgctttgttttggatgaacgccaatataatggaaggagtacatggaggggtggaattgaggaatagcggcagttcttttgtgttttgttttgtttttttgtttgttttttttttgaaaagttcactcaactgcaaaatcgaatatagagtacaactaaggtataaaactagtgcaaattaagttccccttggtcgctggttttggttaaactacttacgtggtgcattgatctggtctatcgtcctacgtggcgtagaaagaaactagtactatttatgttttaaaataattataattttatattgttttagcatatatcttgaagaagcaattgcttcttgatacaactggagtactagcaagtttttacccaaatgactgctttgcttttgagcatgccagtatggaatggaattactatgaattagagggtgaattatttacatgatgcataatcaattaatcagtctgcaatctggattgtctgtccgtacatgcatcgatccgtcgtactagtatcatgcatgatgagtattaatactactggtgtttgatggtacaagcagcgtcttgttcctgtaggcgtacgagcgggcgaagcagaggaacatcgcgagtgcgacggcgctgacgccggcgagcagccagtagaagtagtcgaggtggccgcggtcgaggtcgtcggcgaaccacccctcgccgccgtcccttctggtgacgccatccagcgccgcgatgagcgcggcgctgacgaagccgccgatgcccacggcgccgcagtagagcgccagcccgacgctgcgccgcccctccggcatctcgccgtggaagaactcctgcatccccaccgccgccagcacgtcggccacccccatcgacgcgtactgcggcaccagccacgcccagctcatcgccggccgccgccccgcccgcgccgcccccagccggcgcccctccaccgccgccagcgacgtcgccagccccgcccccgtccgctgcagcgtcgtcagcccgctcgggttgcccgtcgcgcgccgcagcgccggcaccaccgcgcggtcgtagatgggcacgaacagcacgatggtcgccggcccgatcgtctggagcgcggcgggcggcagctccacgccgccgatgcggcggtccagcatccgcccctgcttgttgaacagcgtcatgatctgcgcgtccgccacgccgtacgccacgcacgccgcccatatcggaagcaggcgccgcagcgcgccacgcgcatcctcctccgacgacgacgatcgcttgccatccatggcggtgtcgggacggggcggcgcgtaaaggcggtaggtgggggtgccgaggaggaagacggcggaggcgcaggacacgacggcgaaggggacgccccagccgacgttctcctggacgtagctgacggcggcgatggcgacggcgacgccgacggccatggagaagaaccaccagttgaagagggagctgcgggcggcgctctccctggggtggcccgggtcgaattgctcggcgccgaacgccaacccgcatggcttgtcgaatccctgagcgaaggcgacgaggtagagcgaaacgtagacgaagatcacctgtgccatggaaggacggcaggcggcggcggcggcggcggtggcggcgcacgccggcagcgaggacgccacagtcagcatgccaagcccctgcaatcatgcgcccatgcgcgtgaaatccaatcaattttgtatttatccgttctaaaatatttgtagtaataagtttttacctttaaaatttatcataaaatataactcctttgtacgtagttatatatatatatatatatatatatatatatatatatatcattttttcaaccaataataatcttccgccgttcaagtttccctacctaataactcctcttctcaaaacctttgtccatttaattctacttaagatatagatttttcttagcattttttaaattgttaaaatggtgtattctttgtaaaaaaaatttatataaagttgcttgaaatatcaaattaatttatttttaaaatttgtatttgaatttttcggagaagggtactgatcactctcgaacggacgtacgcacgttcatttcaattaaatcacatttgttgtttattttaagaatgcacgcatattagtgagtaagattaatactctaccagtgggagtaacatttttaagataggattaagataaggtggagcagggagatggtgacagtgtttgatttgatcgctcagttgcgaaagggtcagatatataagtacttagtccatgtttgtttcagcttaaaattattataatctagattatagaactagattattataagctggattataataagccgatatagaataagctgctagttgtttgtttctctggattattatctgtttgttagttgttagtcatccaataatctaaaataagcatctttagagtggcttaccaaattatagtaatctggcttatatattataataatctattataataagctatctgtttgttttagcttactcataataatctagattataataattataagctgaatcaaacagggcttaattaattggatggaccaaatgtgtgagcagagagttttcttcttttgacagtgcttgtactaattaatacgcgtcatccacgtctttgttgcttgcagatgcagatcgatatgcacatttctatcttttccattatatttttgtcctgatgatgattactagtactgtactatcaattactaattgtgttcgtacgttaatgggcaatataacaagtggtcagaggagtattagtagaagtaacacgaatttcatggcagacatgctggcatatacggggtgctactccattattattcatcgaggagtggtaagtactaaattaacattgacaaaattgaataaaccaccaaattatcacttctgttttgaatttaccctcaaaagctgatttgttacaaaggccaatcacccaaacccttttttgataaatacttatcattatggagccaatcagccaacgtgtacccatagtactacctttatcctaaattacttctctttagaatagtactacctttatcctaaattacttctttttagaatttaaattttgttccaaaatacttatcattacggagtgttagttgtcttattcaaaaccttttcaattttatccttaataataatttcacttcttataatgcattattcaataagaaggaaagagcatgaccgtagttgattgtcactactcatcggctcatcgccgttgccttcaaccctcaagttattcaagttcatctttctgctttaaactacaccctccgtctaaaaaaattaaatattcagaatcatagctagaatttatattttttttaagacagagagtacaacaggtatcgagctggctgatctagcctttgtttatttgcgtgcacggatggatttggtgggtcagcctttgcagcaaattgactttgggtgggagttggaaaaaacaagagtgaccagttttatttacaatcttaacaataaataataacaaatggatggaggaatatatagtaaataataaataaaatattaccatgacgtagagggtgcaggcgaggaggatgaatgggtagcggccgagaaggagtcggcgaggacggcgccgaggagagggagcatgcgcgccgtccccgaccacgcgttcgccgccgacgcgttcgattgccccagcggccccgtcaggtagctgatcaggttcgccgacacgccgtagtaggagaagctgcagcccatctccaacactgcaacaattcattaatcaattaatctctcatgaaatctaatcaaactttgcaaattaaggaacaaaattaaccaaaccgaacaaacatcggtatacgcagtacacgctcactggcgacgaacagtgcggagcgccagccgcctgaggtggcgcggtagaccggccgccctcggaagtcggacacgccggcgagcggcggctccggcggctgcggcggcggctcgtcaccctcattcggaataagcaagggacggcgactgtccatcggatcggatcactcgttggtcgctttgggtgtgctagtgctagtaggatttataggagagcactgagcactctctccaattgagaagaatcagaaaatgctgctgctgttattgccctcgtctcctcctgctgctgctgttcttgttcatgtcgagtgaggcagagaggccactaactatggcacaattatccccgaaaaaaaaacaaaaaacaaaaaacaaaaacaaactattgcatgatttgcaaaagatagcgaaatccaaaccgtccatctccttaacccgtgatatatatgggcatgttcactttgctgccaaaaaaaaaccttatcaaattttggcattttggcatggtaacttgccaaaattttggcaagatttcttatatagttaccaaaatttagcagcaaactaaatgtagccacttttttggcaactttactaaaatttagtaaggttgaaaatgacaccaaagtgaacaggccctatatttcgaagatatttaagagcaccacgaacgaatcgacgacaaaggagtgaaggactgagtagtgagtacctaggatgtcctactggactatagcaaattaaaggagacgacaagtagcattaactgggccttctccccaccgataattcaaccacagcaaattaaagctgatgcaggggtgttaggttcatggccacattttgccacactacattttttattgccacagtttattagatatgtgtttagttcactgtcacagttgtgactcgccacactttttcaacagcatgtcctatatgtcatagacttaattttcttaccaattttaccacactctgtggctagcaatttattcaccacacttttgtgactaccataacttgcctaacgttagttgtggactatagcaaattaaaggagacgacaagtagcattaactgggccttctccccaccgataattcaaccacagaaccaacatctttaacttttaaagctgatgcaggggtgttaggttcattgccacattttgccaaactacattttttattgacacagtttgttagatatgtgtttagttaactgtcacagttgtgactcgccacactttttcaacagcatgtcctatatgtcatagacttaattttcttaccaattttaccacactctgtggctagcaatttattcaccacacttttgtgactaccataacttgcctaacgttagttgtggactatagcaaattaaatgagacgacaagtagcattaactgggccttctccccaccgataattcaaccacagaaccagcatctttaacttttaaagttgatgcaggggtgttaggttcatggccacattttgccacactacattttttattgccacagtttgttagatatgtgtttagttcactgtcacagttgtgactcgccacactttttcaacagcatgtcatatatgtcatagacttaattttcttaccaattttaccatactctgtggctagcaatttattcaccacacttttgtgactaccataacttgcctacaaccaaacacacccttaaaatccatagatagtttcggatggtgctttttgatgattaacgtgacacccacatggtgtattgaaccggttgtcatctcctacgtgacgtctattggatgaatacaattagaaagaaaatagtgggaccaatatgtcattaacatctcttcctcctcctctacccttggtggacgcagatgaatagcgattggcttaagcagccacgttagctcgagctccttgtctccccttcccctagcatcatgatccgtttcctctactctatctctagcatcccaggcagaattaaatcgggccacatcgtgattttgcaacttgacttacactggtttagacttatactagttttaacagtttaacgacaattgatatctgattttgcgattgagaaatatgaatggaacatataaaatggacccccttttttttttgttctttcctctacccatatggggcctgttagggagaaaatattttttgctaacacagcacatgtctctcatcatcaatggagaat

SEQ ID NO: 6891 - DNA, 11158 bp, Oryza sativa
  unsure (1)..(11158): unsure at all n locations
attcttggtcgtccaaagaacgcttgacaatctggcacacctgcttcctttgtgattgctattctgattagttgaattctggacatctcagttttccatcctctcatagaaaagaagataagcctcgcacttgagaacttcttctaaagagacttctctgatgctgtcatcacttgcacgaaaccatgaggaggagccactggtctcctgccgaggacttgctctcacataagcaaggaagtgccctgcatcgttgccaaggccgcggtgctcaacaacaccaactagacgatagctgagattatctttgtcttctgaactgaaagattagaaaaaataaaaaacgatgaaaagcagattttaactcattatagctacatgtaaacagcaaacatctttcttgtgttaatatccttgtattgaatattgttaataattattctattatacaaaatactactagtatagatcatcttaagtgaataaccatgtaatgttacaaaaataatcaacaaataagacacactgtgataatttaaacaggtattaggtttacgagtccaccatacactaaaaatactgaaacaaaaagtatgtcaaacaattcagttttttaacaaataaaagtgctgcctggttagttatttgagggcacacaccgacaaaagaaaaggaaagaatagaagttcctagatattataaattggattttaattagattgtgattgaaaaaatccagtgtagtcaatgatactctgttacagtgggttgatttaggtaggaaaatgagtgtgatatcatataaacacacctagagttagagagggtgtacaatagatgactctaaactctaaaggtaggatgagcaagaaagcagagtacagtcaaaccatgctgttaaaatcaaatcgcacttgactccccactacagttgaatcattcacattatcaccttgttttcttttttcacatttcacataataagagcataaccattgaaattttactagcaagggtgccagacagccattcaaaattttactagcaagggtgccagacagccattcacaggtgcacctagggaaaaatcctaaatgggttaataatgttcagtaaatcccatgtgggagggggttcattgatctgctgcagcttaagaatgtctattcactttactgccaatttgtcatagtccaaattgtctcattgcctacttaatgagctattccataccaaatgctcccatgacaattaaaacattggttttatcattaatccatgttggtctgtcagcaagaaacaagagcagtgctatcccatgtcctaaacaacctttatgctacacaaaacgaactggttataccaggaaaatacagcagtctggtactctggtgtcaattcattttttgcgtggaacaggagattgctcaatttagagctttacaggttgaattggacaaataaaaagcattgcacacacagtacaacaatccacatgctcataacagcagaacaaggaaacataaattactcattgatatgaaatgctggtgtcatctaaaagcatcattttgtgctagaggtgtattcttaaagtaggaacaaattaataaaaaaaatattaattggcttactgccaataagatagatatttaaattggcttaacacaattagaagtcgttgaacgccaatgccaatatattttcaaaaaaaaaaaaacagagatgaggtatcggtacgacggtacctggggtccataaacagacccatatcaaggatctccttaaatctcacatgtcctatcaccttatgaggtcccaacaaagatctcatcagatgaatgactaatacaggtggcagcttgctaataaaatgttttttaattccacctttattccaatctttctgctcattttggttttcttccacttggtgtgcaccatgatgaagctttacttgctcccccctttcctcacttagtatgctggcattttgatcctggccgctcaacaggttggcctgtttctcagctggaatgcaactaggttcagcttcttgaacaccttcatggcattcaggtcttccgttggattgctcgcttcggcatgttatcttctctgacagttcactctggtctccatcaactgttatgtcctcattggtacttgacatcataggattactgtatttacctagattgatgcctggcttctgagcaaccttggagcaactctcacaagtccattctaccatctctgcttcaaaatgcaattccaaatacttgtctattgatgcaagagagttgataccctgcgcgttatcgcaagaaatgtcactactccgacttttcctaacttctactgagaaagtgtcagtcttggcttctgaactaacttctggctcactgaacacatcatcaagaacagcactgacatttttccctacatcacttcctgattctatccatgcattctctttccttagtgaaggccctatatcttctggaacatgggcatctgtttttgtcaaatccatttcctcaactttgacatcaggtaacatgttttgaggaaggaaatcaacagtctccccttggaccttatccttctgagtctgcaaagggcgacatacagcatccttgctatgaaagatctgttcaactttagtagaatctgcagaatcaagcatataattttttttgtcctcatcagtatcttcatgaaatcagcaaccatcattctctacatggtctgaaatacagtctttatcctctatatttgattatttgaaacttcttttcttcaaggatttctgtgtactttaagttaaccaacaatttggagcaaaatttattatatgaagacaaggagaactcaaaaacctagagctatcttccagtggcaagaataactactgcactgtaacatacagctatgacatgctataattgcagaaacatcctgcaggttctaatatttctgtagtatatttaacagtcaagccattaactctttccgaaaaatgccctttttcttatattgagcaaaaactaacaaataattgtggtaatatcagagttttctgcattcactcaagaaaaattccatgttctgagacacccaacatgttgcaggcactgttaaaaaaaatgttgcaggaatgttgaacattgttttcctttcctttcattaggcacaggagcacataaacttaccaactttcaaaggctcagaagttttcaccaataccacatcttccaattctgaaggactttgagaatcactgtcttcagcaatagtatgaatcttttctgggttacgcttgtcaacttctagttcagcatggatcttctgttgagatttatatcctttagtcctcggtggagatgcaatacttttggattgagttggtggaaggggcaccgagagatcatggaatgcaacatgtgaaactgaactaaatgagcaacatttacacgatatgtgagaagacagctgaccaccaaaaatggaatcagtaactgtaggagtcactgcatcatcttgcatgttaggaggatttgtccccctgtcctcctcatccaatttttttcgcaaacagcaaagcaattcatggttatcttgcataaaagctcctatgaaccgtgagtccgacttgcgtacataagccaagagccaagtcatgtccagcaggcctcctgtattgttcacaccgtatgtctgatcaaaaagatcgtacagtattgtaccaagggtccccagtggagtgtccggtcctaacatccttgcccgcagctttccaagcacaaggaggcactgcaccaatgaattcaagtagcaggtgtttccaagattcagtatccctttgatagcatgggcatgcccatcagctaacccagacacatgtgacctctgtcgtaggctttcccccatcatcatccttaacgctgatttcgctgggctctcttcgcgcggcaccccattgttgtcagtcatccccccatcatcatccttaacaccgatgtcataggcttcttcacacttgaagcagtacacccgattcaatctctcatagtacaaagcaatcgaatgctcttcttcgtgcatggcgtggatacaggcgtggttggcgcagaggcgcaactcgcattccaagcacaccatgatatcgttcgccgcggtgacgtcgcaggtgtaatcaccgcacaccgggacgtcctcggagaacctgagccccgacacgatgtaatcgacgtgatcctggtcagacatgaagtgctcgcaccgctcaacgccggtgccgctggcctccagcaacatcgcctggaaccactcagaatcgtccgccgccgccgacgccgacgcagccggcggctccaggcgcggggatttccacgggctcccggcagtatccgccgcccttgccctcttcccctcttccatcgcgtcttaaaccccaattcaaaccctacagattagcgagatcaatcaacatagccaaaaaaaaagtgagaatccaccaacaggatcggaaatcgaacatgaacagcgccgcggcgaatccgcacaccaaaaaaaatagaaaaaaaaacaccaacacccaccgatcaaaccgcccatcggcgacgaacagcggggtttagggggtgtgtggaaatgtgggaggaaacttaccggaagaagcgaggaggacccggagtcgactagcgccgcggggtgaggcgtccgcgacggcgacggcgacgacgacggcgagaagttggaggaggagaggagggggggagagcggcgaaggcggcgtcgctggtcggggacggcggcgctcgggtgggtgtatattgggctaaatgggcctaggtggccgtcgtgagttcaacggagcccatggaaagtatatatttcctcctgtaaaaaatgaaagtaaatttcgaaatgtcacgtatactaccttcgtcctaaaatggtttgaccacggatattaaaaaagtaggtgaaaataatgaaggaaagttgtgattagttaagtagagaaagtagatgagaaaattagtggataatgtgtgtgattggtaaagatgatgacaggtgggtagataaatagcttcatttttggaaaaactactatgctagaaatagcatttagtatctttttaatagaaagcatgtatatactcatggcatataaccgcagagtttatgatatgtgaaataatatttcaaagtaatagagagttaacccaatcatctgaattttaaaaaacaaataatttaaaattctgtagacaccttatggcatgaaaatttaattaaatatattatctggattatatgggtgtggattttctggaatcctgggactataatatcagaaattcagggttgcatgccacaagttatactaaggttggattatgcaactttaagttatcttaaatttacttaaaagaaccctctttccagaattccatgttctcctttttatgcttttcttttccaaatgaggttcagttttttcattcgtgatgtcaggccaactcgattgcacaacacttgggcaacaccaacgctataaattgacacctccaagagagttagttaaaaacaaatcctcctcttgattgcttcagaagaacagcagtgatgcaaacaaagcaaatgtccatctcatcatcaagacatcagcggagcagtagggtctcatactctaattgcatgtcacattgtatccattctttcctttcaaaaaaaaaacattgtatccgttcagaaaagataggtccaaagaattgctcttgttatctctactacttctcaagatatatgattgtatctgaatcatcttgcatacaatgtatcttgccatcacaaaaattattgaggcaaagctcaaggtataaaagaaaatgtgttcctgattttacagtactgtaaagtaactacaagtaacagtaacatccgacaaaattgtaccagtgcctatatattcatcttgctcaatcctctaatgcaaaatgtccaactttgatgttttcttttcaaatgaattcctaatatcgtcctcatggacaaaagagaagtggaaataatcagttgttcaagaacaacccaaatctctcaactggtatgtacgtgttgcgctcatgcaatgactcagacaaaagcaacgaaattcaacttgatcacgagcctacgtcagtacagtatgtacactgattaaaattgaatccttcgtgcccaaataatgcttgataatctgaaaacatctgcttcctttgtgattgctattctgattagcagctggtggatacaggattccagacaccttagccttcaatcctctcatagaaaagaaggtaagcctcgcgcttgagaacttcttctaaagagacttctgtgatatcggtatcacttgcacgaaaccatgaggaagagccattggtctgctgcggaggacttggtctcacataagcaacataatgccctgcatacatgctagggcccaggtgctcaacaaaaccaactagacgatagcgggaattatctctgtcctcagagctgaagattagagaaaataaagatgatcagagcagatctaaggcttttaactcattatagctcgatgtaaataacagaacgcctgtccttgtaactgaatattgttagcgagatatctgtcagttaaaaagactggtctaaatcatcttaagcaaataaccatgatgttatgaaaatcaacaaataaacagtcataatttcaacaatccaatggaaaatgttaggtttgtttatatccatcatacactaaaatactgaaacaagaacagaactatatcgaacagcccggacttctaacaaaataaaaaggtttccaggttagccatttgaaggcacacccctaaagaaaaagagctaaaagcttctagcctagagttaatctaaggatgtatgatctgatctgactgtaaagggtaggcaagagcaagagagtacaatcagatcgggatgttaaaatcacccaaaattcaaattatttgattacccaaatcacaattaaattccccaaatgtagcagaatcattcacgttgtcaccttgtttcgttgtaatcatttcataatatcagcgtaacaattgaaatttacttgcaaagggagctagacagccatcaagaagcacaccatttcttatttaactatggttaattttacaggagacatctagaatctagattacaacttgacacaccatacaataatccacatactcatagcaagaaaacatgagaaatggactaaattactttgacctgcaatgctagtgtcatctgaaagcattcttttaggggagaagtgtaaaacaaatgggaacaaattgagaaaaataacatttatcagcttactacaaataagaaacttaattacacgggcatagaacaaacagaaatctaataaacatcatcagtcatatgttttcggaaaaaaacagatgcagttgtcacttgtcactacctgggatccatgaactgccccacatcaaggatttccttaaagctcacatgtcctatcaccttcgttaaatcctccaaatatctcatcagatgaatggtcaatacaggtggcaacttgcgaataagacgtgtttgaatgggacattcattcttatctttctgctcattttggttttcttccacttggtgtgcactcttctctaactgttcactctggtctccagctgttgtgtcctccttagtacttgacatgatgcctggcttcttaagaactttggagcagttctcacaggtccattctatctctgtttcaagatacaattccaagcatttctcaatcgatgcaagagagttgatatcatgtgccttgtcataaacaacatcgctaatctgagttttccccttgtcttttgtagtaacttttgctgaggaagcggtcatcttggcttctgtactaacctctggttgaacagcactgtcatttttctcttcgcttagtggagaaacaaatgatggtgaagcaggatcttctggaatgcggggaaggacatcaacaacctttccttggaccttatcctttctagtctgcaaaggaccacctgcatccatgctatgagatatctgttccactttggtagaatctgcagaatcaagcatataagtttttagttttgtcctcaacagctacttcctgaaaccagcaatcttcattctctacatggtttgagaacctttatcctctacatttgattatttgaagcttcttttcttcaaagatctccacatgtacttaagttaaccaacaatttggagaaaaaaaattattatacgaaaacaaggactcaaaaccccgagctatctccccttggtgataattattgccacacttgtaacaaaaatctatgccatgttaaaactgccgaaacatcctgctaatgtaaacatcctgttgtgcagtccatgtatgaatcaagtctttaaacatttttcttcatgtagctagtacgatagcgccgttccagaaaatgcccttttttcttatcttgagcaaaaactaacaaacaatactggtactatcaaaggttgctgtgctcattcatgaaaagttctatgttctgacttctgagacagcatgcacatttgtaggattgttcagcattgttttcccttcctttaattaagcacacaagcatataagcttaccaacttttaaaggctttgatcttttcaccaagaacacatcttccaattctgaagcaggactctgagtcttttcattgtcacttttgtgtttgtctattgctgaaagcaggttgatacgaatcttccgtggagatctgcgacctttagtccatggtgataattcatcacttttggctggagactcctgtggtagtggcactgagagatcatggaatacatcatgggaaagtgatctaactgagcaatgtttgcatgaactggtaacagacagctgaccgccaaaaatggaatcaataactgtaggagccactgcactgggagcaccggcttgcatgttagacagcttcattgccctctcctccttgtccaaaccagtgcgcaaaatgcaaagtgcttcctggctatcatgcataccattgcctttaaactctgggttcagcatgcgtacacaagccaagagcttctctgggtccagcaggcctcctgcattatttacactgtctgcatcatcaaagagagatcgcagtgagctaccaaggagccccaatggagcatctagtcctaatatccctgcccgcagtcttccaagcacaaggaggcactgcagcaatgaattcaagtagcatgtatttccaagattcggtatccctttaataggacaggcatgcccaataactgacccagatgcatgatcacctgccacattgtcaactctcattcccttctcatcctcctcacgtaaactgatgaaatagtcatcctcgttgtccattaccaccccaaaatgctcagttctgatgaaatagcactcttcacacgcgaagcaatacgccacatgtggctttttgtacaccaaagcaacccaatgcttgttgaccgaggcgtgccatttcccgtgtgtagtgcagaaacgcgattcgcaatccaagcacgccgagatttccctcccctcagtattgccacaattgtcagcattacacattggggtgtcatcgcaggtcttgatcagtgctatggccaaattaatgtcatcctccccatacaagacgtgccggcaccgccgagcacggcagtcgccgccgaccgatgccatccattgtaacgccacgactttctcccaccaatcgttcacatccagcgccgttgccgcagtatcccctggccttgctgccttcttctccacgtctatcacgcctgaaattgcaagaatcaaaagccaaaaaaactcgcgtgaatccagaaaccccaaattatcggtaaggactagggatgagaacatgaaccaagaactgaagaaagcgaaaataggaggaggaggagaacaagatcatagaagttcaccgagagaggcagcatttgggtcatcgagctccttgctcggattgtttttgatcaacccaagcaaggacttgagaccgactccagattcggcctgatctgtcgtcgtcggaattcggtgcaccaggcgcggggatttccgcgggctctcggcagtatcccccaccctcggcctcttctcgtcgtccatcacgtctgcaattgcaacaaccacaagccaaaaaatctcgcgtgaatcaataaaccccgaagaaaaccagaacgaattagggaaaaatccataaacctcaaagcacgccgcatgagttcaccaaaaaaggagaccgcgaggagcaaccaataacagcgcgaggagcaaccaaaccaagaaaaaaccgaaagaaatcgggaaaaaaattccgagagaactccaccataggagagcaaggggcgagcagcatttgggccattaattaagcaagggaagaacaacgcgaggagattctagggactagaaaccgaaataatcggagaaaccgagagagaactccaccaataatcgaaccattccggcgaggacgaccagcaaccacccgcgccccgccgcggattcgcgaaccaataaacccccacccaaaagcgcgcgatcaaatcaaaccccccgcgtcggcgacgagcagcaaagcatcacagagagagggggggaggaaatgcgggtgcgagaactcaccggagcaccgcgcgcgtgctcggaatctcgaacccagcgcgcgctcgagctggggaatccggcgacgagggctcgcgcgcggcgaggccgaggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccttggcaggcatcattccccccccctttttttcgggccccccccaaggggcccctttttggggggggccccggggcttttttaaaaaaannnnnnnnnnnnnnnnnnnnnnnnnnnnnnnnnnnnnnnnnnnnnnnnnnnnnnnnnnnnnnnnnnnnnn

SEQ ID NO: 6892 - DNA, 628 bp, Oryza sativa
tccctcctcctccccttccccccgcccccggccccgccacgcgctccacatcccgagcggcgtccccgccggcccgccaccgccagcgacggtcgagcatgcagccgcgggtggctgcagggcgcctgcggcgggcgcctcgcgcgcgcgcagcacccgggggctcggcgctatgagcgccattgttcggggacccggcgcccgcgctgcgcgttggtcggcggcggcgatccggtgaggcggtgagcgaactgttcgtggcagtggcggcggcgggaagcctgagcttatccgtattgctgcgcttgcgtagagaggagaggagaggagagaagaggaggggtggagcgcccgccgacggccaggtggggtaggaagggacaaaagcgttggcgtctgggcgactgggccctaccggatcgcggaaatatctcgagattttttagtgggaataagttcacttcaggaccctcaaaagtgaccaatctaattcatgaccttaaaccgtaaaaccggatatcttcaccccccaaactattgaaaccggtgcaatttgactcccttggtggttttggatgacggcttcgctgacgtggcgctgacgtggcagtattgactcggtcttctt

SEQ ID NO: 6893 - DNA, 81612 bp, Oryza sativa
  unsure (1)..(81612): unsure at all n locations
nnnnnnnnnnnnnnnnnnnnnnnnnnnnnnnnnnnnnnnnnnnnnnnnnnnnnnnattacatataattttacaattttttttgtatgttatcataatttattgttgaatcattggaaagcgataagtgatataatagttatgagaaacattgtctatcatccaagggataataaaagtgaccataatttttaaaacttaagtagaattgtggagcagcctaatctcatctccatttttaaaatcttaagtagaattgtagagcgggaactagctcaactttctgtttttaaggtgaagctcagaccgtttggtagggctataggtatacctctccattaacttattataaagttaaaaacatatttaaaatagtattacaaaatattcatgcatagatttttttttaaaaaaaaaactacgccgttttgtagttcagaaagtggatgtgatagagttcggtggtacgtacgtactcttcgtgacagtaaatataatgatatatcatattccggaagagtgtgaccaatcaccaatggcaacttatggatcatatcatctagctacaactcgtttatatatatacaaatcatcctacagcgatttctcttttggacgcagacgccgacgcaacggcgcatgcaagccagttgccgagttgtcgtccaccagtttctggtcgactgttgtaacccgatcttggtcgcgcgcagctgctagctggtgcacgcgagacggacgcgcgcgcgcgcgcgcccacgtcgtcttcacgggggccggcggtcacgcgaccccgtcgcgattgcgatggaggccggcgacccatcacccgtgcctagctagctaattagctcccgttcatttcgtagggccgctgcacaggtgatccgtcgtactgtcgtggcggagcgcgacgtgacggtgctcttatgattactgccttggccagccggggtcccaaatactatagttcctccgtttcatattatggccccgtttggaagcagatcctctgacttaactgtgactcaactgcacagcagttaagtcagaggatccctttctgctctgtttagttccccaaaaatttttcccaaaaatatcacatcgaatttttgggatgtatgtatagagcattaaatatagattaaaagagaaactagttacacagttaagggggaaatcgcgagacgaatcttctgagcctaattagtccatgattagccataagtgctacagtaacccatatgtgctaatgacggattaattaggctcaaaagattcgtctcgcggtttccatgcgagttatgaaattagttttttcatttgtgtccgaaaaccccttccgacattcggtcaaacatccaatgtgacacccaaaaattttcatttcgcaaactaaacatgccctatatcatgtcctccgtttatattacaagatgctttaattttattagttaaatttgaatagattgggtcgaatttatgaaaatatattattccaatttttttatgaaaatatatagcaacttctacaacactaaattagtcacattaaatctaacattaaatatagtttaatagtatattggtatggtttgaaattttttcatataaacttagttaaacttagataaatttaatttaggaaaaaaaagttaaagcatcttataatatgaaaagaagaagtatgttagtagtacataatacatggtactcctagacgcgtaacctactagtacgattaaaagccatgacaacaaggatgaaggtaagaagtagctcgattgagatcctctacttaagtcaagtgacttaacagtcactaacatgtgggtccatagcaaagaaggcccacatgtcagtaactcagaggatctcaatccgtagcatgagtaggagcaaaatatctactaccacgtagaaagattaaaaaagtaaaaattgtaaggtagtcatttgcccccagatagtataaaattaactgaggtttaagatctctgcttaggaggggtttggatgggataaaatttttagcccctgtcacatcgaatgtttagacaataattagaagtattgaacgtagactattgataaaacacattccataaccctggactaatttgtgagataaacctattgagcctaattaattcataattaacccatgtgatgctacaataaacatgtgctaattatggattaattaggcttaaaaaatatgtcacgcgaattagctcttatttatgtaatttgttttataaatagtctatgtttaatactctaaattagtatctaaatatccgatgtggctgggactaaagttaacacccctaactatactctagatatgtctctgtatgacagctgctaagctagaatattttgaggtttcctataaggtagtacgtatttatgttatgaaaaaattaatttgtgaaagatcaaaaccccaaagtatgcaggagacttgttctgaatattattctgccctctattattgtgtcggtcgggcacaattcgagtatatttggcaacttgcacatctacagttctacactgatcattctcccgagactgttgcaaaagatactgttccatgagctccccactgcagcacaacggcaaaacccctataatattgccgctacatttatcattgtatcccaaacttcttaaaataccgaacccaaccattgcttaaaagctcgtaccgtacttttatgtttacgagctaaagttctagcgcatgaaagtcgaagtatatactttagtcgatacaaagtcttctttttttgaagatctactgtgataatgaaaaagatttctacatatccgaccaaacattccctatgtcatacgtcaagaatgattgaaccacttagacatcaccacttgcaccttatttttctttcttttttttttagaaacagactaccgtcactctaaactctaaagtactatggttgattttcctaaaaccttgaatatagaaatggcccggatattgtaccctctaaatatgaaattaaaacaggtccaaataatctagtaagatgtatgcccaataaaccatgatgagcagtgagagagtcgacggcattgtcaaaccagggccggcgttatagtggtcgaccacttctttaagatatcaacgttagtcgtcattgaaatcgaagtgacgaagctcggcgaccgtccaacctgtccgtacggtggttttgccgctaatgacgaggatggtgatatatatacatcaaattagctaagtacattttgattagtgggacggtttgaaaaagaaaaagaacatacgctagcagttggtccggagatcgtcagtaggaaacagaaatgacgaagggagtgcttcggccaacaacagtttttgccatataaacaaatagtgacattatcattcattcatatcgtagaagtgcttacggaaaataactaattagggttcatcagaaccggtttctatatttctagggaataaacactaactatattttgaggacaactttttgtatgtacacgtttttatttttcttttccggacgaatgcactgaacctaccggagtgccggtgagcccagtataggccagggcacgtttgttcgggcgatccccaaaaccggcgcgaccaaggaaagcagagcgcactcacggccgggcaggagacatattggtccttgcggcgcgacaagttgaacgggcgccggccgatcagtgcgcaccgtcaccatgcatgcattgatgcatgtacaccagcgaggcaatgagatgggtccagaaaagtcaagtggagatcgcagcgatgggtggatataggagttcttccggcccctacatgatggagaaagcagagatgaggaagaagggacatgatcagagatgaacaggaacgacaggacaatcaaccaatcgttgggactggggtctcggggtccagtccagcaacagcaaaaaagagtaattggttccattgatgcaagtaattaagcatcatgtaatgcttgtgtactgactgaaatgagatctgtttaagcctcaagagttttcaactgaattttactggaagatatcaattagtttaagaaaaaaatacactggataaccaaaaaataatttggtatcaaataatcaacaagaaagcgtgtgcctgtttggtgttaaatctcatgcaacctcatggtatcagttggtacatctatagatattagcagttcgtagggctccgtttttctctgttttttcaatattttttttgctcttctctttaggcgacacatgtttttctagtatacaggactcctcgagtgggaatcggcaaaaatgtcctccagtttatttgtaattcacgtatcgcaaacatgctgttgtgtttcttacggaaaacccttcgtgtttcagacaagtacaacgctaagatgagaaaatttcgcttttaggggtagcgctgtaaacataaaaaatacgaatttttttttttcgaaaaacagccacatagatatgcttatccaaaccctatccggtcgcctcccacctcgcccacacttcgccggggctccacatctcctctcctcccacagtcggcggtcctgcctctccccatccggcggcctcgagcttgagctcctcttcctcttctctcctccgatggctggcggcctcacctctccccccatccggcggtcctctcctcggtggagcctcgaatcggacaacgtcgaccagatcgacacgacaaggaggttgaggcagatgtggatcgaggcggccttcgtcgggccaccactgcggacgggtcgaggtggccgtcgtcgagctgctactgcacaggttgacaacgacgatgagcgacggcttgtaaatacatagtacaatatgtacatgagcaatccaggaggcgactccaccaggtctgaaccaccttcctagctcaccaccttgccaccatcggcaacgtcacccacccacttccgatgcctgccctctcctctcctctcacattctttttctttctctctctgcctaatacagatatttttcttctatgaattcaattcatattttctcgatccataaacactgacggcaagagcgagccatcacagacgacactcttgctccatgtgggcatcggttggtgcctagagagctgatttgataggatgaggttggtcggtttgttttgaacgtggactaatcaacgtgaagcagggaagcctttagaggaggttggcttgttcggtttagtaggtggttatagaggtggtattggccggacacaatgtacggttttttcctaacaaactaagcactgtatgttttttttgcataatgtatggtttgatattttttttcttaaaatgttatatcttctttaatataataaattgccacaccctttttaaaaaacctgatatgtgtccataggacctagccatgtgaagtctacatttgacaaatcaaattgatcaggtctgggccaggtgtactatgcccaaaattctgtcatcatcaaatccaaaaagcaaggaacagtctcttatcgatctgtagttctctacttaatagagttgatcacttaggttaggtatatagaatagtaaccaccactaccattatagtattacactatagtactactacatcacaaaggcattagacattaattaggagtaagagcaaatcttgtggagaacctttttgtgactgtgtcgggtaaccggcatgaactcaacctgcggcgtgcacaggacacagtgtgatcagatcagataatcagattagcagcttagcttagcttagcttgcttacgtccacactactttactctccgttggaccaaatcactaaactttgtcgtaaactcgtactacctccgtgccataataagtgtagccataagtttccgcgtccaactttgatcgtccgtcttatttgaaacttttttataattagtatttttgttgttatgagatgataaaacatgaatagtactttactcgtgacttatgtttttaatttttttaaaaaaattttcaaataagacgaacggttaaagttagatgcggaaaaccatggctgcacttattttgagatgtaggaagtaaggcataccgcacaccacgtcctgggggtcaggcagtcagcctagtgaaaaagataactgtgcaagctagcttctcgctctcgcgcctataaattgggcgctcgccgccggcctcagagtgcacacacagacacacagacgcactcacacactcagcttaagcgagcgagcgagtgaacgagagagagagacagagatggcgagtgttgcctccttcccggtgatcaacatggagaacctggagaccgaggagaggggcgcagcaatggaggtcatccgcgacgcctgcgagaactggggcttcttcgaggtgcatatgcatgccaagcactagcatgtactaaccagcaaaaaaatgttaatatgattctagctaattcctaagtggccgcacaacttattgatatgtttcgatttttttttgttcatcgagccacctatacgtacatcgttctttctggccgaaaggatggaaacatattcttattctccatcttagtcagtcgacccaccaattcaatcttatcatctcagtaggctcgccggctagaacgcctactaattagctttgatttgtcatgcttgtcaaagtattaactttgcatgtcgaaattaacatgtgtgaatgcagatgctgaaccatggcatcgcgcacgagctgatggacgaggtggagcgggtgagcaaggcgcactacgccaactgccgggaggagaagttcaaggagttcgcgcggcggatgctggaggccggcgagaagggcgccgacgtgaagggcatcgactgggagagcaccttcttcgtccgccaccgccccgtctccaacctcgccgacctccccgacgtcgacgaccactacaggtatacttaccctgcatgcatgcgtcatcatcaatcatcattaacaaactcaatttagtctttgttaatttatctgcatgcttctgaaagaaaagcttaagttgcaaactcgcctaaatgatcgtcagtattttaatcggaagtagtacactcacaaagcaaaggcttacaaagtatcctagctactgtagagtgtaggcctgaccaaaacctcaacaaagttacacctgacacgacgcgctctactatagaaatgcccacttctgtaaacagctactgcaaccaaaggtgacaggattatcgaccaaaaggagatgcttacttttttactgcggcttatccacagcgtcgattactcttgaacggacgtagtggcgcatctctgcaccctttcctactatgagatagtaacaagtgtaggaatacaccattttttttctgttttcccccggagaggagtatacatcatacaacgtgcagtaactatcaatcaatcagaactcacactaactggattcgcttttggcaaatggcaagtgacttgtgaatattcgcgaggcctaacagaagcccatgtgtcgcgtttgtgtaggcaggtgatgaagcaatttgcgtcggagatcgagaagctctcggagagggtgctggacctgctgtgcgagaatctgggcctggagaagggttacctgaagaaggccttcgccgggtcgaacggcccaacgttcggcaccaaggtgagcagctacccgccgtgcccgcgccccgatctcgtcgacggcctccgcgcccacaccgacgccggtggcatcatcctgctgttccaggacgaccaggtgagcggcctccagctgctcaaggacggggagtgggtggacgtgccgcccatgcgccacgccatcgtcgccaacatcggcgaccagctggaggtgatcaccaacggcaggtacaagagcgtcatgcaccgcgtcctcacgcgccccgacggcaaccgcatgtccatcgcctccttctacaaccccggcgccgacgccgtcatcttcccggcgcccgcgctcgccgccgccgacgcggcggcggccgcctacccgaggttcgtgttcgaggactacatgaacctgtacgtgcgccacaagttcgaggccaaggagccacgcttcgaggccatgaagtccgccgccgaggtcgtccacgcggcgcccatcgccaccgcttgataaggatcagacttcactagctacggctgcgcgtgccatgatccagatatatgggatgtgtacggtagtgtacgtggtgctgtacatgccgtcccgtgtttttctgcgtaatgtttttacgtactagactactactagtgtgtgtacgtaacctggggatgtaagtatcgcgtcaagtactcaagtgtgtgtaacgggcgctctaatcgtattgttctgtgcttcaatggctaccacgttagatgggccttgtgctaatgttgttttatgctacttccgctgtcgccttagatgggccttgttgtataatgtctcgtcgacacatctgtgcttttctgggtgtgtttagttggggaaaatgaaattcttggctgtcacatcgaacgtttgatcgaatatcggaaggggtttttggacacgaatgaaaaaactaatttcagaactcacctggaaaccgcgagacgaattttttgagactaattaagccgtcattagcacatgtaggttacagtagcacttatggctaatcatgaactaattaggcttaaaagattcatctcgcgatttcccccataactgtgcaattaatttttctttttatctatactagcatgggggcccgcgcagattgtgcggctagcatcattatattttctctcatataatagcacatatgttttctcattatattattaaaatatattacaatgacaacataattttaaattttgcaataacttttcaaaactactaatgtgtaataactactctagtctcctcttctaatattccttattttttaattctgaatttcagctatttctagattgtatttttatatggactctgctttttcttgttctctgattaatgtgagaatttctaggccatgagagcgaacatggaggctcctttttattctgaattttagttggatttaaattccaatatgaactctatactctacttctaatattccttattttttaattccaaatttctattttttttcttaattgtatttctatatggactctatagtctacttctaatatttcttatttttaattctgaatttcggttattttctaattgtatttctatatggactccatactctacctctaatattccttatttttaattccgaatttcaattatttcctaattatatttttatatagactctagtctcctcttctaacattccttattttttaattccaaatttcaactatttcttaattgtatttctatatggactctagtctcctcttctaatatttcttattttttaattccaaattttaactatttcttaattgtatttctatatggactctagtctcctcttctaatatttcttattttttaattccgaatttcagctatttctaaattgtatttctatatggactctagtctcctcttctagtattccttattttttaattccgaatttcagctatttctaaattgtatttctatatgtactatgccttttccttttctccgattaatgtgagaatttctaggccacgagagcgaacgtggaggctcctttttctattcctttaattatataactagctgggtggcccgcgcaattgcgcggctagcacccacaaaattatctaatttttcacatgattctacttaaaatttattaaatatctatctcgttgttttatgactttcaaagatcgaacattatcatccccgggtttataattttataatttttaaaagtcacacctgttgctacccttactcctttgtaacccctttatttgttgcgcggctagcacccatccaggattatatatttttaagcatggttttatttaaatttgttaaatagccatctagccgatcttaaaagattgaatcttattatcatcgggttagtttttaaaagtcaataagtcgtcaccccttacttttttacctctcatttatttgattgcccgacctgtcataacttttattcatcctctttgaaactttcatatttagatcttatagttttttaattcattgtcttgtcgattgacatatttatatttttagaagttacatcaaatgtcatcattgtactgttctacaatccacccgatgtctcctcttagttgtcattggaatttaaaaagtcaaatatgatattatgattatcggtgtttttttttctttttagaagtccattcaaacgtcacgactgcgctccttgatggcttgcccgctgctgtttctcttaatcgtcattgagatttttaaaattgaatctaatcgtcatttatatttttattgttttaaaatgtcccatcaaccgctacaccctatttatttatttacggctcacccgttatccctccctctttattgttatttaccattgttgtgttacgggttgttcttttaatacttttttttttgttttgaacttttgttattcataaatcgtattctttcttaaacttttgtttttatttttctaatttcataatttttaaaaaaaattaattaatcacatgttgtgttgtagatggttttttcttttcatagtcttcattattattattatttcaaaattagttacttataaaacatctgaattgctggttgtatatttggtgattaaaaaggatcgaatagataaagaggcagtcgcttcatttttactggcaacaaatatatcacagtatgttctaaatagttttgaagtgattagactgaaaaaataatacttacatgtgcacacgtatatacacggctttctgcctacctagttcctgttttgctttttttttccactggaatcaaataggtttagataacagttttagaattggatctcgattattccatcgagcaaggcgctttgtacacctgtattagcactacaactctaattcctatatttatatataggtgttatatctcaaccgttaaattatgaacgttaaattatgaatccactataatctaaacgtttaatctgactgtcagtttatagcggcttgcactaactcatctcctgtgaaaaatatacactaattacaatatgttgatatcatttgtactttcataaacatcaaagaaacttttggtgtttgatgcattgccggctgcaagtattgatctgtttgttgtaatgtctatgtaaatatcatgtctttttactatggttggctcccgctatcattgggttctgccgctccagcccaatcgttgatgcttgaaatctacagaatatataggtgcagcagtgcaagctttgtttatttggcagcacaactcttctccgtataggtttgtaattgaattagattatacgtgtattgtgtacaccgccaaagaaatagaaaaggacaaagactcctagtatgtaacgtagtacagatctatagacttatcttttctactgtaaacagttaaaatctagaattaccaaaggttttaattaatctcgtattgggttcttatatggactcctatttcagtattgcttatttttaattccgaatttcagttattttttagtttgtatttctatttggactcttcttttctttttcttcgattaatgtaggaatttttagcttccacagcgaacgtggtggcttcttttcgagctgttttaataatataatagatagatttatgcttcatgcatgtgttcaaagatcgatgtgatgtttttggaaaaaaaattgataactaaacgggccctctttcggccgagcatgttaagctccgggcctcgctaaagacgatttgtaccgcctacgcgatgctacgagacaacgaaccaaaggtacaaaacgaatccaccacgggagtacgagtcacaaaaaactgtatcctctgcatgcatatcagcgtgtggccctccagccggcggggcacggattttcacggggaaccaccgatgaaaccncgatatttctnccgtctcctcctccattcggtggtccagctcaacctcgcctgcggcntccgcttggcagcttccctcacatgcgcgcgcacgcgggtcgcggggaaggcagccaggcgaggcagagatcggttttgtaccgaagggaggccacgtcccgcgaaggcgaagctccatgtgatccggactcccggaggccgcagccgtggccgtgcacgacatcacgacgcccacaaccccggccggtacgtcgcgtggttggctggttgccgaaaggcctcgagacaacgtgtgccgtggtcgggtggggagccggtggcaacgcgagccttttctagttagatcagcgtcgtacgtcgcaagtgcgtgtcaacgcgacattttagattagctggtcacaaacactagtggtgatctggtgattgtcgtgagaagttgggatcaacggcctgtcaactttgtgagtgggcctgatcaggaaatactactgtaaaaagggacgttactatgtggatctttccagagcagtttggcacgaaatttctccttgtaaaggagaagtacgcagaaatcccaacgacggatttcaaaccaacctactactaactgatttttaacaaactcacggacgttcacaaaagcgtagcctgaaagcgaaacaattgcaaagcacgagacgagacgagggcacaacgctatcatgggtttgaaactctaatgccggtcgaattggcttcaaagcaaagcaccatttccggtataaatccaccagacgatggaggaggaagagtcaaaccaggcaacaaggccctcgagacaagccatagtgggtcactcacatggccaaccaatggctagtacaaatcagtctataatagtagtgatttaggttaatcatatagtaatactccatactccagcgtagttacatggactaaacaaagatatcccccaccattagccaaagctgcaaaaagaaagaggtacagctactacagtaatctgtttctacgccgcagcaaacatgcagcaggagtcaagcagcgggcacagcaccacaggtaaagaaagggaggaaaactggaaaagaaaagcaaagattccaacatctctgcctcttttccctccttcctctgtccggcgttcgattttctttcataaatcctcgcatcccgagatggctgctgccgctgctcttcttcagtctttcgctactgttgcttcggttcagaccgtcgacgggagctcacacttgcccatctctgcaaacaatggaatagacaatcacccagtaagatcacggttcaaaaagaaagaatcatacaacagggtggtattacgcgattaaaaaactggtaaatcgctgctatcatgtgaacaagagaccaattgtagtgctggtccaaaggaggagacgcgtatactggcggtaaccgagggaataacaagtggaggaatactgtaaaaaaattgatgcaggtagtaggagtacgaactgcaaaaggtacacgacacgatagtggcaatcagtcacacgttgcgagcctgcgacatccagccacggcacgcatcaccatgaatgaagggagtaaagaatacaggacgagtcatatcacgtcgagctgcgagccacgctgaccccatctcatcgcagtcataattgcacttgtgcgggtttacaacttgctgagccactcattaactaccgcagtgcaatgcagaagaagcagaacacctacagctcgaatccaatgcaacgagacctcaaaaccgcagtgaagatttgttggtcacagagacacagtagcggctgcttgcagtcgcaattttgcaagttgcaaccgccggctgcgtctttccaaggtgtgtttaacccaggcaggaagccatgggtgtgaatcgtgtggcacatgccagtgtgtggctgcgaagactacagtgaagcgagaatcattcccgtacgatgccgatgcaaagcgcctttcatttgcacccgtactgtgacccacccatctgtgaatcaccatgtacaagtagtagtagttcctacgcaaacttttaccggaacacgatggcccaatccaggttgtgtaacgtgtactagcgtgtaccaagccctacacccgttcgtataacacgtacatttcgctacgaaacgcaaggaatcatgtagaagtagtacgaatgcaatgaggtaattgtacgagcaaacgagcgcgaagactactcacttggcgcttggttgacgacgtaggcggcgccggcgaagtcgcaggtgccaatggtgcggccctttcgctggtagtagtcgttgaaggcgtaggaggcgtgggcgaccatggtgttcggctcgaagcacgccgcgccgggctggatggccttgcagtccgcgccgcccggcccgcacgcgtagtccagcgccttctgcagccgctcctccccggccatggcgttcgccacgcaccacgcctcaccggtcgacgtcgccttcacgccgccgcctgcgccggccggcgcattgccggcgtttaccccgccgttgtcctgccagccgagcccgccgttgtccttgccgctgctgccgccgccgccagcggagttgccgccgaggacgaactcgacgtcgtagaccttctgctggttcgggtagaacacgccgtagttgcgctcggaggtcggtccgggcttctggttctcgttgaagagagcgaagaggtacacgtccatgtcggcgtcggggcggcgcggcgttccggcgttgccggagaggacgcggcgcaccaggttgccgttgtaggccgcggcgttggccgccgcggcgccggtctccttggcgtcacccttggacggccacccggtctccgacaccacgacgcgcacggcattgtagttcccaagcttgctcaccgcggtgaacacggcgtcgagctgggcgtcgaggaggctgtagtacttgaggccgctcccggagtcgagcacgccggcgttggggcggaacagcgcgtagtcgagggagatgacgtcggcattgccagagtacgcgaagaacgggtacgcgttcaccatgaggtacgagccggtctgcgcgaggaagtcgagcatgggcttcatgaccgcctgggcgaggtcctcccggaacacgccggccgacggcgggtacgagccggcgagcgcggtgagcgcgatgggggacgacaccttgacgggcttgtcaaggctgagcctcgccagcgcggcgtgcacgttggtcatcgccgggacgagctgcgccgtgaggttcttggccgaggcgaacacctcgttcccgacggcgatgccctggatctgcgtggccgggtagtacgctgcgacgttgcggcgcacccaggcgagcgcgtacgacgggcgcgacgccgcggcgagcagctgctcgttgggcagcgcgaccaccaccttgatgccggtgttggccagcgcccgcagcacggtcggctcggtgtcgtacagcttcacctgcgcgatgccctgctgcttcatcagctgcaccaccgccgccgggttgggcaggtcgttcgccaccctcccatagttgatccccaccgtgcccgcctctgtaaccaaaccaacccaacaatcaaccacactactctccactaaaccacctgcattgccaaatctctcgttacctgaagcggacaggaagagcagcggcaatgcgacggcgaggatgagggcgcggaggcgcccgggtagagccattttgctgctcttgctgctgctcactgctgcgcgggcgcgagaggcagcagagcaagacggcgacgagtcgtgtagtggagagcgtggtgagtggtggagagggggggaaaagggcggggatttatggttgggggaggtgaggcgctgtaaagtgggccagccgcacgcgagacgggttggttttgggtggggaggaaatggcggggatgttgggagatgcacgtcgcgctcgcgtcgggttcgtggcaaagtgggtggtgcgcccgtgcgaccgaggaagagcgaccggcgcgccgaatgaccgttgtctccgcctgcgcggcgggggcccaacgaacgtacggagcgcttgggctggctcggggttaagtggttagttgctggctaatcaatgtcgatgaatgagactgtacttgtagttaagcgtgacctaattgctctcatcccaacggctccaaacttgttcctttctcggacgatttaatttcctgagctgaaattgttggacgattttcctgagctgaaaatgaaccgaaatgtgggtgtggtagtttctggcatgtgggaccaaaatcattctgggctttgcaatatttatcggtgttcggtgaacatgctccacatagactgtggccctgtttagatgggactaaactttttaagtccctatcacatcggatgtttgaacactaattataaatattaaacgtagactattaataaaatccatccataatcttggactaattcacgagacgaatctattgagcctaattaatccatgattagtctatgtgatgctacagtaaacattctctaattatggattaattaaacataaaaaatttgtctcgcaaattagctttcatttattgaattagttttgtaagtaatttatatttaatactctaaattagtgtctaaatatatggactaaagttaagtccctggatccaaacaccacctgtgactacaataagttaaaaaaaacacctttttaatgaaaaaaaattctttattgactggactactggattgagtgttacaaaatgtaaacttcaacgacgtgatataccctacttttgttagcatgtaaaccgaaacaaaatggtgactgagcattaatcaaacgtgctatacgcgcgactgttttcagctacacttagaccaaataattgtcgataacaaacctgtacttttgtagccttgttcccctcaaatctctcatccaagtgactaggtggacgatgcatacacgcaagggaacgcttgtagcatgacgccgacagcgtgccccggtctctccagttttctgctttcgcaacatgcaattgcatggtcctctccttggaggacgtaacaaactctgccgacctgaattgcttggtcagtaaagtctctcggccacacaggcgatgaggcgagcaacgcatgactgcacacaaaggcagccaggtacactagctaccacaggatctttttggagcggatgaccagtgtccagtgcgagacagcactagtgtaccaactcatccgttgcatttgcacatttgcactgcagttgaacgctttagctcggtttggtactttggtgacgttggttcattaattagctgtaaccgtgtttgctgtgattagatgagctaggacagtcccaacccataacactagatatggtttttataaactccacattatcaagaaactaatactagacactactcttacaatgcaaacaccactatttcatactttaatttaatgctacttatctcacataatgtcttggatgttgtgtaggaaccatgtctcatgcaagacatgttttccttctcttttctcattttattcacttgccatattatttttttgtcctagatagcaacttatttaatgctatgaacaccattctagttattggggtggaaatgcccttattaattgattgattgatggctagatctgaaggtagccgaaatggttagaggtaaattatgcaagaaatggacaggaggacaggttagcctttttcaagcttcaccttcggttaattatgtttgaggtccggacaagaatacacatggggatcgagtggggaaaaaggcctggacgccttttaagccgctaataacaacggacagccgcgcatgctggttagagtaggtagagtcgagctagcgtgctcatgctcgagacgaagacatactgcaactactactactcgatggatggaagcagcatgtcctcgctaggtccaaactacagtgtttgccccagctcacattgcagcagaagacgagaagaccagtaataacagtagtcagtagatgtgctgcggcacagctattgttgagctcgacacgattaggaaaattcctcagggcgtgtactcacggtcttctccgtgatcgtcgtagatcggtcagtacatctgtcacgcatggtgtcgtcgattcgtcgttcttgctcgctcagctgttccacacttcacatgtagcgttctcccctagattagccagccagtttctggcaaacaaccaattcgatcgtgcaggcacagttgcagatgaagtggacgtggtgatgaacagaggagagcagatcgagcgagcgagcgatcaagtggtaaacggatagaaatccagcaggaaaacgcatcagggcccgcgcggcgagaaatgatgggggaagactggtggtaaaggggacgtacatcccagctgtgcaacggggggaaaagcggcctctgctgcgtccggcttgtcctccaccggggcgcgccatgtgcgccgtaacgcccgttgctccccggccgcggcgcgcggcgtccaccgctcgtctccacccgtctcactgcctcactctctcgtcggtggccacagtagtaaacacacaggcttgactcactggctgccaaagtgccaatgctcccgaatgtggcccaacagacagaggattaattaattatttgccactcttacggatggtgataaataatctgcccctagacccatatgtgatagacgcataagggcccacatgtcatagagacataaggacccatatatcatagacagcaagtgacaaataattaattgccacatcttaaacgtggcccaatgctaaatgtcctagagacataggcctggtttagttatcaaccttttctttaaactctttatttttccctcatatcaaaactttcctacacacataaactttcaactttttcatcacattgtttcaatttcaatcaaactttcaattttaacgtcaactgaacacacccagaaagacacaggatttttctgcttccgatacctgacataagagatcgtgccatcgcgataatgcaaaggagaggagaggcagtagtaggcctttggatctgcactagtaccattttcaggttagtttttttattttttgtcaagaattttcaggttagttgtgttcatgttccctactagcagcttcgttctcgcttcgaccatgtggcaagggtggcactgcaatcttctctcctataatagcagtagtagattccagaccggcagaagcttgcattcaaagcaggctgattaatctggttcagatagagaattatcgctcctgcgcatgcatgggatcctgcatcattgcacgaaggtttttatcattagcattaatatttttctctctgcctcttgagaaccactgagtggccattgctgcagacgagagtagcatggtgatctgatgaactcccacgctatgatcagtgtcagccatgtggatcttggagcatcatgcatccgagtcccagaggcatttctgtcggtgtggctggggaattcactcatcgcacgaaagattaggccgggaagggcagaatgatgaacatgcttggctaccctacgtcactggacgtcatccctggaccaccatgaaccggttcatgattggggcttggatttgtactgcacctgcagctcgggcagcagtagacagtagtgcggcgacaacagccaaaggccaagactgggaaaccacagagtgcgctcatgtgaaccaaacgtttattttcacactgattgcagtgagccagtgagctatagctcactcatggaccattcatatcacatactccctccgccctaaaaaaaaaagacaaaccctggttttcatgctcaacatttgaccgtccatcttatttaaaaaaattatgaaaaaaattaaaaagataagttacgcataaaatattaatcatgttttatcatctaacaacaataaaaatacgaactataaaaaatttcatataagacgaacagttaaatttagacacggaaacccagtgtttgtctttttttagacggagggagtaatctctgagctgcctactttagatcacggcgcttcaaaagagtcaatagattcagacggaagaggacatcaaatacatccgatatgatactattgatactgctgctgattcagtgcccaccttcagagttcagaacaatttcacggccacaaatggcagtaacgtttatttcacgttaaaactgaaagtttggttaaaattagaatgatgtaatggaaaagttagaagtttgtgtatatagaaaagttttaatgtaatggaaaagttggaatttagaagaaaaaatttggaactaaactcggccttagtattatccgtctcaggccaagtttagttccaaactatttcttcaaacttctaacttttccatcacatcaaaactttcctacatacataaacttttaacttttacgtcacatcgtttcaatttcaactaaatttctaattttggagtaaactaaacacacccccagtggtgacactggttctgcaatttgttttccttatcttctttttttgctccatttcaccgttcggctaggatggggaatcaagcctggatcttgcactattgcacacatggaccggttcaccaaccccacgtgccgttggtgacgcggcagggtgaattgcatgctactagtatgctacaccacctccatgtgcagcagcaggaaatgacaacggcgaagaatagatgagatctgatgaaagagaggtgaatataaaaaggtgaccctggctgaagaattcggttttaaaacgtcttgctacatcagattattctctcccttccaactgatgaggattgatctaagtttggaatgataaaactggaggacccaacaaacacatatgaggacccaccaaacgtatatatgctgaatttactgtgtagaggcccattagtattgactttcgattcctttgtgatgctggatgggaaaccgattatcaacgatgtttttaaaatgtgaaactgagtaccacacacagttaagacaaaagattggacaaccgtgttatggaaattgatgcttagctatttagctaatactcggatgtaattacaaaattgttgttcagaggaacatttcgggaggatatgcacaaacctactaggctgctatacaagccattagaatgaacaaacaacagattctgcgtatgtacaattgcggcgttttgtttcactacttgcccgctggtacagataggatacatgattaaagctatgtgatgaaacattcggtataaacctgtacatgactcttccaattccaagcaagttgttttgaaggtctgtccagtcgaccgggtatgcttctgtgttagtaaatgtttcctgttcacacttttttcagctcacgactggctatctctatttatcccgcgcataggctccctgaatgaggttgttacctggcaagtcaagttgccaggcccactgttatctcgtgtgagttttcctttgctacagaagtacatacaccagacatgtttatgtaaggagttgaaactataatatagacaagttagttgaaactataatatagaaaagttagttttgaactgttacttcatgttggactctctgtagaatatatgtggaatgcaaaagatgatataagcatgattttgataatccaagttacagcagttcgtgcagtgaaaagaaaagcagccatattcacagttatcaccacttgtgggttaaaatgcaatcatagtttcatacttgattctgtagacatttcgtagttcaacatagcttaacatctaggaaaaacaaccaagattgtaaagactactttgcacttttttagtgggaaaagcataggcacaaacagcaatgaagcataactcagattgtcataacagactgttatatgaactagtgatttcaattccaagggtcatttttacccctaaacttcatgaaaaaaaatcatgatagactgtaacttttttaaaaaagtaaggacttacaggatgattttgactagaatacctccgtgtgccttcacaagaggtggtatgctgtgcaccagttaaaacacgagataggcgtcggagaaatacttgaatgtggttgtaaatgctgcagcatgaagtagtagttaacacacagcacacatgaagtgataatgtaaactttgaaacactatataatcctgttatttattttgaaccactcgaccatgttactaaatcactaccagagtaccagtgaagttcacaacagaatgacatgttagatgaggcattaatcaggtaaaattctaattcgacagtcaatacgagatgttttctgtatatacctgatttcatatttaatgttcatgtgaccttgaaaatactaccacatacggatgagaaggaaggttacctaagccgatgcctgttgcatgttgaaaagaaggcaacaaaaccatacagaatgcttcgaatcgcacggaaaatctgaaaaagaaagtcaaagtaagttccatatatcctatttcctaatataattactggccgcatcaacatatttttgttacctggtacagaagatctttccatagtgacccccagatggtagtttcagatgcaagtccggtcgatccggatgcagaaccaacttgatataaggaactcaatgtagaccaggtctccctcagaactccaacaatgtccacaaaagagtctgccacaaaacttgctatcgcaacaacaagccggaaaggtgcagctagaatttctccaagaagccaaacgaaagggtacaggactgaatttgctgaagttaatacaaaagagaaagatatcagaatcaacacaaaaagtttatcatagtgaggtcaatacaaattgaagagcagagtagcagacatatcgtctcagaggttgcagaaaacataccaacattaagcacaacactgaagaccagccaaaaaggccatataatcatctgcattgtactgataactacactgcatgaagtctccatcgccaacatgataactgagctcagatgtcctactgtttcagcacaaaggttccatagcggcagggtaaattcaagaacctccaaaattggtcccatgattggctttgtcaaaacacttagagcagatttagtagcagttacaatcttaagagaccatgtaaaagcctgctggaagttatgtagaaaaagcatggttccaagatacttcagtcgtgaaatcatttcccacgtctctatccagtcaaagaaagggccaaacaatcttgatgcagttgccttcaacatggggacattcttgtagaggtcataaaatcctatgagaacagtaactattgacatcaagacatacaatgccctggcaagaggacacatccatgggcgatatgtcttgcagaacactggatatgactggagaaaaatgacccatgaaggaaggccatactctagcaatgttaacagcctcacatcagaaagtattacttcttttagtctgaaagggagatcgtggtcatcgaaccggaataagatcaacacatccttatatgtgctaggctcgagcagagtcttgccacaatcatcatcactgcagcacgaggaagatggagatgatgaatgtgttggtgaggtcacaacttcagaatatgattcttcagacatattatttccagcatcagatcttattatctttcttctcttgtaaggtccagagcaaggaggtggtgtgtatgaggagcttgtaaaacttgacgactctctcatgcattgactaggtccagaatcgtcatcatcactctgtacattctcactgtccccttcaggtgttgagaaataattctgagcgtcataaaacacatttcctgtacagcaagcatataagtggtctgcacatgcagcagagaagaatggagagcacattcatgcctttacctttaggagagatgctgttcaaataatcctgtaggagctggcattcagagtaatttccagaaaaccatgaagtgattaatgatgaagcttggttgacactctcaaattcccatctcttcattgttttagcttccactgccatagaagtatcagtctacaacaacataaaaacaaaataagcatgtaccatccattaatagctatgaatatcatgttcagtctaaaacaatacctgaagttcattgaaatagttcatgccgcgcacatcagcccagtctacctcaaaaattataaagccatataaggttcggtgcagttccttgttcagcaggcgagaatccttcagcctattcacatgaagctttttattccgcatggcatcatcaattaaggtataccatctggatgatggattccacaaatgagaaccatgtctaggatctttagagaatacaagtttcttcccagtttcatctccctttctcctagttctagtgtttgcaaaaggtgaaagtcttgactggagcaaaaaatgacaagaagtcaacaagtaagacgagccagaatcgatgtaacaagggcaatacatgaaagtgtaagcaatgaacaaatattcataagtactcgtttgtgtgcttacaagtggctcgtaaaacagtaaagcatacctttgtgaccatcaattgccacaggtgagcaggttttgtgtcctggtcttgcagccatggccggttatcaagcaatatgagaaacttcttcgtatgagggcacaaaaatatagtaagttcagcaagatatgattgtaaatccctgcatataataattatatcagactaactaactgtaatatagatgaaaatccaaatttacattgcactttaagatcatgaggttagtaaatgcaagcaaaactgtgaggagtaaaacaaaacttgcagtttgcaagaattcttaacacaattgcccacctcagaaattaagataattgcaatacaacttaaggtcatacgactttgcacaacaaatgcagtccaatggatgtacagaaaaaggataaaataaccgccacattgttcactgtttgatatcatatgatccaggtggacaatagcagatcaaaataaaattaatcaggaacacagtatttaacattttctttcctccagtgtacggacggagtcatgtattgcagcctactgaacctagaagtaaagtaaagccacaattccagatttccagtcgataaggtatgatgaatgtgcacaaaacacaaaattatcaacctacgataggcaactaaacctaggaataaaacctagattgttttgcaaacaacaacgtgatggtatagtaagtttgttttatcatctctgcatgaatatgtagggagaaatgacaaaccctgaattattgaaccgttccagtatagtatcgatcctgtgcctttacactggaaacatctactaccttaaattggaaagatttccaagaacagctttcctttctactcctactaactttagtcatatctctcatcaagatatacagtattctgtaacaaaataaatgctactagaatgaagcaatacaagacaattcagctacccactcccacaagtgagctttcctgtctttttctcataaacagtatgctggaacttcctccaccaagtaacacaaacgaataaacgactgttgtagttttgatcaatttccactgccctttgggaaacaagcgtaactaacttcaaccgtgttcatcgaagttatccagttaactttctcgtaacttctcgtttttttcacttatatcacaacgggactacattgcattgtggaccacacaaattagcacccaaattatacgagactggaacattccaccaaaagcaatgaaaagaacgtttccaccgcgagatcaaaacagagcccccgcacacagaaggagacttacccgatttgcaagctcgtaagggggaagaaatgccgcttcccgccgctatccatcacgccgactccaccacctccctgaaccacatacgcgaaaacacgcaaaaaattccacatcaaacgggagatcagaggccaccacaaaatccaggcaaaggcgcaagcaaaaatttgcagaggtatctcgtcgaatacctgcgcagaggtcagaggcatcccatggtgatgcctatccgcatgccaaggtggccagagttaatggccacccccggtggggtaaatacgccgcctacctccccctctccaccaccacgcggcgctcaatcaccaatggctcctcctcaaataccaccaccacgagcctccccccccccccaccctgcctcgcgctgctccggcgagaggcgcggctagctctccgccgctccgccgccggtgacgcggcgtggtggtggaggcggcgaccggatcgcggcggggccccgcgccacaagccaaccaaccatccgaacggccggtacgggggctttgcttccgaggtgagatgagacggttcggatatttatatcccgatgacatgtggagcccgagcacgagcagggcccacctgtcagcgtgcccggatttgttctccggaggcgggtgcggtcggcgtgggggtgacgttgatggcgcggactttcacgaaacccggggggtggctgacaggtgggcccggagattgtgtgctcccacaagccagcgtgccgcgtcatccgcttcgggcatttctggtttccccgcgtcgaagcaaaggggagacaaatactacgtgccggcctacccgacgccactggtatgcaagtgacgtgtggggcccactaagattggacccatatgtcggtgagatctgcagcatccgacgtggagtaaggcgagtgacccatatacgtaattatcgaaatccagagtggggcactcaggggatcaactgcggctgttcggtcacgcggcgatggtgtgcgaccgatgatatggtgacacgtggaccgtgctgcaatgatggcgtttactgcagcgatgacgtgtggtgtttcgtgttcggacaggtgcacggagggctctaggttctaggcgccacatgcaaaggaggaacggcgtccgcgtgacgcctcgagcaccgtgtaacgggtttattgcatgtgaaattattggcctgtacgcccagattgatcatagataaatcaatgatcgtggcctcctggagaaaacaagctggagctactccgttcagacaagatccaaggaactaaccgtggaaacatgaacggtctaattaaaagtactcccttattctagcatttctctcatattgatgttaataaatttaaacatatatatctatctaaattaattaacattattatgaatgtgaaaaatgttagaatcacttacattgtgaaacggatgaagtagtttagagcaagtttaatagtatagttcactattaactccaattcatctataatcaatctaatagccaattcatataatagttgctttctatactattaatatatggtcccacatgtcatatatacattgtgtcttggagtccgtgctgtagctggctacacatctgtagcccgctgctcttctctctcatcgtttatctcattaaaatatgtttatagctggctaatatccagctattgtacctgctcttatgggaaaaatataattttgtatgaaccaaatctaaaaaacagaccatgataaaaagaaaaggatttgatttatctcctcgattatcataaaagtattatctatccccttaaactagagtatcggaaatttgacaatccccgagctattaaatcaacacgaaccaaaaccgtaccccttcccatgcgtaaaaaaaagtggtagttttaatattacgttgcaaacatatgacatcgatttcattacatggcaacctaatcacgcattttattagttttcttaccctcttatctatctttcttactcgctcgatcaaatatagggccgtcgctgtctacgacctccttccctgttgtcctctttctgtttcctgccaccaccttggtctttccacttacttttttcgatcaatgaaagaaaggtaattcgagcgacgagagggccaaaagggagaaagggaaaacctcctaatgttgtttgaaggaggggagcaacaaagaacaacacgaccttgtggaggaccacgttccgagctggctaggagggaatgaaggggaagcccatctaccatttatggggatgggagtgacagaggatgcatagtggcgcaaattagtggaggacggtggcggacatgcttgtctaggaggggatgaaagggaagttcgttggtgctattttaaaggaggggagggcgagtgagaggatgactcgtaagctcatgaaggatggtggcgggcaagctcatatgggaggacaccgacagctcaagctcaaggagatcaaatcgtgtccgctcacctatgcatcaagtatgtcaaccttctcattcaccgaatcaagtgcttcaatgccaacctcaccatcccatccataagacacatcccctccatcattgtacggggacccaatgaggtgaaacttgagcgggtggtatagatctagagggcaaaacattgaaccgtcctcacaccacaacttcacatgctattatcaaggtccctccatggcttcacgctaccaaggagggaggctggagcgttgagaactagggcattgcctaggaaagtaggttggggcgtcgagaactaggacatcaccaaggaggggttggtgcgtcatggaagaaaaagaataacgagataggctggtaggtaggcataatgagctgatatttttgttgccatgattcatccagatttaatagttcggggtttaaaatatttaagagggtaaatcatacttgtaggggtaaacaaaaaggccctaaaatcaacaatgaaatcaagctttaacattctatgaaatttggcaataattgatatattaatgcttataattcatcaacccattaatacattgacttgtctggttgtagtatgtaaattgaactacatatttcatattttcgttccgtattggaccttagggtggtcatgatcgatctaccaacgttgccgtgataaaattatctatcaaccaattaatgtattgggtctttttgtcaactcaccatattgtagttcatataataacaactatatatataaattgctcaccgggtgtattgacgtgttgtgcaccagatagctgactagctgtgcgcctgcttccgttgtttgttcgaaaggcatatccggcgtgccgcttgcgacagcatcttccatctccacatcggcaacgaccagacgatgggtttgctttggaatcgccatcgcgttgcagcatgcaggccacatgggccaaggctcgaagcccaatcacatcttttcgttctttactttccgagaaggcccaaaataattttagcccgttgcggtctttactctttacgcatctgttctcgtgcgatcgtgcccaatccctcgatcctgtccacccagaatatgtctatttgacttctctaagctcttgctcgtgattaaatagcctccctcaacctaaaactgcatataacatctccctcatttttaaaactagtgtaaatcgacttattcaatggtttggaaaacgatttctgccgatgtggctggttgaccccagggctctgcagttgcgtcgccaccaacggggcgtgtaacatcgattacttatggtctccttggcgggatatgtgctgccgacctcaggagatagatggaaaggagaggagagaggaaaataaagagaggagagtggctgataggtgggtttaaccagctgattcagcgagtcaactataattaacatatcacgtctacaggaaccacttcctaaatcatcgaaagagtttgatttgtatcggtttttcaagatggggaagacattatattcagttttgctgttgagaggcgattcaatcaagaagagagataaagagagtcataatagacttattcctcccccgttttgcgcaccgacttcggcccggcccaacccagccagcacctctgccctcctcgagcctacggctacgaggcggttgctcgccgccccaataaataccccccgcctccccttccgagttccgagcaatcgatcgaaacgcttccccctcattctcgcacagcatcacacacgcggagtccgcgcagggagaccacgcgcgactaggcgctcgactctcggcggttgctccgcggcatcgcgcacccacgccgccacgactcgcgagagtagggtgcggaaccctagcctccgcaatgtcgcgcggcagccgcgaggaggaggatgaagaggaggtgtacgactcggaggaagaggaggaggaggagggggaggtggagcaaagggccggaaaccggtcacgcggggccgccgacgacggaaagtggtccggcgtagagagcttcatcgacgacgcggccagtgaggatgagtatgagaagaaggaggaggatgacgacgaggactacgtgggtggcggcggcgcccgtgcccgcaagaggaagagggcgtccatcctgatcgacgatatggctcaggtcgacgatgaagaggaggaggaggaggatggcgagttcgaggacggtgagtgcttcctggtggtctcactggtgtttgaactgtgaatccgtgatagaatcgttagattgatttcccaaatccgaaattacgaagcacagcgaaatcagcaatttcgtttcggtttctgctagctgagtcattggacgtagaatttgtgtttgttaattaagcgctaagttgagcgaaccaacaatttcaatgctagttccttcccggttaccctggataatcaactctgttcgaaatggtccaggtgtagattcattaaatttggtggtcaatttcgtattgattccatgttgttgcagttctatggttgtttgtggtggtttagtctcatctaatggcaataagaatcgagatttctgtttagcgatatgtgaaaacttcagttggaggcaaaagtttatattcattccgggatttttgtcataaattgggcagatttgctaggacaaaagtagttccgtcaaactaactcgacaccaattaggccttcaccaaccaagaagttaactgggcgagtgggcgtagttcattcaatcatctctatttaaagccacgttgccttgaatggcaggactctgcgacatgccaatatgatggactgaatttgctgctactacctattatcaatgttcaaagttgtctgaatacgctgatggcctgatggctgttctatgttattgtgatagatctgttaaaaaatcttcgtttcaaatgtgaaacctaattggaagatgctcctactctttgtttcgaatgcggcacagggaagatgctccaattaattcataaactaactaagctgtttacttgtgctgactactaacatgtgttaccttccttttggtattatcagattcacattgtcaaaatatatcttgtgttgaattatataatatccaaaagcaagttcaagtgttttaatgctgtcagctatggtccttcatgttttggtaggctttattgatgatactcgagctgacgaccctgaccaagatgtgggaagaagctctagacggcatccatcttctatgctggatgaagaggaggacgtggatgcacttgtgaagctaatacacgacaggtatataattccgtcatcacattttgtggatgatgacgatggtgtgactgaggttgaacagcaagctcttctgccatcggtgaaggatccaaagctttggatggtgaaatgtgcggtatgttgcaggttctatcgaataatgttctgctccacaatttgttttctgtataatttgatgctcactgatatccaattatgattttcagattgggcatgaacgggagacagccatttgtttgatgcagaagtccattgatacgccagatctccagattaaatctgttcttgcattagatcacctgaagaattacatttatgtggaagcatataaagaagcccatgtcaaagaggtacggtgcttgacctgacattgtaatattcctgctatgtgatgggaactaaaatttattacaggcttgcaaaggtgtgcgcaatatcttcgcttcaagaaaagtaactctggtgcctataagagaggtggctgatgtactctctgttcagagcaagtctactgatatttcaattaacacatgggtccgaatgaagcttggtgcatataaaggggatcttgccaaggtatggccatcaccacggcagtacagtttcttcatgctaacattttctgctactatttgattttatgacctccatcaggttgttgacgttgatgatgtgcatcaaaaggttactgtgaaactcattccaagaatagatttacaagccttggcaaacaaatttgtaagttgttacttggtataaattgccacgttttatgttcacctttcagcctaacatgccctgttatatttgtggtgatgcatctgctgttaatacattacctttttaggttgttgctgccatcatttggtatgatgttaggatttcctatctgatgtgattcactgaatgccagatgtattaatttatagtggaacaagtgaccatttgagtaaattgaaaattaaaaatctgtacgtagtccgtggtcatctgcatgctattatcctttgccagtgccgatgggctagcatgatcagtatttcccattttcaggatggacttaaggttgtgaaggagaagaaatcatttgttccaccaccaaagttatttagcgccaatgaggcaaggtgctttttcctccgtttgtaatcagtatgtattcatatatatttgtattgctgcaatctgctaactcgattgtaaataaggagatgaacattcgtgttgaccggaggaggaatagagactctggggaatactatgaaatggttgatggtttaaaattcaaagatggtttcttgcacaaaacgttttcaataaagtcaataagcgcacacaatattcagccatcatttgatgaactggagaaattcagggaacctgataatgacataaatgaggatgcggccagcttgtccaccctatttacaaataggaaaaaagggcacttcatgaaaggtgattctgttattgttattaaaggtgatcttaagaacttagagggctatgttgagaaagcagaggatgccactgttcatatccgatcaaaattacctggtcttctggtaattacttgcaaaaggaattttcatgtcattttcaatgtagccattacgaatttatacatctctttgtgtacctgcagaacacacttgtcttcaatgagggggatctctgcaaatgtttcaatcctggagaccatgtaaaagtggtgtctggtgttcaagaaggtgcaacgggcttggtagttaaagttgaaggccatgttttgatcattttgtcggacacaactaaagagcatgtgagggaattttcgtggacataagtataagaaactatttggataaacttccattatgcttttgactttctgatgtgtttatatgattacagatccgtgtgttcgctgatcatgttgtggagagttctgaggtaaccactgggcttaccagaattggtgattatgaattgcatgatcttgtacttcttgggtaagctcagaatttctaatgagccattgttgttgcttacaacattgaacggctatgtaataacaatgttcctcccattcaattttcagaaacttatcttttggtgttattataaaggtggaaaaagaagcacttcaggcaagaaaatttgtatagaacatttcacgtatgcctaatgatcttttgttcccatattttttgtgtactaacccccaaaatgcatttagattctcaagggagagcctgacaaacctgaactagttcttgtgaaactcagagaaataaaaagcaagatttatcggcgaacatctgcaaaagatcggtccagtaatatcgtgtcaacaaaggatgtcgttagggtcattgaaggagcttgtaaagtgtgtacagtttattttatttgtttttagcttttcatattatattctgttttagttttttttctgtcagaatatatgtttattacattatcccattatactatatgtctaatacactttgtcacaacagggaaagcaagggtctgtggaacatatacacagaggagtactttttatttatgatcgtcaccaccttgaacattcaggctttatctgtgcaagcgcacaatcatgcctccttgttgggggatcaactggtagccgccgcggaaatgtatgtttgaagctatttacctctgttggttgtcttggaagattttcctaaccattttgcttctctgatacagggtatgggtacagttgatccacgatttggtgcttttagatcttcagcaaggattttgcaatctccaggaaggctcccccctaaagcacctcatactaattgtatgaatattatctgcacagctccttgttttttttttatttaggctgcattgctctgctaaatgcaatagcaataccaattcataattgtccttcctatctaatgcagatggcagacggtttggaggcagagatcatggtggcaaagggcatgataccctggtgaatagatgtatcaagattaaatctggcccctacaaaggatatcgtggtcgtgttaaagaaatgacgggagcacttgtacgcgtggagcttgattcacttatgaaggttgttgcaggtgaatctttgttgtcatttgttctatttttggtgggaactttgcgcgcatttgtattaagaagggaagcaaaaaccaataaaaggagatcaacgagtacacctcttcatgcagcaatcgctgcggacacactacaactttcattcctgagctgcattccttccaaatccccactatttcttctgatttttaaaactatcttgcttcaaatatgtagttaagagagaagatattgctgacacagctactgttgcaactccattcgggtaaatttcttcctccttgtccgtatatttggaaagctgtttgatttcatttaatgactacttgtatcgacagtgaatctcataattcatggggcaacgaaacacctgtgcacccatctagaacgccactgcgtccttttcagactccattgcgggaccctggaggtgtgtccatcttacatgcattatggttattataaaaattaagacagctaagatcacttatttgttccttccgtttacaaatatgtagttttggacataaccgaagcaactttgactgctaaatatcagaatatgtttactaagaagtaacaaaaatgttgtattatgatcccaatgtagctattttgggtcctaagagactgggaggtttatctataatgtcataaatgtaaagtggagagaagtactaattccatggcactactttgtagttttgttttctttatgtcatctactcaatatgtaaaaaattaatgcggatagactttgctacttagtacttgagtactcagatggtgatggaagatttatatggaggctagtgcatctgtactgtttagcagcataatcaatggctatcatttctctactgtttaatcaacttaaactatatgagtagtcacctctttgtatcttgattggtgttgttttttggagggagcctttcctctcctgaatgcttatcaggaagcacttcgaaatgggtgtgatagatgtaattcagatgaacgatgtaaaatttgactggcgttgtgtcgttggccaaacgaaaatattatgcagttcatgctataaatggtatttactttctctctctctcttgcacacacacatattaacaaggtgttcgtcttttacagcaacaccagttcctaatggaatgcgaactcctatgcctagtcgagcatgggcaccaatgagtccaccaaggtttgtatgctgacattatgtgcaatttagttttataatgaaaatgaattatgttgtgcaagcgagctaattctagtataagtttattttatatagatttgttgttgactaattcaattattacaggaatggctgggaagatgctgtcacttgggaaagcagcccaacttaccaagttcgtcatgcacttatgctatttcttgactgctctttattttctgtagattagctttgggttggcaatcaatggtaagtttttgagcctctacatttcacttttgcagccaggaactccagttccccagccacacgaagcccccacccctgggtcaggatgggctgttacacctggagttagtttcggtgatgcctccggaaaaaatccaagctcatatgcaactccaacacctagtgggcaaccaatgaccccaaatcctgcatcatatctcccgagcacacctggtggtcagcccatgactctgggttatattgaaatggatataatgtctcctgccataggtaatatttttatccttcgaattcgttgcttctccagcaaaatgcattctacagtcaatctggatggtgatcgaaactatctagagctctggatgcacttatttgggtactaattcccaaactgctttcaggtgaggagggcggtaggaactggcttttaccagatgttttggtcaatgtgctcagggaaggttatgataccacctgcggtgtggttaagaaagtcctcccggtgcgtactatttttacatctacaagatgacccccctaattcttctttcactttcctacactgacacatccttgaatttaaactctaggatggatcttgccgcgtcgcacttgggtcgtcaggcagcggggatgaaataactgcttttccaaacgagtttgaggttgtcaagcctaagaagaacgacaagctaaagataatgtctgggtcttggcgtggactcacggggaaattgctgggagtcgacggatctgatggcattgtgaaggtggatggtctagagacgacggatcagacgaaaattctagacacggcgattttgggcaagctagcagcctgaggcaggccgatcctacaagccagacaaattcttgttcatatcttagtgtagcgagtagtcagaggtgtacatgtattttaaggtgtcctatttgtccctggatattcataccaggatacgctctcgtctcaaatgacaaatgatactgaacaagttgcgaatgccagctgcatcgttgacaattgatgttgtctgcccttggccatcaggtcgtcgatacatagattgctgtaccagtcattactctagaaagaaacggaagaactttttgcaaagagatttcacataaattgagaagatgacatcaagactcaatagcgaccaaacaaaagtacaataggctgtattttataatactaagtatccaagtcattaccgagagatgcaacactaatttatgctttcagaaaatctactacacggtgtcctgtcacaacgggataaactggataagatctctgccttatctccttcccttcccctccacaaactcactcactctctctctctggataaggccgagaaggctgagaagaagccagccagaaggaagggatcgtcgtcgtcgtcttcggcggccgaggaggacgacgacggcacggcgtcggtgaggtcagggggcgtcgggggtgatctcgccgcacttcctcgacgccgtcctccgcccgctgcggcgccgcctccgcgcgcacgctccccgtcactgccggcgccggggctgctgccctcctccctcgcgctcctcgccaaggtctccatcgcctgcttctcatgagccacttgtgccgccgtccttgcccgctgctcctgccgcctccttgccggtgagcgcaggtggatcctccgctgccactgtagaagcagaagaagccggcggtcccggtgcctcggctgccgcaacgccggcgacaacctgctctagaacctctacctcctcttctttgccatcaacttgaagatgaagttgctgcagcgcgtgttcttggagatggtcaccgttgacttccggccggacctcaccaccttcagcgtttgcgccacagccttctccatcaggcatcagtcgtcgtgatacctcagtattaggcctggtatccacaagtatcaggcctggtacaagattacttagtgtcaagcgctcttcgtcgatgtcgacgctatcctcctctcatcagtgttatgtgcaggtacggactgatacctaggtatcaagcttggtaccaagtactaggggtatggtacctcaagggtatcatgcctggtacctaagtaccatccagtatccatgggtaccatgtgcatggtattaggtaccagatacctataattatcaggtaccacatggtacctgatacctattgtacctgatacctcgagggtatcatgcatggtacctaggtaccatccatgggtatctgttaacagtgaaatttggtaagcccagagtagtcatcggcttagagtcagcatcggcttcgaagtcctgagattagccgatgagagttgtcaagtcgtcagttgtcggattcttgctatattcggttaaggaaattgatctactaaaggaagcttatccaaaagagaccgagttcaaagagaatgcggcatggcaagttatctattaattaggaatagtttgttagtttccttttatctttaggaaagtgtgtttagtgtcctataaggactttatcttttccttttatctttaggaaagtttctttcttgtccgacaaggacttgtatcaacccatgggtataaatatgtacacctggggtctatgtaatctatcttcacgatcaatacaattcggcgcatcgccaccctttttacttctacttttgttttacgttccggcggaacttggcacccggcgcggggctacatcgtcttcgatctccggcgaagggataagtctaatgttccgccggtccaggcaattgtatcgtctacgtcggcgtcgttcaaggctgcatcagtacattcgacctcttggattgctctggtttggatgatatatttgcctacctatttatcatatgtctctgttaatctagtcttagcatatcaatttagctctatcggctgcttctcgttttagggtttctgccggtatcggctaaatcgcgttgctagattagattagcttagacatctaccaccctgaaaactcggtcaacagcttgattgtctagatattatgtttcttttcatacttagtgttacatcagttaagtttgatctactaagtcgtgcttagaaccataatctctagcctgcttttgattgccactaagggtttcatcggggtttcagccggtgagttatctggacgttgcatcggctcataaggattgcatatacatataagttggatttagccgatgacaacaaaggtttcactgtttaatctaatcttgtggatttcatgacatcggacctccagttgatgtgtgctttaaccttcggatcgatgcttatttatcatatcattatctgccgattggtttatactggactatattattgttatattttattatcaacagccgattgcctttatatcatcatctacattggacatatagccgattgcttacaccctatcgctatcggctagtatcggcatcggctattatcggctatcggctggaactattccatcggcttgtcagccgattgactgttttgatctattatttgcatatcttgtcagttgcaggatcaaactgactggcacgctcgcatctaatcaagatttggacctgcacaggagctaagcaaatctctcagccgatgtgttcgattttctcgtcaacagtaccatatgcatggtatcaggtaccagatgcctagtacctaggtaccatccatgggtaccatgtgcatggtatcaggtactagatacctatagttatcaagtaccacctggcacctgatacctattgtacctggtaccacggtcaaaggtgggggaagggggagcacgccgtcgccgcctggctgaccggtggccacacgttcgttgcctcctcttctgttctcccttcctcagttcctctcctcaacgtttctcttctccttctgttgttgttgctgtcggtgggggcaaagaggaggatttagcgggggagttgtctgctgctcccgctgcttaggggcgacgacgccgacgaggaggtgtgtgcttctccaggtgcaaaggcaacacgacgccggcaagggaagcgcgcgatatcaggaagagccagctaggtatcgtgcctcttcacgtggacaacagggacacgggacgccatttttttattttgtcgtgtgttttaattatcccgtgacatcacttttccacggtatcttgtgggctagctgccctcttatgctttactccttccgtttcaaattctaggtggagtagtagtacttagtccaaagaaacgaacagaactgtttgaccactgggcacttctcagctcgacgtgatgggactagttcatcaaggactcgaactcgttatatccacagttaaatccgccggacttgcacggaattgactgtgccttcgggtcaataatcttgatcgcctacagtgtaatccgacaatatctatcctatactattgtccaggttggaaaagcagcagcagccgctagcttggtgtgtcaagccggctgtcaacaggcaagctcgagcgagctcgcctgtctaggcttgagctcgatacaagctcgagccgagtctataaaatgttcgacctttcaaacaagctcgatttaagcttgagcttgatttttaattagaacaatatatattttaaaggataatctttttaaaaataattaatttatgatctatcgtagaagaggaaaaagaataaaataaatatatgatgccaatacaaggtatataaataacatatttgatctacaaatttattaaataacaataaaaaaaatctagaagctcaagctcggctcgacaaagctcgcgaactttaaaataggctttagctcggttcgttaggagctcgagccgagctcgaatcgaacttaggacgagtcaagctcgagcagctcatgagccttgagcttttttttttttttttttacagtcctacgtcaatcccgtgccatgattcccatgaacagcgccaggtacccgacgagccaaatcacaagcgccaggaacaggcgcggcaatgacgacaccggctcggcgtacacgccaatgatggccgtcgctccaagcagcatgaactggaacgcgtagacccgctgcatcggcggcctgcggcgggcgcgttccgtccttggtcctggcgcctccttggcgacaccgccggcgtcgttcggagccatgggattaggacggatcaatgcaccacgagtccacgacggccgacgccgccgtgggatgtgtgagtaatctgagtgagcgccgcgagacgaggtgttttctttccgaatatggcttctgttctgggcacgaactctgattaccttatttatagctgtcggccggtatggcagttcgggtgtgtgtgcccgtacatttcgtgcgatggatattggctgctgtttgtctgcatcctagcccttgggcacctgcacctgcagcttcggcgcagcttccttcgcgggatcacggcgtccgcccgttgctttcacgagcgaacaggtgacagtgacctgacctggctggcttcaatccgaggtgtctccacgtctgtacatgcacacatggcgcatgagcattcgtcacctgctcatgatttctcgcggcaaaaaacatgggggtggcttcagtcaagatgcagggtcattagaacaggtcgtgaccggctaatcattctgaaacttgttaccattagtcggtggcgccgaaatttccctgtaatctcgttcatttctcgttcgctggtttcggcctaacaagacaaaccagcggttggtggagcccaagggtttgggaattctgctgtacgtcactcgagaacaaatattcattgccgacccatttaaacgactcaaatttgagtattcttacagattagacagaaacaaataaagatagtgttattttttatctgcctgttcctattctagaactttgacccttgtatgaatagccgtactttatttagttttatcataagaaaacaaaatgctaccagcccatcaattaaaatatatgtttggcttctttggagcgaaggaaaagtggaggaattttggaggactaaaattcaacagaaaaatttcccacatggtcctttggagaattggagtaaatgaatggcttctccgaaatcatttgattatttcatatgaattttggagaaaaactctttgaattatagaaatgaaaaaaatggaggaataggaaaaatacttgattcagataataatacaagtataaaacatagaattgcaaaacatagaatgatcatttgattggaccatatagatttgagaaaagataaagatacaaatgaaactttccatgagattctactcatgttaattttcgtccaaaacttgcatggaatgagacattcttcatataattctatagaaatgaaatccttcaaaattgatatgattttcctttgaattaagggggcctaagtccacttgcttttctataatgttaccagacaacacttttttgcaaaaacctcgtggatttagtccctttgagttcctctgaatttaggattatggcacggcatcctaatcctgagattttcatgcatctcagggtttacattaccggttgaccactaaatttcgagccccatcggtatcacggttttcgataaatttcgatcggttatcgataaatttcgactgaattttgaccaaatctactgtttaaccttcgaaatttcaatcaaaacttaattccgagtcatgtcgaaacgtcgaaatatcatggaattcgacatgtttttgtcgaaaatgtgaaccctattctcaagttctcaaccaatctagaatcggcccaacccacctaaaacaatccctctccgagttgggccaaaagttagcaaacccatctgtagagcacggcgcccctttcttccccagggatctccccctccatccggcggccgggcgacggtgcgagagagtagagagagacccgagcgagagtccgacacggggccagcaagcgctgggataatggcgacggcggagaaaaagaggcctcggagcaaaagcggcggcggcggcggcggcggcgtggagaagaggccgagcaggaagcaggtctttatatttctctcctctcctcttgttgatggggccagtatcgatagctcgttcgtttcaccctacccgtagtcgattactcatggctgatacgatttgttttatattccgcgaaaccgaatagctgataagattttgtgtatttttttagtagatggtgtttggcacttggttatgtcagagttcaattagcgcgcacttcaaaccctacaagtgtgtcgaattcctttattttcataaactgcgaaagctgcagtgtcaactttattagactcatgtgttcttctgttgaatacgtatgttgcaacctctagatttttgtcaaaagttctttttttaaacttatttggtgggtggtttgtcactcctgtcaccgaggtagcatttgaggagtaatagcggagatgtatctaatatcagggtctcattcagataatcttctgcctttgcctagatattggggagaaagaaggctgttgaagaacttatcaggaaagctgtagccgtgaaggatcatctagcgcaatttcctgattttcataagtatcagagaaatggtaacctacattgtctgttggtgaacaaaattcactaccttaggactagtaatgttccatcatgatgtagaaactattaatattcccagcgaaaggaaaaaaaactcctaatgtcaaatttacctctataattccaacactaggccctaacaagtcctattcagtacaatgcaattttcttatatgtgtgttgtgggcattatatcaatctcaccttttttatgcttaggtcttttggtctacttggagtctggacatggaaatcaacttccattatcaacaaggaagtacatccaaaatcttctcaaggtcacatatatttctctttcattttgctcttagtgctgctggatattttgcatatcttccttttacagtttccccataaatattgaatgtaatgctagaaagcaataatataggttaacatggagggacaatatgggccagaatggccttcagaagagaaaattaagcgccgggaaatggttgccccagaagcacgatatatctttgtccggcaatcttcaaatgccattaccacccaaaatattatgaagcaagattccgggctagaatttacacatgaagcatgtaatgaagatcgcttgattggttttgtacactacagatttgttttggaagaagatgttcctgttgtttatgtctatgagttacagatggtgccttctgcacaggggaaggggctgggaaaatttctaatggaattgattgaacttatagcttgtaaggtaatgtgacttgtttaacaattactgatggtttactaaaatgacctgctcaattttgtgtgtacatatttccagaaatattatgcgtacttatattcttctatgatacctcttattccttcatctgtcttatcatgtacattttttagcataaaattgctatctgaaatctcagcatgaaggatcagctgattttgatggcgtgtacatgcagagccaaatgggagcagtgatgctaactgttcagaaagctaacaaccttgctatggctttctacaagaagttgaggtgaagtgctaggcttgaatatttcctccacagtttatttatgctaaatttataccttatcgttggtttgttaatattgcagtgactgctggttgaaacatttcaatgtaactcttatcctgcagatatgtaatatccagtacttcgccatcacgagtagatccactggtattgttttgcctataaactatagtttttattgattaagatgttcatatcgtgatccttccagtgtctacagattgggcttgaaaaaaactatgagattttgtgcaaggcatgtgaatctgaagctaagtccaaattagaggtatgcagcatgttgttcagtgttgcataaatttactgctaccttcttgcaacttctaagatggttgagtctgatgaatagaaaaaatattcgccagacaggcatattaatcattcactaaattctttatgagttggctgtgttgatcctttttcttagtaacaaatcttctttgtttagtattggctatatgccaattactcactaatgcataatgtggtgaatttgcattaatatgatgtaaaacaagtccttgatatgtatttttgttaatatttgcaggaaggcaactgaaaactccctgcgcaatgaccaatcttgttaaaatgtgatgtgatgatggatgttgttctccactacagttttgacaccttacagggtacagcactacagctcatgcttgagcggccgcatatcgtcaggacaccatgttatcgcaatgcattcagatgtattgcacatttgcactgttcttgtctgaatgaagctgatcctgctaatccatcctgggaaacaaacacgattggctggcccatattctttccttgcaaaacgcaaatgtacatctgcacgatggagagcatatgaaggttgcatgtcgtaggcttgagacgacagtaatgcaactttttgcaaactatggatggagattcacaaatagacttgaataaatgtatactccttatcttggtttggtcttttattttgttggtgtgtttaatttcattttgaactacgatactttgtaataattggctgtagctctgatgagcaaaggctggaatgtttcattccattatctaaaaaaacatctgcacgtttctcaattttacttggaggaaacatgctgttgctgtatggtcgtcaatattacttcaggtaggatggcagatggcaaattcgcaggcacgcatagatacgaccccgagagctcaagccgctcaaggcgcgttgtcgcgcttcttccgcggggctctcttcccccttgtgacgatgatcgcgtcgccgctccaggtctccacctcctcctccggctccggctgcggctcctcctcttttgcacatccgcgcctgagcaggagacgcttgcgcggcggcaggtggtgctcgtccccgacgccggcgtcggcgcggtgctccgtgcggcgcagcccgcagctcgcgcatatgcgccgcctcatcttgatgggatacttgcgctgtttctccgtgaacgcgccgtcctcctcgccaccggcgaacgtcgtgcacacaggggtcaaaggaagcgagagcgacctattgctcgtgctcaacatcgtcccgctccactgtagattaatctaagttcgatgtggatcgtattgcctctcgatccatgtttttgtaggtctaaaagagctcgggtttttctgggatgaagaatgcttgagcatgcatggggcggcacagcaccatgggaaccgtcttatgattgttgcgtgtgaatcaaagcatgagtttgccctgtgtgcgggcgttttgctttcgtttcctgacgatgaagacaaaccatatgtctcggttcctcgtgcgagaaacgagagccacatcgttcgggttttccggttgctgcccatttggtgccgtgcgtccgtgcgtgcgcctttcgtgtttttaacatctcgcaatggacagtgccagaacgcagcaacagaaagtaagcgtgggacgaggatcaagttaaaccagacattaaaaccgtcgtccgagccacctttagatcttgcttatactagttttaaaagttgagcaacgcatgcttatactggttttaaaagttgagcaacacattatatctagtaattcctccgtcccaaaaaaagccaacctaaaaagggatgtgaccctcctagtactacggattcgtaggactaggaggggtcaggttggctttttttagatagagggagtaccgattaaggaaacgatttaaacccaacctcaaccgaaaaccatcatccgaaccgtcttgagatattgttttcactgattttaggagttgagggacgcgtcatacagtcatatctgatactccctccgtcccataatataacaacctaggaccagataaaatatttcatagtacaatgaatctagacatgcggcctgcccagattcgttgtactatgaaatgtcacatcctatactagattgctatattatgggacggagggagtagaggtttagggcctgttcattttgatgccattttcaaccttaccaaattttggtaaagttgccaaaaatatgtgtacgtttagtttcctgccaaattttggtaactatataagaaatcctgccaaaattttggcaagttaccaaaattttggcaactatgccaaaattttggcaatttggtaaagtatttttggcatcaaagtgaacaggcccttagacatgaattttagatttggcgacaaattaagggatctgaagtgaacttatgcccccaattatctgtcgatctctcacactcatggaggcccaataaacttatgggctgaatttagttagcccaacaagccagagtccattatcaccgtgggcccgacctcttcgtccccctcggctctctctcctccccctcggctcgcaaccgccatggagccatcgccggagattccgccgccgccacccgccttcgccgccggcggagaaggcgatccgcatgctcccaccacagccgccgcccgctcctcctcctcctcctctctatttcctctcttccccctctcggcgcccgaggaatcctccgcccccgcggcggggtcccagtggctctcaaaccctagcttctccttcgacgcctcctccctcaacatccccgccactgcctcctcatccgtaccgccgccgctaagcgcctcgtcggacgaagaggaggcgccacggcccgcacctgctaagtatgacctgctgccctactcaccgtcgcctccggcctccgacgaggagaggagggacagacggaaggataggaagaggaggaagcggaggcgggagaaagagcggtacaatagcgcggaagcctcgcgaaagccgggggttcgcgcttgggctgggtcggagacgaagttggctaaggattactacttcgacgccaagggcgaccaggatacttggcgtttggatcgatatacaggtcaggtttttgcatatgaaatgtgtagcaaagctgaacttgcattgtcatctgaagttaataatcaggcatacgcactgggtttgttccatttttgcggtatcaggttccatttgaaaaccatgggcgtttatgttaattgcgcaattccatgaaggtgtgctagactagctgctaaagtggcatgttagatgttgtgcaggcttgcttctgtttagggcatcatcagaattctcagtatcaagtttgttttcctagattcatagctacttgtttaaacatatttgttgtgatctctgagggaaataaataaaagcctctgggctaattgagttgcaagaaactgttaggcaaatttactgaactcgaagctcattaatgtttagtcccctttgaagttaagtgggctgatttgatttcgtcttgagaaaagcgagatctgatttaaatagaatgaatcagcttacatcatgctttggccagaatattaatgcttagtgtgattttgtgactttccatttttttccttggttcatgagttgattctttatttttctgctttcttcatttttgtttagtttgactgtagatgcatttttcattttactgaaatttgacacacaagaaaattatgcagaatggatattgcacgctacaagtctcaaaacatgccagaggcacgtggtctaaaacggcttttgtttcataacttgggtgtctcggtacatatgggtcatgagtcagatttagatggactgaatagcaaagcaagagctggaggtcgctactactcggcgaaatatgcagttgtagaaagaaataagggtttcaaacacctaaaagtattgaaaaaggataactctgcaattctcccagaagattttatccccctagggataccatctcttcctgaaaataacactactggggaacaggaacttgaagaatcttgggaagatgaaatacttcggaggacacgagaattcaacaagatgtctcgggagttccctcacaatgagaaaatttggttggactttgcccgattccaggtattaccaatttgtctgatgttataatatttcttttgtgaaacagtgcatagtgtgatccacattgttgttacttttatgggatatcattagtagttacatagagagttctaagatatcaaccttattaatataatgtttcttcattcaaccttttccttgtccgctctttataaatccactgaagaaattttctctgctactttttacaggataaagttgccagtactcaacctcagaaagcagcccgtttgcaaacaactgaaagaaaaattagtatattggaaaaagctgtagagcttaatccagataatgaagaattattgctttatcttctgaaggcatatggtgagagggatagcacccagaatctcctggataaatgggagcagatactcatgaaacacccggatagttgtaagttgtggaaacagtatctacttctgtgtcaaggggaattctccagattcaaagtatctgacctacgggagtcttacgcttatgcagtacaggctttatctgcagcttgtactaagctatgtaggcaggttcaacttcagtgtttctttgtatatagttcagcttatctgctccccctcccctttttctatccctctctcggcatgtatgcactgttagcgagttaaaattttctgatgtttattctttctttctttttttcacaggatacacaatatgatcgtctcgaacctaagtattcttccttaattcatcttgaactcggtctagtggatatatttgtgaatttgtgtcggttcgaatggcatactggacatcgggaattagcaactgcactatttcaggctcaaatagaatttagtttattctcccctccccttcatctgaccacaagcagtaagcaaagactctttgagcacttctggaacaatggtggtgctagaatcggagaagatggggctcttggatggtccagatggttggcaaaagatgaggagagtagacaaaatatagatatacaagaaaatacccaagaaactgaaaggggtggttggagtggttggtttgatccttctctaaggactaatagtgaaacaaggcaagtggaaccatcgacatcttgatggaaatgatgcagaaaaaccagatgatgaggacccatctgcacaagaagatgttgaatctttgctgaaaaagcttgggattgattgagatgctgattacaatagtgaagttaaagatccaaaaacgtggaatagatggtcatttatggagttatcaagggataatgaacaatggatgcctcttcatgaaaaacttggtacgttattttctccttgtgtttgtagattgacaaatcacattgtttttttagctaacccagtacttacactggatgccattttcatggacaggatcactttattctgatgatgctccaactggagaagacaatgatcagctttccagagtaattttgtttgaggatataactgagttcctgttctctctatcttctgaagaggctcgcttttctttgatatgccaattcattgatttctatggtggaaaaatttctagatggtaatttcatctacttcttttcagataagctgttgtcattctctgtacgcaaagtctactagcacttgtacaataaaaatggcatttcgacctcagtgaaacagcaaatattattgctcattttttaaagatgtgaacgtattccttaagatcatcactatatgggcctttgaaagaacatactaatgatagctgtaactgtataatgaggtgtatgattcaacatggcaagtgcatcttaattttagacttgtgctgatcatgttgatagttttacttgaatccagaaattaaggaaaatagatggtaatggtattactgcccaggagtttatagtccttgcaagcaaacatttggacatgtaggatgaaaacagagacgatggcagtgagatgtgaaatgtgttatatcagccttgtcctcattttatgtgccttaaaaatctgtattaattatgagcagttcattgggttgcactatgaataagttgttacttttcacaatttgtttcttgccattttcatattgttgtgtaccaatgagttaactacaggatatttttacattccaggacatccaccaacagttcaagttggattgataggaatttgagcctagagatgattacagatgacattcaggaagatcttagtacggtgtctaaccttatagacaagaaccaaacttcagttcataataaaatggtgtcattgttaggaactatgcatgaattttctcaaaggcctggcactgcgaaatttctgaaaaatgcaatattgcttttccttgatgtattccctcgtaatcatatcctggaggaagctgttcttgttaccccccaaattcatacagctcaagaaaaatatctggctactccagccaccgcatcccgggctttggccaaaaatctattgaagaaagacagacaggtatgccttgttccgtatttttggcatcacttggctgagtagcataacaggtgaaaactaggtcgttagttgtgcaatgagcatacagaaaccggtagttttttcatgtgttttaagctagctagttgtgcattttatgttttcttgaatacgtgcattgtatttaatctgcgtctcttggtagactggatgcatcatgcagtttgggaaccaaaatcaaactgagttcttcagagattgagacatgtctcttcaattcaataacatccatttcatttaactagctcaaagtatttcaacgttcatcttattttggatcttgcttttccaacagttccatgtgtgcatttttttaatatttatatacctgcactacatgtatcagtaaatattcttaacagtgatacttggagcacgacgctcttttcttttgaaataagaaaaaaaaactgaaccatgtcacctttttcgggtaggatcttttgctttgtggaatatatggacgaattgaggctatgaatggggactttgtcaaagcaaggcatatattcgacttggcactatcaacttctcaaggagcttcagaggtaaaaccataaagtaaatgaatcagtatgttcagatccaaaaatacaatcaatgttgtcattatgtctttgtaatgtgccaatgctgctagaaatatagatcagtatgtcaaatgggtctcactcactacctcccttccaaattccaatatagatgtagttctgtatattgcaatggttctctgacacactgctagcaattatacccttcttttacattatacattgataagcattataaaatgtactgcctggaattagttactgtgagaaacaataacatgatatctattagtgcttaaggtttgaaaagttttttttgaaagtgttgaaagtttgactgcgcacctcctatggcaagtagggaacctctattttggaatagaggtactcactcgttttcacaatattattttcaattccaccatggacacaaaccaatggtcaccaacttagatcacatgctataactactcaacctattcgcaatattatgttaggggtagctactattatagagtggacattgtgacacttggttttctcaatagacaatcattttgatgtggcctgttgcaagaaaattggctaacatatttttgccattcaggtttctcacattggtctagcagcaatctcgtggttgagttagaataggtttcaagcaactttatgaaagcatatactacgtagttaattgtcttgagcagtttatgttattggaaaggaaacaccacatcggtacttggtcagctatgtcaaacatagttttattgatttcagggctctattcccagcacaacaatgtgccttatatagtcttctattctagcacatttatttatgctcgcttctgctttcgttgggcaggatctcaggaagaaggttcctattctttatttttggtatgctgagatggagctagcaatatatgcttcaagaaacaattctgactctgtggatcgtgcaatccacgttctgtcctgcttaggggacaaggcgaagtatgcttcttttgatgggtctatatcacgacctcaggtgttaaaggctcgtcaaggatttaaagagcagattagaagcttgcgatcttcatttgcaagtgatggtatgaaagaagagtctgttgctctaatctgctcagcatctttgtttgagagtatgacatctggttttgcttctggtcttgaagttatagaagagaccttttatatgacaccttcaggtatttcatccttcagcacctttttcttgataatctgaatgataattactcatgcctttacttttagctcatgtgtatgtttatttatctataagcggggcgagttgacttttgtacaaattgtagccattgtttgtcctcccatacttttttctcaagtactagtgatagtctaatagatactgatcataaaagcaaccacatgctaagccattacattttctgttcctttaattgttatatattggctatctaccatctgctaactattgaattataacctgtctttagggctctgttagacgtattttttagtttgacatttgaaattgttttcatgtatcttgctaaactcttagatattttacaatcttcaataaacatacctattttctgactggaagtgacaagctcctttctagtactcccaaggctgctcaggtgtcaactacagcttttgataccaagattttgcatgaagtatcaagcttatttggatcacaagtctccacccatagtccaaattaactagcatttcactgtagatcttacatttattttatttctgcagtgcttgatagttcatgattttatttatccttttcatttactttgcttttctatgtctgtaaatatgtattattattctcatctgtcaaattcgcaatctattaagcatactcttatcatgatttttcagagaacaaccatagcttagaattcgaagaattgtggatgcactacatcaagcagcttcagaaaaatcttaatcagttgagtctctcaagggtttggccaaaaatatcgcaaggaatacaaacatatccgtacaacccaaaatcatatgcagccatgttaactctaggttgcctttacagtgtttccaataatctacgtctcacactcgacaaatttaatcaaaggtgagttctcttccctacaaaatccataacacactgcttttattacatgctatggtgttcttctctgacaaaaatatggaatatattgtgtaataaggtagaaatgtaattgatcctgctaatgattctcttggtctcctttagcaatacatttttttgtgatgcttttcacagtatatagagatacatttgtaacctgcgaacttcctgacacagtaaacagtatatatcaagtatttttttttcctttaagtagccagtttgggtgcatgcactcttctaaaaatatcttctgaagtgcgcatggtattgcattgcatatttactgctctttgtcttttgattttatcagggatccttccataattggcttgctctttgctttgtcctttgaattgtgcaaagctggatcagacaatagaatacacaatctgtttgagagagctctgactgatgataagttacagaaatccgttctgttgtggcgctgttatctagcttatgaggcagagatagcttgcaatgcttctgcagctcggcgtgtgttcttcagagctatacatgcctgtccatggtatggtactgaaatatgttgtcgcaatttgatgtttctctggttatacttacatgattgcttattctatcatccatctatatccagctatttttatgtagccaatttggaacaaagatcatttatatgttttttgttacatttgtatcttatacttacactatattactagagtacagaagagatctcatcagaggataatgggcacctgaactttgttgtgctattgcccttacagatagctaaatgtacaatagagtataaagtttaaataaccacacttttttggaagaaagtgctttgacagtaaattggtgttcttgcaaatatggttgctctatgaacttgttacttggaactcggaacttgtagcttctgccttttcttttttatttttttatcaaaaagttccatctttaattgtgggtttgggaaacacaagttctattttcatgttattttagctgctattgttttctaatattaaacatttaaactgtaacttgagtgatggccaaactaatgacaattggaacttggcactcataacaagacatcccactttgcaggtctaaacgattatggcttgatggatttgaaaaactgagttcaattttgacactgaaagagttgtcagatctccaagaagtaatgcgtgacaaggaattgcacattcgaactgacatttatgagatactcctgcaagatgaaacagatacgtgatgcagctatccctgtttttgtccataattcgagatctccatattatctcaaggttccatcttgcaactgaagatcggttgcatgtgatcttttaactcataattgttggactctcaagatcggttgctcaggaacctttatgtcgcatggaatgtgatctggacacgatgtacatccaaagcatctttagattggcaatctcgtgacatattaatgtgatttattttctgttcctggagacatatgttcggcttgtgtctggtcactccaatccttgtatttggttggctcatgcttcttggaagggcacaactgcaggaagaggtcaatatgaagtaatgatggaggaaagcatagagcggcagcataaagttgaaattgtcttgccaaaatggaacatcaaaagctggcagagaatcgagttgataaataaaaaattactgcgtcttcaggcaagtgatgctgtattttacagcaaatatgtttttttagtttcttcgtcattttcttactgcacttgctcatggtactccttgtgaaagcaggttgggggtatttatgcagtaccctagcgtcaatcaaaagcctggagtatgtcttcatttatcatctttctgcgattaaacgatgcttgtcctttttaaaacggaaagaaggaaagcttagttctgaacataatatactaatattgtggtatatatgtgtacaatgcttgaagtgacacatttttttttgaaaaaaaaaagaaactaccgtaaaaatatgactcggtaattacaaaagagggttgctagatgaggggtgcatactacctcttgttagctgagtctgctgcagcaaatgatgttagtaggtatagttgtataccatgttctcgtaggatactgtttactctttatttgttatgctccgctgctgtgatgcctgcgtcctatactcctagccaaacgcccacgcgatacggcgatggtggagagaggccgataggctatagcgctttcgagtattcttgtattcgacggtccatttgcagttacacgtagcaggtttattgattgttatgtgctgatactcgctagttcattgccgatcttcctcatcagaatccgggataagggacttcctacgcaggcacctaaaggctgtgccaatatacatcttggtttatgcttggcatgataagagggttgaattgaatacagtactgaggccccgacaaggtaacgatacaatgcagtcttccatatgtaccataccttgatgcatcctggtgaatttgaaccctcctcacccacaggatgtggctatgtatttacaagggtgggtaaactaactcccccattattatcctaacttcctgaccaagacatttgtccgttcagttctccatataattggttccttcacttcaccctctcgttctgatgatggttatggtgccctttcctgccgtcctgatccttgtgaggctaacaactgctttgccggacaggcctagtccatgagcgtacacagcagggctgcacgcgaactggccgactgggtgccggaccggcctggctggccgcttcaggatcctctggttgacgtcgttaagcgtcgccgcgccgccgccttctaaccccagcggcttgacaactgcaaacgggtacagcacgcccgtgtccctcttctccttccctgtgaatgaatgaccaagaaatttcttttacacttctataaacatcaacaaatgcaattcttattattaaggggggttgaacagtaacaacatgactatttacttcgtccgtcccaaaatacttgtcattctagatagtttagcagggactaagatttcagaaaaaagactataataccccacattaaatggtatatatggttaggagtggagtagtagtttaggggtagaaaaggaagaaatttgaatatagaggaatggatgtgacaactagtactttctagtgataaatatattggaacaaattttgaatcctagaaagacaactattatgggacagatgtagcattttacttaaaaaccctcttcatttatagaagctatactatgaaggagtaaataacaactgaggggggcaatcaatagatgcggcctgccatgcatccatgcatgcctatgaaactgtttaacaaggcaaatacgttcgaaaccacatctgcaagactgcaagcactgctgctccccgccccaatccctgccaccgcctcagttgccacacatgcgcggcgagtgataattgcccaccggtcacccacccacccccaccccacctcacctcacctgtcagcgacgaggagcgacgaggcgacgacgcggaggcggcacgagaggacggcgatggctgctgctgctgtttgcccacgatgacgtgctcctcgcaggagtaattgccgcggcgccctggccgccctgccgctgccgctgcgtggcccgcgcctgctgcactagttgccttttgcagctgcagttgctgcgcagcgccttgcccggtggtggtgcgagaggtggcgggcgaggagttgtggttgtggaggatgggatcagctgcctctcctcctcctcctccctgcgccgctggcacctgcactgctgatgttgctgctgctgctgctgcgctgatcgggcccctctgctcctgctcccaacccgatgcgtcgtcctcatctcctgcccaataaacagggtcctaagttgttttaatgcaactactttgacactaagatcagatgtactaagtttgctgataattgactgtgatgagaagccgacagctattttgtctctagctgttgttgcttagcctgaagaaattcagccatgcagtgacgaggaagaactcgatcggagatatgattaatctggtgtttagatgtggtagtaaaagctgtccgattgaaaaggacgtgtcgatattcataatcacctgagacaaaactgccgctctccgggatcatgatattcaattcatgcatgagacccccctcgccgccgctgctgctggaatcccagaagctctgtgtgtggcaagagcaagcaacaaaacaacagcagctacgagttagctagagcaaaaggcgaggaagaagacaatcaggcacagcttgctttctgcgaggagacacgacgacgctgcactgctcttttgtacgtaagtatatgttactgcatatatgcgacattgcgacaatggagttgtgcctttccactttgctgtgatctctgttatgttcttagcactttcgttctactcgagattaattactactgctacttggaagttttacaggcaacaaaaaagtttcagtgatctcatgatctttcatcttttttaaaaaagctccagtaataagtaaccactactaaagaatgaatatattgtctaggcgccgagctagctacccactatagctacctgaaaacgcaacaagttcttgcatcaatgaatctacgatgaaccatgcatcatatatcttcgatgacgggtacattgtccatgaatgtgttgatggcatttacctgaagaaggcagtgcaggtcctcgttcgccgccgccgccgctggccgtcgaggcggcgccgccgcctccgccatcctctgccgcttattgcaacggtcgctccagtgcgcgacggcgtcttgcaggtagccactggacgcctccgacgacgacgactccggcgactccaaacctactacacacaccaacgaacctaagctcaacgacactatctcactagttcactacacaaacatgccctagctagctagcttgcaagcaaaagaggaaagcaagcgtatctgcgtatgcatgagtctacgtatatactgtgtgtgaggtggtagctagtagcagtgggtgtgtcttacgcatggccgaaagaaaggcgccatgaatgccatcttgggcggcgtctcctcctcctcctccaagtgtgtgcagctgtagctgatcccaatcccaatccaactgaggaggaggaggaggaggcagcacgaagtggtcgtcgacctaataggagtggtagttgtctagggccatggccttactctcctttgccctgttacgtcctttcgtgtgtgtttatgtgtgtgagagagctagctattatggctgtgcagctgaatgctgatgaggctggggcttaaataggaggcaactttcgtggcaacaaaagctgtgtcgaattgggcggatgggaatggacggaattgatcaataggaggagccaggcagccagcaaccggtcaatgggaaaagaacgaataaacaagagcaaaagagcaaaggggaaaaagttgcggttgctggatggatagctccatgcatctaggcctttctcgtgattcgttatgtttgattgccctctccccctttctatcatcatcggagaatgttgccagcagtgcattcaatacattgtgaaattgatcaacagtgtccatccatatactcgccgagatacaaaagatctaaaatagatagatatggatagtacattagtacttaaaagcaatgtagacagtttgttaataatgtggtatagtttagtttgtgtgacatgtatacaaccttagaacaaaaaatattaaacgtactattttttttaattaaactcttactaatattgatgtgctatgtcatatatctagatttcttgtaactgtcatctagttaattcaaaagatttagatcaatgtttataagagctctgttaaaaaaagtttaagtacgtgtaacattgctcttttagggctaattggctaaaacatgaatttttacggaattttcacgtgacttaactcaattatcctacaaaaatctggtaaaatcatttaatccaaaaggaggaggctttctatatgttatattcatgatcataagctatttctatgtattcacaaaacatttcacgccaatgccatcacatgcaatatttgacatttgcagtagaggaattaatgccatcaagtgtgaccgaggggtggtaaagtaaaattgttgggtggggagagtaaaaaggagttgcaagtactacgtgactgttgatgtttttgttcgtatcgctgctgcaccagacggggacagcaccggtagctttagcattctttcatgaaaatctttggacgaggccaagaaaatgtgtttgctatatttctcctttttactgtaccataagttttgagcttctgccattactgccatccttggacaactgcgagcttatcatagctctgtgtacttgttacagaaactcctttgcccaacccaagtgtggggcttcacatatcaccaataatgaccaaaagggtccacacaacaatatcactatttaagatactaccagtacttaaaagctactagtagtattggatgatgtgaaacatcgaatttcagaggatgatatgaaatgtcaataattaatatgaaatttaccatgcatgcatggttggtaaacctaaagaaacagacagagaaaatatatatgtggtgtgatcattgacagattaatctgctggtgtggtttgttcatcaatcatctatatgcacaacggcacaaggaaatgaccaattaaagaatgtaactaatctgaagttctgaaccagctaatgaagcaaagaaacgtacatattgatcaataaaaggcatggtccaaaagggagatcaatcaggcctggaacagaaatgagttccccaaagggggtcaagaaagggtacgagtacttagccctgacatgaatccataagctgattcgacttttggtgtaaacccatgagttaattttacagagaaactatcgacttggaagtggaagtggcctcttttgcaggtgcgtgctctgctacttctcttctttacttgctctctcactcactctttctgctaatggtcaatgcaaaagcaaatgaattaatgctagcttccaacagttttactactccatcatgctcactcaccaatggttaagccattcctctgaagaagaaaataaaaatggttaagccaattggaccatatctacttgcctgtgtgcttactgcaactacggctagctcgactgccgtgtctctacccaaagctgcacgtccatcttgagaaaaacgtagccttgtttttttttctctgtacttttgctagggtgtgtttagttcacgttaaaattgaaagtttgattgaaattgaaatgatgtgtgtaggaaagtttgtatgtgatggaaaagttgaaagtttgaagaaaaagtttgaaactaaacaaggccctattatagtttgatttgcatatttaaccgtggcctttacctactcggttaatgattgggtgacaaacattcatgcttgcagggcttggagctagtagagtgcatgcatgccgtacgtcctactatcgtgtagaagggactcagtagcgcggctaggaaagatttttattgcgccctgtgctaattgcttgatgatctatgtagtgcattctgcggctctgcctaaacgtgttaatttgcttggttggtgacgcatttaccatgtctaatttgatagctacaatcagaaaaagattaccactatagtttatttggtggtcactagtcacaaatcccgactcaaaaggatgccggcgaaattgaagcaacaatgatactgtactacgtacactgaacaagttaattaagaattgccgtagtactacaagagtaggaacagatgatatggcctaggacaccaatagattagagctgctaatttttttttaccgctttgccgagttgtctgttgtagggtagaatcttgtactaagatgtaattattggcgactatcacctcccaaagcttttctgtcctggatcggaaactgtacgcgcgagactttgtgattatgcagcgcaaggcgcctgttgctagctgcgactgcgagagtggcaaaactggcgaagcatgtgcgagacacccacaccaaatcagccgaaagaaacagtgcgcctaacgacctaagcggagcctctgcctctagttttcaccatctccactgaccagtgctatcaggtacagtactaggtaatttagacacatggattatcctactagctactgatcactagtcttgtccactgtggtacaatgatgaacttgcttggtgtcttgtgacagctatttcaattcctctctcctcttcgatctaggagtatatgcatgttgttcagagctgcggctaatccgatcctccactaaaatttacatcccttcgagtagtagttatatactgccttgattcgaagagatggaacgaattgaaggtttgaacctcattggcatgtttcacattccccgctgatataaaacaatgtaatcggtaaggacattgttctgtccacagccatagtttatcacgtcgaatgtcgacatgtcaatgtttgttaggcaagcatttagattgatacagttgtggcaaatcacttaattatttgagctaaacttcacctgtgatcaacgatttattggtcccagtttatataatttgccacacctttaacaaattagctataaaactacttaaaacacaatttaaaatgccataatccggtaaatactttgtttcaaatggccctaggcctttgttcttttatttttcagattattgaaaatgaattatctgccccatactttaaaagatatttttttcttaaaaaacactttttcctactatattgtttagaccattttgttttaaattatctgttaagtttatttttatatattaattatttttataatgaaggccatgtttagttcgtgtgccaaaatttttttgaagtacacggatacacatttaaagtattaactatagactaataacaaaacaaattacagattccacctgtaaactgcgagacgaatttattaagcctaattaatccatcattagtaaatatttactgcagcatcacattgtcaaatcatgacgtaattaggctcaaaagattcgtctcgcaatttacctgcaaactgtgtaattggttttttcatccatatttaatgcttcatgtatgtgtctaaatatttaatgggacggaaaaattgaaagtttaaaggaactaaacactgtctaaatagataatcctctaaatctaacatgaccctaacttatttatatgaaaatcgctagctatggagtattagagccgagcatgtgcagtggcaaaattgaatggtgggcaaacacatgtactaagactgtcagctagtcagttattgcatggcaaccccaagtcaactgttgcgaatcttgaaccatctgcaaggatttaaaacggccacctacccataaccaaagcagctcgtgatgatttgttgctgttcttcaccattgatatcctttacaaacacaactggcccagcagctcagctatatatgcagcctccacattccacagttgcacacatccgagcgaggacaccggctggcgatcgagcatatatatgcatgcacttgattctttacaacgactcgcgtacgtaccagtaccatccttttcattactgaattttgctcaacaatcggcgcccgttttggttacgtctcaggatctgtttccagctgcacatgggtaaactgcttcaatctgcggcgccacattattgaagccattggtgaattggtgaggtgaaatgcgcgaaatttcacgagcggccggtcgatctcttggtgaggtgaaagcggtgaaaatctgaaatctcgcgtcagatttgttcactggagctggtggtggtgacaacctactgcaaacgtctgaacctgcaatttaacgtttatgacggccctgcctgagtggctgacacgacgatgaaaaatgaatttaatcatgcatgcatggcttgcatgtacgtacgtactacgtacgtagcaaatctgtattaacatgcatgcattgatggaagccaataaaggatcgatcgataagaaaacatcgagggccagggatgctacgtgaaggcccgaccgttgtttgttgtagcgattaattcgaacttagaagtgtggacatggggccgagacaagatcagaagccgagttaatgattacacaaaggctttgaattacatttttgctattttacttacaatggatttttaggtttctgtctttcaactttcgttcgtaggattttgtatcaaaattcatgttcatgtatatcaagcttacatatatactttgttagatagcatttatatccagttagcatatatttatactcagttacagtgcaccaaaattagattttacactattttttctagatttatgattatttatttttgttatttcatttaaaatgggatatatcattggttaaaatttttgcaagatagtcccttgaaaaaattctgcaagatttaaagttataaatccattaaaagatcaatagatatccctttaattatattgttgagctgatggttatcgtgaattatctatttattgcatggtaaattaaatattatgaaaagtaacttaccaaagaacttaaaataacttaaaataagtggtctaaataatactacagtagaagatttttttttgagaaaacatttttttttcaaatcgtgaagcaagtaatcagttttaataattttatgaatgaggccttgtttagttcccaaaacaaaaacttttcacccatcacatcgaagatatttggacacatgcatggagtattaaatgtggaaaaaatcaattacacagtttgcgtgtaaattgcgagacgaatattttaagtataattgcgccatgatttggtaatgtggtgctacagtgaatatttgccaatgacggattaattaggcttaataaattcatctcactgtttcctagcggaatctgtggtttgttttgttattagactacgtttaatacttcaaatgtgtgtccgtatatccgatgtgataaccaaacccaaaatttttccccaagtggtggtgtttggatgtagggactaaactttagtctttgtcacatagggtgtttgacactaatttagagtattaaacatagactaataataaaaataattgcataaatgagagctaatttacgagatgaattttttaagtctagttaatccataattagcaaatgtttactgtagcatcacatggactaatcatgtattaattaggctcaatagattcgtcttgcgaattagtccaaggtttatagaatatgttttataattaatctatgtttaatactctaaattagtgttcaaacatctcatgtgatagagacttaaaaaaaatttagtccctgagctgaaaagaacggagccgaagtattggactggacccgagatctcctctctgctacatgcttccattcaaatcaatcgtcggtcttttactcccccacagacatgagacacggcgtgccaacttcttttggtaaagagttgggggatggaaatgacgagtgtatgatccctagaaattcttggcgaagactaaagttgggaaaagcggctggcttcatgaggaagtcaccaccacactcccccggcccgctgcgatgggccccgaaagcctcttttggatccggactccggagacgttgtgtgctccgcttgccgcgccgcgaatccgcgtgcacgatcgggtcgctcgcgccacacatctcgccgtgcaacgcacggcggcagtcaccccggcatggtttgggcttgtgccgttgtacgcgcacgccccgcgcgcggaggaaagattcagccgcgtgtgcgtgtgcgcgtgcgcgcgggctgtgccaacgcaccaaccaggcaaccacctcggctcggtggcgccgaacagccgaactgcgggggctcgtgcagtccgcccgatcgaaacgcggccgcgatgcgatccgttattccgtggtgctgtgccgagacgagagggacggtattttcacgtgggctcgtgccatagatatcaacacgcgcggttgggctttacgctgcgtttcgcgcgcggtttggccgggccgtctcgcttagccgcgatgcatgcagagcttccgcctccgagacgaggaacggaggaaggggtggctcgcgtcgcagtttaccatcaacaaataacgcaaacgttaaagaacagggtgtgccaggtaaaacgtgtgtgaattgcagttgcagggtaaacgtgctatatgtattgccaaaaaaaaaaaaagaaatagtacgaattatccctggaactattaaggccgaccgaattatcctcttaaactcaaatacaagatattttacaccctcgattattcataccggacgaattaccccctaacactgttttgagctgttttgactgggagtttgcacacgtggcatcaacgtatcaatccagtcagcaataataataataaatttgtggggtccacctatcatctatttcttctctctcttaatctttcctctcccccgtctctttcccattctcttcagctcggggtaggcgtcggctggacggaggaagcgggagaggtggggctcgagatgggggtggcagactggcataggcgggagaggcgttgctcgggataggggtggcagaggcggctggaggcagggcccgggatggggtggtggccggtggcggaggcaggaaaggcgtcgctcaggatagaggtggcggaggcggctcgaggcggggtccgggatagggacaacggctggtggcagaggcatgcaactagaggcgggactcgggaagggggctcgtcggctggtgatggagacgtttggaggctcggttcgaccccctctcttcagcgtttggaatggcggcgatggctggtggcggaggcggtgttcagaatgagagcggcggctgggtcgaggctaggaatgggggcgccgaccagtggcggaggtgaggaaggagaggtggtagatcctgtcaccgccgtctcttttgcccgcctctcctgccgctgccactaccacccgcctcttctactcagggtgctacgatgtgggggagggggtggggggaagctgtgcgacgggtggcttcgagtttgctgtggaggcggcgaggtcaacagtgaactccacaacctgagcaccgctgccactaccgaccccgtcttgtcacgccgagcgttgctcggcgcgagtagaggagagagaggacatccaccactagccatgcaggcgtgctccactcgcctccgcaccgccgccgcagggtgctaaaagcaacgttcagcaacgccgctgcctctaggctccaggcctccagcgccctcctcggcgcacccttccgctaaccgtagcgcgctctccccatgatgccgccgctagccggccgccccgagctctcaagcgagcgagagagagagagagagagagagtgtagggggattgggacttgggagagatttggtcgagggagggagatgacaagtgggtccagggagttttttaaattttctttgctgactggattgccatgttggcgccacgtgtacaaactcaagtcaaaaaccgctcagaacagtgctcatgggggttatttgtcgggtttgcatagttgggggtggaggatgtctggttttgttgttcagggggtaattcgatcgactgtgatagttcgcggccgggggggtaattcgtactttttttttaagaaaaaatgaaaatgctatttggattacacgcgcatgtatgtagtaggacgttactaataaagccttaattatagcttgcggttcggctccggcttagtttctgtttctgttttaccattttttattttgttataaaaatggtaaaggaaatggttgaggttattttacgactttttttttcaaatagaacatatatgtatatgttctttttaagagagtggaggtaaatactcactacatttcaacatataatatttttaggttgtttagcaagtactaaggttaattagttgaaaagatttctcttaagttacttcagttttctattttaaaattttgaatggattagattctctttgaagtcattggctctggatttatggaagtgatgtgaatcgtgggaatcaatgtagaaatcctcatattgtggtataaaatttaaataatagaaatatatatattttagaacagaggaagtaatacattagtaattcttctatcactcacattccttgcaaacacatagccattctttacaaaagaataaaagatgatcgatggccacccctacatggcacgttacatgtatgaaagaactagcacccaatatcatactactccacaacattacagatcaaataaaggcccacgacctgatggactatctggactgccaccacgccggccttgttgcggcactacatatcgatatgacataaaacaagaacaaaaacatcgacatttctacccaacataatttatatatactatcagacataagcatcatcatttcgacccaacataatgtgtatatggattctctactgtacatgtacatgtagtagtagtcactaaacgttaggacctaggtccacatgctcgtgactatagctaccactgcatgagcactattgtagataatccccgtcaatcccgatcgtgtactaacccgtgcagactgcagaaagctatgtcgcgccgcggcaccctgcgccgatctcaatcttttgtcttgggtggtgaaaaacagctgcagattgctctgagcatgctcttcttcactctgttgggatgacgctgcatcgtcggctactgttagaagagctctgataccgattactgaatatgatgaacccaaaactaaactggaaattaattaatgcttcagatggccaaagaaactaagcgagagaacaagagttggatgattgatgcctccaggcagcatctccaatgtcgtcctctttataggcctcgctattgtaacacgaccagaagctttccaaacacgatgtatataaactaggaaaagtacatgaagaaccatgcatagaaaattaacttcagtgacaataatatatgtagaataggtcgcaccaaccatcactccccggtggtggaaaggataaaattggattaatattttaaaattccaaatatcgattttatatattaaaataactttacaaagtctaatagttttataatattaggataatatgataatattttctgagacaaatttacatatattatttctcttatttttaaactaaatatttgaaaattttgttgatgatcgaaaatttagaaatttgacataatcttgtcttaacgttaaggctctcgtttgaaacgtatgaccgaaaaacgcaagaatcgaaatttcatgtttttcaattcaatcctataagaaaatgcaccacaagaaagattgatccaaataaaagttttctaagaaatattatctttttacttatttttctatggaattgaccatgtcttttagttattttcttatgaaattgatcataggaatgaaattctatatatggtaggggataattggcttcaatccaaacaagccctatacttgtgaccgggactaagagcttgaagcgagggaagcgaatggaggagcatgttagtgtgatgagcacttcaataattaatagtactctaattacttatcttaattaatttggaggaatgccggggtccggctagctgcattatattccttaatttattgtcttccatggtatggtatgtaacacgtggtcgaatatgttgtgtgagtacactttaggagtatttcgcaaaagaacactgtgatataaatacgcataaactaggacctggacggtgaatatatactcctgctcctacgtactcggattggttgacttaagcaccgtttacttttgaacactgtaaggtggctagtttaaaatagacaaaattagttctagagcatcgaaagttgtcgattttggttttatagcatcaaaagtttacggctcattttgatagcacctaaagttacctccgttacttctgtttagcattccatccaaactccagttagttttcttttcttattattatttttcaacaaaaaattagatcaaacaccaatggtggccctcttccacttccttctcatctcgaaacagcagtcatacaggagctcaggccggtcagccatggtgcgaacacagtatgctggctccacgagctcgtcatgtaatacgtgagccctcacgagctcatccgcaagccgctgtgttcatccgcgcttgctaggtgtgatctatccacgttctagctttgcccgtacagcgcaatcgtcgatcgatctcgtctgccgcgccgccatggccatgctagagcttgttcaaatcttgcgtgctcaaccaggtccatttcctccgcggccgtgccgcttccgagttcgtccgcgtgcactgccctcggtctcccctagatgcgtcatcctcaagctcatccaatccatgaacgcccgaagtgtcattgtccagctcgtcgccggcattgtcgggtccgcacggaagcaaagccctccaaattattgtcggcgcccttgagctctctccgacatgctgccctcgatcgagctcatccatcggccctcaaattcgccccgaagcaccaccctcgcgctcgttgcgggctcgcctgagtgccgacccgctcctccttgccctggatccgttgtctaccgacccaagagccgccgcctctagcatgccagaaccagctgccaccatccaaggctccaactcgctcagcgctatactgtcatggtcgagctcgcctgatgccttgaagagtggtcaaccataggagggagagcgcaggaggaagaagatagaggtaggatggggtgagccgacggaactgctgacagaatgctaaaaatagtaacggatgtagttttcagtgctattaaagtgaaccataaacttttaatgctatagaatcaaaatcgagaactttcgatgccatagaaccaattttacctttaaaatatcatattcctttttactcaactgtatagtcatttacttaaccgtatcatcttgatataattgtccatatcaatataagctttactacgaaaagaacgtgaaaaaacataagaaaatttcagcgaataattaacgagtcatgtaccctcgattcacgcgacgaaattgaggaaacttggtttgcaagtagctagtacatgcgcaatcgccaaaaggcgcaacctggaccaggtcattgtttcagttaaatgcacttgaacttggcatagggtgtgtttagttcacgccagaattagaagtttggttaaaattggaacgatgtgacggaaaagttaaaagtttatgtgtgtagaaaaattttgatgtgatgaaaaagttaaaaatttaaagaaaaagtttgaaactaaacaagtccttaatcagtttctagtatggtcggcatgcatgcaacaaaacacgacgctgcaaataatacgcgtaaactgggattctgactagctatggagtatgggcagtcttaatttagaagaaaaataaaacaaaggaaggcaagccaagttcgttcccttcacaagcgcacctagcttgggacggttaaaggtagcaactcgcttggaacggttcaactatttttgctgcaaactagtactgcaatgatagatggcaatgattaaggtaataagatgcttcagaacgcacaggcgcagatgctccgtattaggcccggtttagttggaaacaaatttatttcgaggtgttacattggatatacggacacatatttgaagtattaaacgttgtctaataataaaacaaattatagattccgccagaaaactgcgggacgaatttattaagcctagttaattcgtcattagcaaatatttactgtagcaccacattgttaaatcatgacacaattaggcttaaaagattcgtattacaatttaacgcaaactgtataattagtttttatttttatttacatttaggccttgtttagttaccaattttttcttcaaacttccaactttttcatcacatcaaaactttcctacacacataaatttctaacttttttcttcaaacttctaattttggcgtggaactaaacacagttaatactccacacatgtgtccacacatttaatgtgatgggtgaaaagtttttgttttgtgaactaaacatggccatatactagtagagttcaaagtcatgaaataaatcaattaatactatcttcttacctactccttctatcccacgaaaaacgaacctaggactggacgtggcatattttagtatgactctggacagatgtatgtctaaattcatagtactagattgatttttaatgtaacggagggattagacttacaaatgaatcaaaaagttttatagtttcaattcccttaacatacccacccacaaatactactttcctcaccactaaaattatcttgggatgcaagagtttaatttattttaggatggaggaactgcatattaaagcaccactaaaattaccttaggctacgagagtttaatttatttcaggacaaactaaatattaaaaacaagaaaaatatattgcgaggactattatactgtaacatttttactacagtatataaccagagctaccgaagtttgttcgaacaacgatgatttgctcatactatagccttcgcttcatcagcctagagtagggcggagttcaagcaagttcatctgcctagactcaagctcaattaaagctcaagccgagcctacgaaatctttaagctaacagacagtcttagttcgagctatatatatatttgatttgtaagtcttagttaacagacagtcttagttcgagcctactgaactttgattggtaagtagaactatatatatttcaagtataatctttaactaatgtttagttcaccacattgagcggagcgagccgaggggcgtccaaatgatcatatgctcgccggggctgcacacaggggcggagctagagtacattaggggagtgcccaggaacccggttaagaaaattttttaaactataattaatctattttcaccatatatgcatccccttaatacaaacttagacaccacccgcatcagtttaaacttaatctaaagtaaaattaagcaagtagcatcatcccctatttcgtgcgtgcttgctgcgcgacgatttctattcccccgtaaccgtaaggcacaatcgctctcggtcggtgcaactgtgcaagtccgcaagattcggccgccccgccccgccgcgcaacgcaacgcaaatcggcacggttgccgcggtgcgcgcagcgcgcggctggttcgcaaccaagacgccaaccgcgtcgcggattcgcgggcgcggaacaatggcgcgcgtgcatccgtgctagtgaccaagtctcgccgtctcagcccacccgcgaggatccatggttgggctgtgccgagcgggccgtttttctttctcacgcgggctcgtcttagcgataccgccaccctcgctgtttgtgctttcgtctccaagccgtgtaggtatataacaacttaaatgaggagaatatatatatatatgagtatttggattacatgcgttcaaatgaatgtaactaagaccataattatacatagacagacatgactcatccacaccgaccaacaccagcgtacctaatttacaacactaacattagtttcacaagcacggaaagaacaaacccatacttaattagggaaccagtgacatataccaaacgtactccttatcgtgttgagcggcccagattcagctacgtgctttacgcccgtgtatggatcatcataattcataactatgcttccgcgggagcaccgcagaagcagagtaatctgaggatgctcttcagggctccgccgcgctttggcgccggcttgcttcgccgattcgtcgtgtcgtcgccgccgccgccgcgtccgttctccatcagcagctaacaaggaacaacttctacgaactaacacgggtgctctctgtcaagaggagtattggaactgtaactctgcaagcaacaaccgctgccaataagcagagccctgaatgcgtggagtataaatagatagcacggtcgctttctgtccgtacccctgagagcttatactccaaaatggagggacatttcaggcctatttcgggggtaaaaaccagggaaatgcgcactagtgtaaagtgtgactcggatgcagccgtatcgaacggacggacggttctttttttgggaaggaaatgcacttccattttcatctctcaatgaacttttgttttttcaccacaatcacaacggctaaatccacgcaaggcggcgcactatcgatcttgcgtgtgttggctgattgtcgcgcggagaaaaatagggccacgattcgctagcgacattgacgagattgtacgacgttctgcatgtaggatgcgtctaatttcgtcgtcccaggaagcgcgtgtatgtttagggtgggtttagttaacgctaaaattaaaagtttggttaaaattaaaacgatgttatgtaaaagttaaaagtttgtatgtgtagaaaagtttcgatgtgatgaaaaagttaaaagttgaagcaaaagttgagaactaaaccagaccttagcagagtttcacgtctcatgttggaatcttcgaaaatccaacgcatctacgagccttcgacgtaatttacatggaatatatatgtatgtgcctttgcggccgacagggtttgcccccaccaaatcttagcttgggcggttgtttttgtctcttcaggtaagcgtactgcgtacgtcgtccaaggcttcaggttcagcgtcacctcatcatttctcatcagctcgatcacgaccagatcaccaggtacgtgtatggaaatgtttcttcttggatgcaaagccggccggccatgacgccgaaagtacagtagcttgcaagtgtttttcttgattgactgaaactgaatcatactgcatgtacaccctgaaattaacagctctgctgaaagtttaagaacagactctaccacggtcatcttgcatgcaatggaatatttttgtatttcgtgtgatgtttattgtcctgtttagtttatcacgttgtttcgcgttaacaagtttccaaccttgcaaaaaaatagagcaataatttccgcctccacccacccacccctaaccccaccccgaaagatagaacatagtatgtttcctaagcaatacaagttatttaaaaactatccctattacaatagttaagacaaatatatgctctaatcattaatctataaaagttttttttaattatcattccttcctttcctcacccttatgcagcaaaaattactttttatcatgtattccgtacaagctaagggttgatgtaaaatttaacatcagcgtttctctctcctctcctctttctctcttacatgccagtaaatttgcttgcaacttgtcacgccccgaactagtcccgaccggaactagcccgtgacgctccaatttagcctgttaatcgataccagtcccaggaaacagtgctggtatcacagggagacagaatatcacagcaacagaggtctctttattatagagtagaagtacagtcatgttgggctgcggacagatcccgagctcacaactgcattacaaaagggaaacggaagccaggacttggaccaaacacacaggcgtgacttgggaactaggccgaaaccctaaaactcatcgtagccggcttgctcctggaagaactcctcatcagcaggatctgcttcatcttcttcagcaactgggggggatatttatatagagcaagggtgagtacgggagtactcagcaagccatgggaattaagtgtttaatgcaggcttcaagggaaggctgttgtttttgcaattgattttatttgaactcttttctaaaaacaactaagcgagtgcttctcaaacgacacggatgagacagtgcgtctcgtccggtcgaagtatgtgcaatgtatcagtctttagaattaaaacaaggttggcacccggccaacagcttttcaaacggccacccgggccaacaacttttcaaacggccacccgggcctacaacttttcaaacagccacccgggcctagctgatcccatcagctgcagatttttcaaacatcgaaccccttttcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccgggtcacccagcccgtggggatcagccacgtcgggagacctccaagctttcatgacaaggcatttcgaaagccgacacaggtttgccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaaacggtccttaagtgcgagagcgggaaaccgtacacccggtacgttccccggtccgcggttttggaaattcatttagttcgcaagcaccgacccaggtgtcgggttttccaaatctttcgtaaaacccaagttttacccaagttgttattcagattataagtttgaaggcgtccgtcgatactcgcacaggatgcacgaatatcaagacgcaactaggtggttacaaggggacatgctgtaacaattaacaaggaaaggatcaaatgcaacaatttaggtaagtccgccaatctgtcttgcagacgggacaaaagattaagtgcgatcctatcaatgcataatatttttcaagcaacataattaaatttcaaatataggctcaagatgttcaaaggtggcttgccttgctagagatctggagcttgatcctcgaaatcctcgcactgcgggtcttcgggctccggaactacacgcgaaacggaacaactcaacaaacggcgaaaataaagccctattaatgacctctaagcgtgccattagatagatctcgagatttgaggaattttggaagttgaacggagtcaaacagatttacggttgggaagatattgaatttctaagattattggatttttggtctaaaggaaaaggatttaattaaatcctttttggaaaagaaaagaaaagaaaagaaaagaaaagagggatggaaatcagacttttcctcgggcggctagggcgctgcccaaggtaaatggagcggctcggccgagcttaacgggccggccggcccaagacggcccaagcgcgcgcgcgggaggggaggggagagagagccggtggaccgggctcaccgcgcgcggtcccgggtgggacccgcttgttagcggctcggctcaccgtgcggagggagtttgcggcgtacgcgcgcgggcggggctgggacgcggtgcacgcgcgcggttcgcggaggaacggatgcggcgggcccatgcgcagcctcacggctcgcggtggaacgcgcgcacgggaggggctgaccggggtcggcccgtcccgacctcggctgagctggcgccgacgtggcgcctacgtggctgccacgcgggccggcgggaggtagacgacgacgccggccggaacggacggcggacaacagcggcgagcggcggagcgaaccacggcgatatcggcgaaagcgagcacaccgggtggttgcacgtgatgaggggagacgagccaacggctcggattcgccggagggagcttgacggcggcgaatcgcggcgccggcaaccggcggcgggaaaaggggaaaacggcgacgaggtcacgaggggccaattcccggcggcgagagcatccacgcggctacgggaatccgatgctagcgtcggattgggcggaactacgccgagcgaggccggcgacgagcgggtgttacgaagctcgggcggcgacggcggcgagcacacggcgagcgacggcaacggtcggggcggcgccggctaactacggggagtctactcaagctactaccgaaagctagggggaggagatggagcgaggaggaagaacggagagagacactaccgtgcgggacggggcgcagtgacgagaggccgacggcgcgggagtgatctctccggcctcgggccggggaagaggaagaagagggcgcgcccggagtccccttccgcgtccacgaacgcaccggctctcccggcgcttggcgatggacggcggaggcgaggcagagcacgggagcggcgacaacggtgaggagacgaatgggagaggaaaggaagggagggggaagacgggtttaaaagggcggcaatgtcggtttgagagaggggaaccgacatgggcggtcaagccggcgagctggcgctccggctagcgtccaaagcggcgacaggaggtgacgccggcgagaggggaaaaaggggagaaaaagaggaaaaggagggagagaaagggggctcgcccctttccgattcgggaaaaggaggagggagcggggcgactcggcagagggagaggggctctctgcctccgccccttggaggctagcgcgcggagtggcgggggccgggcgatgacgacggcgatgatggcggggcggtttggagcggcgcgacgacacgggcgacaggcgcgggctggcgcggcagagggtgacggcggcggcgaccgggcggtcggccactcggcacgcgcgcgtgggaaacaacgggcggcgcggctgggcagcgggaccgggcgacgcggacggcgcagacgacgcggctcgggcgggaaaccacgcgggcgcgcgcgcgagcgacggcgcacggggccggctttgcgagcggggagctcgcgcgagaggagggggcgctcggcgcggctctcgcacgcgcgagtagcgagtcggggggggggaacgcgccggggaaagcgagagagagagagagagagagagagcgcccgggagagagaggagagggccgggggagagggggagatgggccgagcgagattcggcccatcgacctcgggggaggcaaaatagacttttgcggaggaaatgattttggaaggatttggattcggaatttgaactcgacgatagatcggggattgagatcttgagatggcacggacactagacaacaagcaaggaaacaaatttcgcaaatagggtttttaagagataattttcccgctaggcgccacgacggaacgggcgctacacaactaaaagctactccctccgttttaggttataagatgttttaactttggttaaagtcaaactgttttaagtttgacaaagtttatagaaaaaatatagtaacattttcaacccaagacaaatttattatgaaaatatattcaattattgatttgatgaaactaatttagtatttaaatattactatatttataacttagttaaacttgaaataatttgactttgaccaaagtcaaaacatcttgtaatctgaaacggagggagtattaattacacacgctcttctaccatttacattattacatctccgactaattagaggtatgatggtaaagggagagatcttagataatttctttttaattggtgattatggtggaggtcacaagatgatcgccaagaataatagggaaacttttagtgcaggagtcatcttggtaacatggatggtttagaaggaacacatccatggattcttctttttcttttcttttgtttcagcttgtttgaaactttgattgtttggaattggctggagcccaagctcgggtaggcagaccctaaccaaggaaaatatgtagtaaaaaactgttcttggatgtaaaactgcatgcttgaaatttgtccatgtcaccaattgtaaaaattctactctcagtttcaatcatgaaatcatgagtaaaaattttactcggactcttggtgacgtggataaatctcatgcatccatttttacatctaacaataatttttagatttccatcgtatatatggtttatactatattttccctataaccacctataagcattgactcggtcatagtaatagtatacagacatattcaggggacagtggagcgagttgcgagtatagtgaaaacgttcagaaacaagctggtaattctttatcactcaagactcatactgaacacacaaccacacatacgtatggaccaatacaatcggcgtaaacaactataacctacaagagtactaatcaaat

SEQ ID NO: 6894 - DNA, 18320 bp, Oryza sativa
ttcttagaatgttctgtgaaaatggtacgtttaattctcctagcttagcctgtgttccgtacttttcaccgtgtagaatattgccttgttccccaagaaccgtaccggcgaacgactcgtaacgtacttatgatgaattgatcaaggtcaagacgtcaagttaatccttgagagtgtctatcagtgtgagcactttgaatattgttatattagctgcacacatagtaccttaatttgttgcatcccatggtatgtatgctagtacgcaacaagcaacaagtggtcgaatacggtgtgacaccgtgacaaccccgtgaaactatgacttggtttctgcatgagtaattgtgaacagcactagcaagctttactcggattgtttgactgaatcatgtacagttcacttttgaacgactcttctcgatctcatgctagctgagggtgaccagttgatatgagaacttctactacagtaaattgtaagtttgcactagtaggtgtgttcggatacccctttttcccagctcatctccctcgttttccatcgcacgtttttcaaactgttaaacggtatgttttttaaaaaaagtttttatacggaagttgcttaaaaaaattaaactaatctatttttttaaaaaaatagcaaatacttaattaatcacgtactaagagcacccgcaatggtaaagtagggtgctctctataaaacatgtacatctcagcaatagactagattaatagtaaaccacctcaatagtatgtctacataggtatctatagctctctcatgcattgcctcgtttttctctatagactatctctaagctagtagatagctttgctctctctctcttcatttaatatcttccaagtaggaaaatatgctgacatggatatcttgtagatagcttatagataaccattgtgggtgccctaatggaccgttctgttttccgtgccagagagcaaacacaccgtagttatcaagcgttactaggaaaacaacatgagaaaaaaccacatgaaaattcagcgaataacgagtcctgtacgttcaccctcgagtaacacgacgaaggaagcttggtccgcacgaagcaggaaaagtacatacggaatccgcaaaaggtgccgcctggaccaggtcattggttacagttaacacgtactcctacactttgaactcccgcttaactagtttgcacttgacatggagtgttcactgaaatatactataattttctagtcaagtagtactagtttttaaagaacaaaaggttgcttatatttcaagcttcatgtagtagctagtagctcgttttatgtgtatattgtgcttgacgagtaaaattgacttaaggctgtgttcagttccacactaaaattagaagtttaaaaaaattagaacgatttaacggaaaagttgaaagtttgtttgtgtagaaaagttcgatgtgacagaaaaattgaaagtctaaagaataaaaagttgaaacctaaacagggccttacaaattgtctttgatacgatacatcgatggtcgatttggttcctgcgtgactacaacttaaacagttgttagggctgtaggatgtaaattcaaatgcccaaatttcaacaggacaccgttagggctgtagcaagactactgtagcatttaatctggaccttcaacggaaaaattggatgactggattgcgtgcaatctctaacgtgcagttatagttgggactgcacgtcagcagatgttcccaatccatcgagtgtgggtgtatgacctgacctgaaactgacctgtcagcaggtttgatgcgttcaccggtcggcatgtatgcagcaacatggtagtgcaaaaagggtacgcgtaaacctggatttcttcggtctcaaaaaagcccaaatgcgaccttaaaaaagaaggccaaatcagccaagctcgatcccttgactgaagcatggacgaccgtttaccttggttagcttggaacggttcaataattgctgctgctaaatatggcaaatgatttactcttaaaaattactgcagatgattaaagcaatcagatgcttactgcaaatgattaaaacaataagatgcttcagaagttcacgcatgttaacttgcgtttcgaacgtcgggcgtgcgatgtgcaagcgtacaatcgtgatatgtggagtagtagcgatgcagtagtaccatggaagaaaaagagtaaacagagtatgggtcggaactcagaaaggggtgcttgaaaacgggaatgctacgcaccggaattccgtccggacgggatccttttatccccttgcttattcaaatagtagcgatacctgaccatgcacgtcctgaacagcagcagcaacctctgcaggacacggtgccgctccagcgcgcgcgcatggctgacataggcagcggcgcccacacccgcactgtcgacgcactgccccgtgatcgtgagctcctcgccggcggcgtcggcaccggcgcaggggaggaggaggacaacacggacgcggcaacagatgaggaagtagagtgcgaaggtgttgccctcaccaccgccgtcggcgcagagcacaacgagcacgtacttggctagctcgtcgaggtggggaaggacgtggccgtcggcgacaagctccgacgcggcgtggacggtggaggatgcggccgtctacgacgagctccgacgtgggacatggatgatgaaggacgcggtcgtcagcgacgagctccatcgtgggacgtggatgacgaagaaagcgtccgccggtgatgagctccgacgtggcgtggacagtgcaggatgcggccgtctacgacgagctccggcgtgggacatggatgacgaaggacacggctgtcggcgacgagctccatcgtgggacgtggatgacgaaggaagcggttgccggtgatgagctccaacgtggcgtagacggtggaggatgcggtcgtcgacgacgagctccggcatggggcgtggatgacggaggacgcggccgccggcgacaagctctgacatggcgtggacggtggaggatgtggctgccagcaacgagctctagcgtgggacatggacggtgggatatctggtaggtatcgtctgatacctcgcaagtatcacattctacgtggtaagaatcgcatgatatctgataggtatcatctgatacctcacaaatatcacctgatacgtggtagaatcacatgatacctgataagtatcacctgatacctgataggtaccatctgatacctcgcaagtatcatctgatacgtggtagaatcgcatgatacctgataggtatcacctgataccggttaggtatcaggatctgatacctcacaagtatcatctgatacgtggtagaatcgcatgatacctggtaggtatcacctgataccggttaggtattaggacatgatacctcgtaagtatcaccctctatgtgataagaatcgcatgatacatgatagatatcatctgatacttctcaagtatcacctgatacgtatgtgatagaaacgcatgatacaggttatgtatcaagacctgatacctaaccggtatcatcccgttcgaaaacgagattccgttatatagcagcccccgcttgaaaactaacccctcttaggacaaaaacacattgtttgaacatattttaagtcacaatatttttaacatatgaattgcatgtatgaaaaatcatatattttgatttgttggatatttagttatcttttatgaaaaaaaagcttcaattgaagactatatcgatgttgaaacgatattttttccaccaaaagtgagtactatttaggtgtccttggaagtaaatttagaggttttatttttttaagataaaggaaactttcttgatggatgtaaacaattataataaagtgatacaattaatctaagatcactcttggcaccagcatagtaggttgtccacaacctataattattttttagaaagaagaacgacatgataacaaatatcatgccatagtgagctacaaccacaagctttatactctatacacgcatcacttagaaaaccttaaaaacaacacctccaaaataaaaattgcattgtcattgccatgatccgatcaacaaaacccaaatcataggttttcatactagagaccaaattcttcgaattctagacaatgccttcaaccagctaatgccatatgtagggaggaaccgattttcgatgagcacagcctgaccgaagttccacattcatattgtcctctcatttcttgttttgtttgagaaattatcttattcttgtgaaaaatctataaaacttctacctatattaagggaaaaaaatcatgccttaccagtctacctaccaattagtaccaatttaagcaatacagtaatatatcgtcggagagtggattttgaactctcgagtgaatgacccatcgttgtttacatgtcactcaaatggttatgaaatttttttgagaagatgtattaacatgtgatatattactccacaaacatgcaagttaaatcaacttttataagttgtaaaaaaacaaactacagataattaaagtatattcatagtcaaatttattttttcgttacgatatgtagaagttaaatttgactttgtatgtttgtgaagtgatatatcacatattaatatattttctcaaattttttcataaccatttgagtaacatacaaacaacaaggagacatcccctcgagagtttaaaatagtttccccgtattacccagtttggaggaaaccagaaatattttaggccatagccatgatacaaggtgaaacggttttatttcagaatctggttacaagagacttgaatttcctttactacaacggaactaaattcaacacgaataaatctacagacaatttaatgaaacaatcaataactttccgacaccttgtaatcacatcaacccctgagcccaacgtccatcagcatgagcaactttattctccttaatatcgtgtgttgcagtctcagttaatcgctcgtctgaggtgatgagcagccgcagaggagctgccagatgctcttcttgacgttgttacgcttggacttccccattcttgctccaggaatatccgagctgcacaagctctaatgctccaaatgaaatgctcctgtaaacaaaggaaccaattgaaaatctcctacaaaattacgcgaagatgaaagaaatatacacagctaaatagcaaaaaggaaccagcagagtaaaaatagaatgctattgtaacctccagttaacttcttcaggaatcaggggatgtcaagcttggtgcatttggtgaatgagagaagctactcctatttataagtgttgcaagactgaactgtacactgcataccttggcttctgaatattgtcggactttgcaagtaaaagttcgcgagaatccacaagaatattcaatgaagaaggactgaatgagtccagaacttgaattctgtccacttgcacaaacttaattcggtggtatttgcccgggattagcttattcaacccttgtttaattgcacctcacctctgcttgttagagacaagtagaggtgaggtgcttgttagaacgagaaatactcaggggtctttcggctagctccacaagatggtgggctagacgacctgggttcaaaacctaaccccttctaattatttgatattaggtccttccctaatttttgagttttttttttttctgcttgttagaacgagtcctagacgtcccaaactgctttaatcactatattagatgcaagcgattagaatgcgcgtaattaatcggattaagtgaatggtttggaacttcatcgatctatgccatgtaaaaagaaaagcattgcgtattccctgggttgcttctactgttacataaagtgtgctgttcgtcgtcctgttgattgaatctttcatctaagaagaattcagacacagccacgggttgcgaaatggcccggatagactctgatgatttgatgggctgcgcgggcccaaaaccatgaaggtcgccatcccttgggcctagtggtagggctttgtctcgcgcggcccagctcgtcggtcgctgttggtctgctacgccaccgatcaaagaagttcacaagcacagttggtttgcagtagcgtactctcgatctgttctaaaataaacaaatctattactcttaatattataaataatatataatatatcttaatactataaatctgttctatcaaatattatgtttttgtttattttaatatgaagaaaagtaggaaactaggaatgtacgtaggggcttttcaactgaagttgaccgaagcatatgtgcataataatttgttgggattattgtattgagaggcattgagcgtttccatccagggcctatagctgtgaagaagaataaaatttgagcatacgattccgctcccgttttgtaaaccgccaacatgcccatggttttggacctttttttgtgccaaccttgcaatcttcaactacaaataaacttggatggaccagttctcaatacgaatgaacaaaacatagtactagtaaattacggcctgtttatagttccctaacaaaaattttgcaccctattgcattgagcgtttgaacacctttataaagtattaaatatagaaaaaaaattaattatacagattgcgactaatttgcgagacgaatcttttaagtctaatcgctccatgatttgataatgtagtgctacagtaaacatttactaataatatattaattagggttaataaattcatctcgctatttactgacggattctgtaattcgtttttttattagtgcttgaacactacatgtgacaccctatataatacccgatgtgacatgctaaaactttacacctctcatctaaacaccccctacagctgctaggcaagtgaaatatctctatgttctggaaccgtacttgtttccatgtcattggccaggaaaacaagaaactgcgtcagaattgagacctggaaacattattggctcctaattaacgcaattgacactgggccacagatcaaagccatacttgtactgagcttggacgaaaatattcttcgtctttccagatgattaaagagccttctggagagagaagcaccatcatggctgcctatctggcgaacggccgatcggccatgtaaaggagaaaaggcagtttgcacaaggaataaaggcaacctagtctacaagttcgctatcaacaggcgatatgtcaccctatttctgttgctgttcaacgacgtccttaaataggagtacttgtgctacaagcctaacccagagatagcaccacaaatacctctcttttctttaggtgtttacttcgacagcttcaccaccttcgtttacccattgccatggcggctgagaagcgaaccattgggctcggcatggactactcgccgtcgagcaaggccgcggcgaagtgggcggtggataacctggtgaaggccggcgaccggatcatcctcgtccatgtccttcccaaaggagcagatgccagccacaaggagctctggaagagcaccggctcacgtatgtaggggcattgcattttttttttcttttgccttttcagtttcttctcttgttcagcaaattctggttcagaaaagattgacaggttttgcatctgatttaccgttggtttttgactttgtgtagctttgattcctctgctggagtttatggagatgaacgtgcaggcgaggtatgggatcaaccccgataaggaggtactggagatcctgcaagctgaatccaagtccaagcaggtaatgattctgcagccttctctgaattcttcatgaattacctgtgatgggactgtaaaaactagaagggaaggttgattcaaatgtaatcaaactaaaaagaaacgttgatccaaatgtaattcaaagcaaaacactgattccatattggctggatcaggttgaagtactggcaaaagtttactggggtgatgcaagggagaaactctgtgaggcagtagacgatctcaaggtgaatacctttgttcttggttgcaggggactaggacccttgaaaaggttagcatttaaacctttttcattctttgatctaaacctcttctcagttaaattgcgtgtgaatcaatggtttttacctcaatgcagggccctacttggaagtgttagcaactatgttgtcaacaatgcaacctgcccggttactgtggtgcgtgcaccaaccgtgtcaaatgcctgattctatgctacatgggactgctggaaattggaatgctgggcttgttttgctgttcatccatcttttagcagagaaccttcatctgagttggtgccattgcaaggattggtctctggctcctgcacttagcttttccatgctattggaatgttattaagttgaatcttcggtgtatttccttctgttacttcctatgtatagttcattactactgtttaatggtgaatgttaaagattgccaatggtgtgcttgctttatgtatacgacaggggccctaagaacagttttttgcttaggcaggtctttgtaacagaaatggcatatctgattttcttttttataaaataaaacaatcttacataagcaaagataatagaaaaggtgcctggcagtacatcaaatgtatataaacctttatttccaaatggcagaaatatatgctttattctttaaatataacaaacagtgttttacattaaccatctgctttgaattttgtcgtacaaattgaggcgaatactctttttagacaatgagatgtctgaaacctctaacaacaatggaagcaattttggagcatagcaatcagaacatcttaccagttccatctttgcgtggaacagattcttcaagatccattctgcgccaactcccactcaaagatgataactcatcaaccttatcatacaaaccaagaagaccacctgtatgtacaaaaagaatttttcgcccttcccacttagctggattagcacccatgtctttcagcattccatatgctgcctttccactgcagaaatatgaagcatatatctttaggcaatgatatggccagtctatcatgaacttgtgatgaccttcaatattagtctaacagaacaaaactttttatacttttcgacaaatggcaagtatactggttgtaaaattagagttacatgcaaaaggtgtttcttgggattaatgtttcaacaaaaggaatatattgtacctgtagactggatcaaggtcaatgcctgttgctgtagctatatctttaacaaacttaagctcctcagctgtgttcatggcataacctaagcccttagcctgtgaagcggcagttgcaggtaatcaagtcaaatgttcacaaaattctaccaatgcacattagcaggaaatatcatcaattagagttgcaccataaaattggaacaatgaaatgaataaactagtttcagaacaattatgttatatactgatacgcgcataacaatgtcataattagaggatgtaagtccactcttcaataccatttaaatatcaaatatagaactttaaaaatgtacttacattttcaatgttgactaaatcatgtgaacgcaaatcagaatgaagtccatcaatcaggtcttgaacataggaatggaaatatccaggatcatcacaaacagagaaagcatggacctatcctaaaaatggataattagtcgaacaatttcagcaggatagaaaacaatcaaagaaagtgcatacttttgcctttaagctactcaattttgatcctaaagcaagaccagcaatggttccaccgctgcataaatttaaaaatcattcaagtcataaagcagcaattgctactttcaggaactaggcatgacgcaataacaagtgagtacataagtaccccttaaaagtaaagaatggtgcgtattgacaaaatacctgccacatgcaacaacaatgtcgtcaaactgaacatcacctgatatctgaatttgatgttcaatctcccttattgcttctatatatcccctatcaagaaacaaaacaagttctgatttacaaaaagaaaaaggaaccaatacaagttacaaagataggtcaagtttcaacaatcgggtatcactttcacaaattctgagacctgtttgaactttgaagtgcaaaccttctctttacagtaatcttatattctattcaatgttgttgattaaatgtggatagaatacactacatttgtccttcagctatgctccacttgttagccaccacacaagatagaaccggatcttctagtgttgcatgagatccactagattcagagcctagggccttagacaattccaacattccaggtccaacatagtatattgaccaatagaaatttgccaaaaaaaagtgatgccctaatgtttattcaaatacaaactaatctcttcttttctgatagactgatggcaaacaccaatccatgaataataatagtccctgaggaatattcaaagtatgctataaacgcacaaagaaattgaaaatgcaaaaatggttcaatagttaggattgaacagaaaacaataccaagttcctagagagtttgatccaccaacaggaataacatatggttttcggccttcttccaaaagcttctttttcagcaagtccgctaaagcctgaaccaaataaatccatactaggcttagggacttttaagcaatatcaatatgaataaagaagttctaacaagaaaaagatcactcagatattttaataggcaatgccactttaccagtttatctacatacatattcaaagaataggcaatataatcatgatctttcctcagaatagggaaaaaatgaccatgctaattgtatgatgcagacatatactgcaggatgcattacttgattggacctttagcccctttaataactacttgagtatggatatcaagtatcagtataacaccaaaatataaaaagttcctttgctacacatggcccgatggaattatgaaaataataataaaagcaataatagcacatcatcgaaaagagcataccacactgccaatttttccatattcttcttttgaaacaagatcaatatgcgctcccaccaatctctcaacaaggagattcccaaccaaaccagggtccttatccacaagaagctgaatgtgaacatgccccaccaaaactaggttagcccaaatatgctaccacacgatatcatatcaatttaatgatttaataacctcataagtcataagtacaaagatcaccttggatgtgcgcagtatcagataacaatcaagatttatatactttgcagccactgcggtggcacggcagtgattgctctggatgccacctacagttataacgcagtcagcgccctgcgcgacggcatctgccatcaggaactcgagcttccggaccttgttcccgctcaactgcatgcctgagatgtcgtctcgctgcaatttcccccaaactctcgtgtcagaagccaaactccataaacaaactactctaccctgaatcatatatctattcattgatagagtaaatggaacatattccctgaatcatatcaattcttttcttctttctttttttgcggggctgaatcatatctattcattgatacaacaaactgttgcttatctctaaccttgatccacacctccgtgccattcggcaaattgggcagattccacttgtggatcggcgtcgggaactgtttcaattagaaattaaaccgtgagtttcccggaatcgatcctcctaatcaattcaaaactacttcgaatcgaatccaccgataagaacaagtgcggccgttaggatcaacgatcaagcggtggacttagggaaacaaactcacatggccgagcgagaaggtctgcgagggggcggtggacaggtgcgaggcccaggacggcggcgcgtacggcctcttggagaggaagctcccgatcttcccggcggcggaggcggcggaaactccggccatccacgcggcggcggcggcggcggcgtggaggggaatggggagagagtggggcagcgagcagcgcgtcggggcagcagctacagtccaaaacccacctggtgcctggtgggccccacgcgccatctactgagcagcgggcccctcctcacgtgccccgtgtcagtgagagaaaaggagacgtcgttttgactcttttgcccccgtgtccactcgctttctcttcttctgggtccttggcgtggaagccacaagaggaagggattaaaaatcaaaaagaaaagaaaaaggaagggagaagtggaaaaaaaaatagttcgttatctcgcttcagtgtccaaatcgcgcacaagttctgaaagcgattgtggttggccgctgttgatcggtgcaatctcccgacgtctcgaggaggatgaagaagaacacgtcgggttagttcgatttctcttcatttttttgttcatttttttctgcgcttttccgcggcgatgtggtagagtgggggagtaggggtttgatgcttccagaggagtcggagaggcgatttttatgggatttttttttgttggcggcggtgcgtgccctcgcgttcagccagggtagccacctcccgccgccgtctgtcttccctgaggtcgccgcctcgttgcttcgagtcctactttgatttggaagccgatgagttcgtggttttcctggaagtaattgaattgttttttttgtatgcgaatctgggtgttagatttggtgaagtgcaatgttttgctggtgtttggtgattttgatgataagatagatgattccactgaagcaatgggggtgtagcaaatgagtggcggcggcgaggatgaatgaaccaatgtttttcccttgattagatgactccaccgccaacctagtgtagcttgctcgctgcagccaggtgccgccattgctcaagctgcttaaggagggcactgacgatgccctggaggctaccacacgcctgccctggctgcttggcttcaatcttcaagggtcaatcgaacctccatcagaggagaacggtagattcagattgaggaagagcacactatttcagtggtattttgagagaaccaaaggctttctattggtatatatcacaatgtgcaagttcaagtgatatatacccctttttatattaaactatttattagttattttctctcttcgtgcatctcatacattggagtattggacacaactagtcttaaagttgttgcagctgtatttgctgtctttattggtttgcacttcttagttccaattcaacagtccgtattcagtaatgctataggtttcccttctataacaagtgcaaaatgtctttatctcatttcaggttctctgttctttgggggactcctacagatgtaattggttctgtaagttgggaaccttatcaggtgaacacttgattgtgataggcttgtcaccattgttagatatgcagcaggttacgtgacacaacagggtctgattttgttggccaatctacatgtgattctctaccgcagagtgtattttcatgctgtatcattctagtggccattataggttaatacctttatatttctatctagggtggttgtttcaaacactggcatcagtaatgtgtttttacattcctgaaaatgttctgaaaattttcgttattgttatgctgacattgtgctacaaatataattccaacatgagtattgatattgattggagtcgttactctctgaagatagatattgttcttttatacaaaagtatgcaaactttcttgcttgtgtcattgaacttgattttctattacaatggatgttgatttcagggttaagaaatgtctgaccaggagagagatgatattcctatgctactaagaaatgttgagctaccaacgtttcctcctagaagtacatcaatgtgcataccagttagggatgatgaatacgaagaagacacatttgtaccccatactggtcctctgtttgttcagccaccaacacaaactgcagcagcgggcattccatttacaaatacaccagatatgcctcctcgacctccacaaggaaaacaagtcaacaagccacatgcgataatgccagaagaaattggaggaaacaggtggtcttatagtgggaatgttccaaagaatgaacatttgatgatgtctggacctttgggacaatgtgacgatcctgattgtgtcaactgccctcctgcttgtaaaaacaaaaagcattttcacagaagatcaagtacattggacagtaaggtggtcttacttccctcttttttgtggaatgcacaaaacattaaaactatatgattttatctgaacctgatagatgtggctggattgcgcaacatttttctaagtaaatagcatagtattgatacatacttcacaatcatcataagtgatctggattcgagaagcctagtacttctgaattataaagtagagaacacaagtctaaaagaaacataaaagataaaaggcaaaaaaaaaaaaacagagtatagaatgcacctctacatagatgagaggtaatattagttgatatttatcttcttcttatataaaaatctcctagtaagcaatcaacatttggctacagataactcaattttaagcataaaatttctatttcaatcttcaatggaaaataacagccaatattgctggaggtagcgctgtagcggaagtaccccgctattgttattgcggctgcaattgtggccattgtgaatgctatttagtaccttggttcttagttttttttttgtctagttagatttcttcaacataatgatcaaagcacttcttaagagcgcttaaagttactgactgtggtattgttgtattgaataatctaatctgttttcttttgctctcttgaagttccataattttctttgtgagcatggtggtggatggaagaaggaaattgagcgtttcctttcacgcattccagttatgaacccacatgcaaaagttgttcagcaatggaatcagttctttgtgatatcatgcctggttgccatattcattgacccactatttttcttcctattatcagttcaaaaggtaactagttcacttgaagatgctagttcatatccatctgtcaaaagcctacaactttcttgtacacttcatttgttgttgcaccttgtttgtgagtttgtgagctaatcttgtgtaatttttcttactcctgttgcagcattctattctcctatcggttaactgttctaagtgttgatatcttgtgtaatggattgaaagggtcaaataagcctaaaaggggaggggggaaggaataggcgattaaaacttttaagtagatgcagaagcagtgcttttcggaaattccgaaaatctcagatactccgaagatcaaagctgacctgcacttacttttgttccctttttttttatgcaggataacaagtgcattgtgttgaactggcattttgctacagcacttgcagttgtgagaagcgtgactgatgctatttattttctacacatgcttcttcaggtcagtacatcattgcttttgctattctatagaaggttctataattcatgttccatgatagggtatggttccacattttataaaattctttcataaataacatggtcactaaggcatcagatggaaggcagtttgattatattttggttctttggtatgcatattaggacaagtatatttgttgagtgatcagtagttttcttctaaaaatgccaaattagatactggttttttgtgagtataacttgcactttttatctgttgacaatatgtgagaaaaggctcagccgctcaggttcaatattcttgtgtcctggtatcatgttttagtaactaacagtaatgcattgtttgatcttcagcggatgatttatcatatctccatgatcaaatagttgtgatatctttttaccctttgtttggtaattgtaatggtttgtcatgctttgactccattctggtatcatgttttagtttgatttatcatatcttgtattttattttattttgcatctatttgttcctgtccagttttaaccccaagaaaacatattatcaacttttgaccgttttattttttgcatttctctttcagttcagactggcttatgtagctccagaatcgcgagtagtgggagctggagatttagtagacgagccaaagaaaattgctgtccgttatcttcgtggatattttttactcgacttcttcgttgtgcttccactccctcaggtaacttgttttatccttctgagttgatgtggctaaattttgacattaagcttcatttttcttctttatccctgatggatgacttattatctaggctgaagttttcctttatcattctatttatatttttatattgctttggtactcctcttcaagtcggtagcagaaggcaaacttgttcttagggttatgataattattttttagggtaggtcaaacaaataaaagagttagctactgggaacgcactatacatcctggagagtatgttggagacctggcacaagcagcataggagttaggaggtcccagctatccatccagctgttgaaaattgcttttcttgtttgcttggcttattactttgcatctgccatggctttgtggaccggtggccacaactgaatgcttgcgattggcaagtgctagtgatccatgttcatctttttcatgcacacagcaaattcattgccctatgtagctagtgttatggacctatcatgaacagatcaagagcatttctttcagttctcttcacgtgcacaatagaccacattatccttttaagctataaacttgtgatctccactattgatgtactttaaaatacataagcttcatctaaggagtattggttcaagtccccgttgaaaatatatgctattgaacctttcaggtttattttggtagtttcttgttggtctcagagtatttgccaatgtatttaagccaactagaaattgacaagaagtcaaaaagaagttgctgtttagcattgaaaatactatggatcttgggcatgataatgactaattgattattccatacttgtgaccttagcagattgaggatgagtctcatgaaattgatcatgcagaggaacaccttagctaggctggcaattctttgttactttctgttctgtttgccatcaatattgtcagtatgagcatcatttgatctgattgcactgatgccctttatctatttattgccccagttgcttatgtaaatcagaattgcatttttttctaaccctattaataaaggatattcatcgaaacaatttacacctttttatatcttattggctaatactttttttttgtcttctgttccttgataaaggtgatgatattgctggtcatccctaaatatgttgggttatcaactgcaaactatgctaagaatttactgcgtatcactgttcttcttcagtatgttccccgcatcatcagatttgtaccattgcttggtggtcagtctgactcatctgccaatggattcatattcgagtcagcgtgggctaactttgtgattaaccttctaatgtttgttttggcgggacatgttgttggttcatgttggtacctatttggattgcaggttagttcagcttctatttcagttttctgcacaaaaatattgtgtttattcatgttgaaccagtagtttttcatctggggaaattgatagtgtcacttaaatgttgaaatagggaaaccactcaaatcaacctttgcatccactcaaatattgaaacttaccagtatgccctccctttgtcttcttatttctccattctcctttaccccctcacaaagagcagcagtacgactgttccctctccctcatcattgttgccacctgctcaagcttcatcgtcatcacacacattgcaatggttgacttgtagtgctatctcaacctgctcaagcttcatcgtcatcactcgcctggatttttcacattttggtccttttgaaaaacttatttcgcaaatagacccctgaaaaaacttatcccagaaatggtcctttttggggcgtcagagtggctggcgccgtcatccaacgggacggcgccagcctctctggcgccgtcctcctgccaccgtggcacacgcgaaccgacgtggcaggagcgcccgagggagggggg

SEQ ID NO: 6895 - DNA, 23619 bp, Oryza sativa
ccccccacccctcacctccattcctatttctctgtatggagttgcaacggtgtcaattttgttttattttttcggatgttttttcacacttaggatcacgatacaaccaaatttaaactcgaactaccacttagctaagtctgaaaatagctagcataccacttagtctactttgcaccttcactaaaattagaccatagctcatttagtaaaaccctttgatcagcatgttatacataatgcactctatcactatatgaaattacttaatctaattcaaaatataaccacatgaaatgatagccataagttaaacagtacagagagatgcaattttttaatttttatttcatttttttgatatttttttcacacttaggagaacataggaaccaaccatataaaaaataaactcaaacggacaaaatgtgacttgtagaattttccaaaactctaccgaaacggacaaaatgtcatttattaaaataggcgtaattttctcatacggactcggaatcaggcaaataatatatccatggacatctacagaaaatgttacatccgattctccccagcttcgccgggttcggcgatattaaaacctccaaattccgcttgcaagattgtgttttcgaggagagaagtttctcggtagagctttggaaaattccataggccacatattttgtccatttgagttcattttttatatggttggttcttgtgagttcctaagtgtgaaaaaaatatcagaaaaataaaataaaaataaaaaagttgcacatctctctcctctgcactagttcggagagagaggagaggagaggaaaaattctacaggtcacatattacgtccatttgagttcattttttctatggtgggttcttatgtgtccctaagcgtgaaaaaaaaatatcaaaaaaataaaagaaaaataaaaaaattgggggggggggggggcgccagccattttggcgcgctccccctagctacctcagcatcgccccgccacgtcggcagggggacggcgccagccactctggcgccccaagaaggaccatttctgggataagtttttccaagggtctatttgcgaaataagtttttcaaaaggaccaaaatctgaaaaattcacctcgctactgttgtggccagccatgtcagaggtctcagaattggttgcagactagaggggttttataactcaatggctgatggagcctgtcagagtctaggccaccagaggtggagagcaattgtttggaaactgttggatttttgggatgaagagaaatggtgatagacagtggggtaggcatgcttttcttttcatatggctcgtaatcggcaaagaacaaggaattaaattaagaaatgcattttatggatgcaacactgactcgagtggcattttacaaattccaacaaattgaatgtcatattattaattgtttccttatatttggagaactatgccatgacaatgtgtgctttattattgctttattattgatacggagaaaacatatcttctgtttaatttgttgttttcatttagattgcattttattgtatacatgctgatttccttgtgtttttcgccgggccggcgtaagatacgcggccaaagtttattaagattgagaagaggttcaaactagtacaacagatacagctgccatggaggctaagagctgtacaacctctattgttacaacgatgcacatttgatttccttgtgttaaaaggggtgattgtaaattgctatattcacctgctccttttaagttgttcacgactcctttggtatttttaatagaggacttgatcatatcaagctactcaggagatgttaactaaagtagaggttcatgatgttattattccttttattttcatttgacagagggtcaaccaatgcctacggaatgcttgttctgcatcaaaaattccatcttgtgatggttttatagattgtggacgtggcattaatattgggaagcagaatcaactaagcagacagcagtggtttaatgattcagcctcaacagcttgtttcgacactggagacaacggtttccactatgggatttatgaacaggctgttttgctaactacagaggacaatgctgttaaacgttatatatattcattattttggggtttccaggtatttgacttttgttccttatattcttgtacttaagttgtgtctcatttgttccatttgatgtataaggtttctatacgtgattacagcatccatgctaacactgtacaattttgactaccctttactgatgttattttggtttgacgtcagcaaataagtacgctagctggtaatcttgtcccaagttattttgcatgggaagtcctgtttactatggctattattggtttggggctgttgcttttcgcattacttattgggaacatgcaaaattttctccaagctcttggaagacggtacgtggttatacatgcaaaatttgctagtgtttattgtgcaatattgtctaccttacaatcctgagatggacctctaattgttgtgttaatacacatcaggaattgacacctctatatagatataagctgtaccagctaacagaaaaaatatctagtcctgattctctcttcttctttttttggataggagactagaaatgcaacttaggaggcgtgatgttgaacagtggatgagccatagacgcctgccagaagatttaagaaggttcatctacataacttctaaacaaaattttactaatcttttctttaaaaaataacatcatatattccttaatcttgttgcaaatcgcaaccatttattaattcagactattaatatgttgttgttttttttgctttgtcttactttttattgtttatgtggctcctattattcagaagaagaaaaacgtgtacatattcaacagttatcaggctgcttttcttgataaatcatcttataagtggaatctcatgcaagctatgatctgtgttacagatctcattttgttttgtgggtaaaacgaatgcatgatatattttgaggaaacagatttagtggaaacatcatttgtttgatattgaaatttgtcaatttagttaccaagtttccatatgcagaagatgcacaacagtctcatggcaatgtcaatgagatacctgaattttggtttgctacattcttttaggatcattatttcgaactagtttatttgtgcggaaatcaatttttaactcgcccaaaagggtgcaattttatcttttctttgacaccaaggattgatattgagtatttgccactctaaatgtgcaactaaccaacaatcgctactcagtgtattctgtcgtctttaagaaaaatgagtgtcagtttgtgaaatgttcgaaataggcttttcctctttgcattctcttcttcatctccacaatcttaatcataccagaagttaaagatttgttggagagggagggaatggtaaatctggagtattcctataatgggcaaagaacacaaacttccccaggcagaacatgaacttttacatttgttggagttggcaagcaaatgatttcctctttatttttggactggaagattgtaatacttaatagttttatgaatgtccaggagggttagacgcgcagaaaggttcacctgggcagctacccaaggggtgaatgaagaggagcttttaagtaatttaccagaagatattcaaagggacatacgccgtcatttctttagatttcttaacaaggtttgtttatatgaggactctgactgttctgggagagcaagcactgcaactagttactctatcacatttttactttccatgctcatgatgcatttaaaatttgaggttgctgatgatttacccctacaattttcaaggaaatgctgactacaattattttgcaggtccgattattcacattgatggattggcctatcttggacgctatatgtgacaaactaagacaaaacttgtatattagcggaagtgacatcctttatcaaggtggtccagttgaaaaaatggtcttcatagtgaggggaaagctagaaagcatcagtgcagatggaagcaaagctccgttacatgaaggtgatgtatgtggagaggagctcctgacatggtacttggaacactcttcagctaacagaggtctgcagtttttgcattttgtgtttttattgttttctcttttctgtgatttatatttggtaagtctccatatttctattgtttcagatggtgggagaatgagattccatggtatgcgtttggttgctattcgtactgtaagatgtttaacaaatgttgaagcttttgtactaagggcaagcgatctcgaagaagtaacttcacaattttcacgattcttgcgcaatccacgagtgcagggtgcaatcaggtggagacttttttctttagtgtcacatgatcatatatgctcaccagaataattctctgattcaactagaattgtgtaggcttatgaatggtttatctgttgatttaaattaattttaccataagttagttgggaaaaaactaagggagttcatcatgcatcacagtaattgttattagctgggatatttgggataattagaaactactacggtactctgctccatgcaggtcatgcattcagttgtgtcagttgccgaatatctatcttctatgatatgtatgacaatgttcactaatgctggtgcgctactgttgcaactgcatccaacaggtatgagtcaccctactggagaaccattgctgcaacgcgtattcaagtcgcatggaggtatcggaataggcgattgaagcgagctgggatgtcgaagttgaacgatcaatcttataattctgcattggaacgtggcgcgcgtgaatgtgatgctcgtcagcatgggcgggtatgatttggatcgacaaggtgctaacgtttggtcacatttttatgcgctagagccctgacatccttgtggctatcttacttggcagaatgtattctatgtgagctacataattttttttttgccccacaattagatctggtagctagagtaccaaactggaggaactacatctcatgtatataatgacggctagtttttcactaataactgtttcattcttggcctgaaatcttgcctgcgtatctgctaagcaattgtgttagtttgttggttgcctgcaactggatcagggctcggcaagctgttgcgttaaagacgcttgtctcatggataagctctcgtcgcggcggggtgggaggccgtcggttcgccgttcccgtcgtcggtggagcagattaacggtacgatatgccctgctgcacactgatcgtagggtcatttttagttttgcttccctaccaaaattgtgcatttgcttttctctttctttttttttcacgcgtacgtttggcttttgaaacgacctcaaaccgctgtgttctggggtaaggattaggaaccaattagtgcacgattaattaagtattaacttaaaaaaactttaaaaataagttagtatgattttttaaaacatttcttctatagaatgtttatataaaaaatatataccgttttagcagtttggggaagcttgcccgcgaaaaagaagagccgaagacagcctaaactcatccgagcacaactctctcaataaaaaaaggaaaaagaaacagtaaaaagtgtgcaagcaaacgggccggggacggatgctgcggttgggcctgcctgggagcccgaagtttcttcttcaacgacaccagacgccgggggtcccgctcacactgtcgcttggctcgccgcatctcttccctcctcgcaatcacaagccgagcgggcgggcgcgcggcggagaaaaaaagccgctggcgctgcagctactcacgcgcagccaacaactccaccttgccgtgcattgtactcgtcccaagcaaacagcccgtgctgctctatcagcgcctccaaatttctggttcaggatcgagagatcgccccgccgagcctggcgaacttgaggtacccctggtgtcgcggtgaccacacgccgaaccggttgtaaaccatgattctgcacgcgtacatggtgtcccgtgtacatgtcccgcttcatctccaacacccttctccctttacgcaacgtgccgcacgggcgcgggcactgcccaacgggagctgaaggggcggatccaaagtagaagggctggtatcaggtgacaccgatgactttcgacaaaacatatagcgaaattgtttatccatatgttataacactataatctaagcataattagcatcctatgataccgatagacacgttatgacaccaacgaaacgattctctgaatccaccaccggagcttccagtaactgtgtcgcctccatatatatgctcacattaaggtggtgtttgaatctacttaagatgaagatgaacataaatattaattgtttcacgcaaaacgatgtggtaataacatatgattaattgaattttaattattacaaacttaaaaaatggattaatttcatgttttagaacaactttcgtatagaaagttttcgcacgaaacgaaccgtttagcagtttaaaaagtatatcacttttatcaaaaagtttatctagtttttattggaaaaaagaacagggccttacagttaagcttggtgtggctctcgtgtatgtatatttcctccatccaaaatataagatactttgattaatgtgatatatcatagtacgtattatatgttggaacgaatggagtatacgggaactaggataaagtttgtattggatcggaggtaggaacgttttggaaacgcggataaagtttgtattggatcggaggtaggaacgttttggaaacgctaacgtattcgtattcaactattcaaggtatagtcatgaattgatgcatgcgcggcaaacccttcatgtatagtactagctaaatacccatacattgcaaggaggttgaatatattcttttgttctttttcatagcttgggaatgaatattctgcgtgcttcactgtttattagtggcatcgacatgtcagctgatagtggaagtaagtgatgacagattcatcaatttctagtccccacatgtcagttgtgcgtggtgacgaattcacccctcaccactacgactagagttttaggagtataatatgcaactggtcgtattcagacggttgtatatacacaatgccatgccattaagcaacgggtcgcgcatggtacatctctaactagctccctcgcatacggatttttcactagctgcatattttcccttctattaatctcgtagcgacagagactagactggatgaactaaatcagatactaccttcttttcaaaatgtatgatacattgactttgcatacaacgtttaaccatttgtctcattaaaaaatttaatataagtatgtaaaagtataagttaagattatgttttatttgatgataaaataagttacaacaaaataaataatatttatatatatttttaatcagatgaatggtcaaacgttatgtgaaaaatcaataatatcatatattttgaaataaaggagtactgtattttcatgaaccactgtttcattcttggcttgaagcattgcctgcatccctgctcgcctacatgctggtagctgtgcaaactggtgaccctgcacctcagcacctggatcaggttagagatgcttgtccgttgctacacaagttactcagcttgtgagataacagtgtataccctattgcacgctagcactagtgcattttttttctcagcattgcagctctcaattaacaacaagggtcatgattcatggacacccgaaaagcaaccaaaaaccctactaattttcacaaaaagaacatcactatcgagtcacaactcacaacagctcatcaactgatgataccactaaacagttaggctgagcaatcacagattcacagtttgctggattggaatacgtatgtagtaacaatctttctacttgtcgcggtgatcgtagacatggccgtcgccggcggcggcggcgcggagcacgacgtggcgaatgttgtgtgcacgaactcctcccagccgagccacgatcgatccctccaccgccggatcgaagctcgccgagaacacgccgtacgggacgccgaggaggaggccgaagagcaggaacgccacccagagcggaggctgcaggtcgagtccggtcaccgcggccgccgcgcgcagcgccgcctcgccggcacccgcgccgcgccgtccaccgccacagcacctcctcctccgactcgaggaacgcgagctccccgtcgcgctcccgccgcccgacccacgcctcgtcgctgatcgacgcgtccgccaccagcagcgtcccgaccaggaacgacgcgtgtccgcgtcgatgagtgcccgcaggaactcgccctcctcgccgccgaacacggtcgcctcatcggcgacgccggcgtcgacgaggttcttgaatgattaggcgggggctcaccgctcacaagtgcagcacgccacgggtcaccagacgtgcacgatcttaattaggagtaccatgtaagtatgtttgtcatgttcttcggtccagttgattaacacttagagtcgtgtggtgatgttaagatagtatccgaaatgacctatgggaaagaggaattttacgaacattttagaaacgaactaactcgtgtgaagatttttgtaacgtttcagcgttccaaaggagccctcagctgcgagttgaatgttcttttagcataaaacggtcatgtacaactacaatctctattaatctgaatatatatatctgactacaagtcttaaaccactttactgagtatttcatggtttaatcgaacaaagtgctgtgaaatcgagttaattagtcagtgtcttcatcttctacttcttcctcatcttcgtcttcctcctcctcgtcctcgtcgtcgtccacttcgtcgtctatggaggaatgcttggccatggacagttcgctccagtggctagcggcgagctcccaccccaccagcgagcccctctccgcggcgttccacctcgacgacaggaacccgtagtggaaaccgagcagccccacggcgaacagcacggcggagcccgcggagccggcccaggccggcgccgcgtcgctcgccgcgccgtcaagcaccctcaggaacgcggcctccgccgcgaccgccgccgcgggtggcgccagcatccgccacatcatcccgcgcctcatgtcctccgacaggttgagcccgagcccgagcccgcccgccgcgcgccattcttggcggttcttggcgacgtcccccctcgccgccgccgcagcggtggtgtcgatgacctcgacgttgctggagcttgccaccgccgccggccgggcggtgaacacgccggcgacgcgtcgccggctcggttggtgaagcgggcgtgtggcggcgcctcgagaagggaggagcagcaactccatggccgcggcaggtgaggtccggtggtgcgagtgagtgagtgagaccgtacgtacgtttgtgaagacgagaaatgcgttatcctatcctaaaaggacctttctgggatagcaatgtggagatatttttttgcttagctttgcagtgacctaaccatgtgtcagttggcttggtcactgggtgagcttcacagtcaggccttctttgactttgaaacaaagtattgtgcctataagaaaatttcctgtttggctctttaaaacagatatttgaagcttttgaaatcctataaaagtcatttggaatggttcatgtagacttctagagaaattttctttcagtctttctctctcatctaactctatttttatttgcatcgtctgtccatctatttaaaagaccgtttctatgtttcttatgtgtttttagtattttattgtgtattattcctactaaaatcccttattttaccatttctatgttccataggggtctcaattttatttcatcaagttgaattgtcatttgaacaagtagtacacacaatggcaagctcaaaaaaaaattaaatgaatgatttactggatgttgcctcacaatcataacaatctaatgatgctttcctgaaaattttggagtcaagacaaatctatctctactacgtttgctataaaatgttacactttcaatctctaaattaatgctatatttttactgttcactcccagacgagcccagtcgacccaccagtgcctgaccatattgtcctatctagggattgacccttgaaatcaacggcacagataattcccctgcaaaatcgaacggatcagagtgcatttccttccattaagacataatcaccgattaatcacatgcatgaagctaagataataaggtaggttccccacactccaagtccattctgacacggtttttttgtcccaagcaacgatctcatgcactctctctggctagttgttccattgctgcctccagctagaagccatgcaagaagaggcaactgggcgatcgagctctactacagtggctagctagcttcccctccacatgcagctttgagatctgctagctcatccggatctcctctacgtgctaccatccaaaagcatctaacagacacatcatttttttgccctggccaattttttaaattttcttttttcttcttcttgatctcctgtgttcgttttgtgcctctcgtgatcatgcacaagctgccctacactgtgtctgtgtgtgtgagcgttaatgtgaagacggtttgtacgaatcctatgctatggcgagcgtgctttgatgagcctagaaacattggtagactagagcatgttgttagttactccctccctcccaaaataaatgcagccatggtttttcgtgcccaactttgaccgctcgtcttatttgaaaattttttgaaaaaaaaataagtcacgagtaaagtaccattcatgttgtatcatctcataacaataaaaatactaattataaaaaaatttcaaataagacggacaatcaaagttggacgcagaaacttatggctgcacttgtttcgggacggaggcagtagtagaagaggttatgatcaatgtactgtgagtacttaagtggctaagtactgccttgacactgacatccttcccctgtctgtcccggacaggcagccttgcgtcgcgtcaggctttatccggaatgttgcttccgctttccaggtgataattttgacgcaagtaattgctcgatcgatccgtgtggctgtagtacgtccatggatgtcggatcggagacgattgcacgacgcaaactaaatgcattctgacttcacgaattttttttgtggcttttttgcgtgtgggtgatcgatgaggaacagtgagatcaatgcggttgcattgcacccggcgagagtgcacaacggttttgcatggttttggatcctgggaatgcaaggggatcaatggaatctatcacgggaaattctggtcaagagcagatcatctgcagtgtgatcttccagttcttccacgaagacgccatggaatttgcaattcacagaaaacggaacatggaattcacattcatgattcaccaccaccaccacctgatatgcaccaccatcaccatagaacaaaagaatcttgcagttgaaccgatcgatcgatctcgcgtcgtctagcatggccgcacgaccggcggctcagccaccgccgccgccgccttgggcgccgcggcgacagcggcggcggcggtgttcttcctcggctcggtgcggccgagctggccggcgccgccgcggccgccggtgacgctccgcatccggcccttgccgaggtggtgctcgcagagggagtagccgaccagcgtcggctggctgcagcgccacccgcgcccgttcacgcggttgcaacgtgacccctccatcagcaccgccgggccacgccgcttcttggctccgccgccgccgccgccgtcgttcttggtctcttccttcgcgttcgcggccactggcattgcccggacgacgccgttgacgagacgctctcctgtagtactcctgatcgccggatcaggcttgctgtaatggccattctctaggctgcaaaatgcaagaacatcatcgagtcatctgtcaaccatctgacgaacaagcagctacagcaatgaatccaacccaatgcaatcagagatgcagcaacttatgatgccaaacacaagggaatagttcacgacgctcgcgacgcacatggtccatgtctgccgatcgatcagcatggcttgcacggttgcaccaatgcgatcatggaagaggacaagcaaaaaacaggctgtaagagaggcgatcacacaatcagccatagaacagccatggaagtggccgatcgaagatgccaagatcgagggtgcaagagcagtagtgcgctggatggattagcagtaaagaagccaagaacactagtagcagtagtacatgcctacatgagcagggccgtgtattaaattggttggattgatgtgtgtcatgtgtcaagctggcattgcccagtataaaacagtaaaaaccaagcccagaagatagaaaaagtcccttggatgctttccctttccatttattactaccccccactaccgctaccaccactactactgtcactcacacccacacaaatgacacaaatgacacaagttagcatagcagaggcactttcttgttttgttcctgttccagtttcagttgttcttcacatacctcctgtgaccatctgctgctccctgctgtgcaccaccacggggcctgatcttgctgcattccacaaccgcattgtcctggcaaaatggcatcaatccaagaacatgggggggggggggggttagttagatagatctgggcatccgccataaacgggtgtggtgcaacctatgatgatagtaactagtaacaagaatcattcataatggcaagtttcttgttttctctgtcgttggagcagattgggatcaaagggggtagtgtatacctgcgggaacaacggcaatgccgcggccgcgcgcatcgccgccgacgagtcgtcgtcggcaagatccgcatttgggtgcaagtgcaaccgctccgacttcttctcctcctcatccaccttgtctaccgagagccagtaacgtccatggtttcttggtggaggctggggagcagtggatggatctgaggagggatgcagggaggagagagcctgcagggactgaggccgcctcctgatcctcatggatggatgagagagaaagagagagagaaggggagaaggaggagagagagagagagagagagagagagggagcaatggagatttggggagggtgcaaattaaaggaggggggctttggggtgttggttccttggttttggttggccttttatgcctcatggatggcatttatttatgggaaccagtaagcacaataggagtagattggtggtgcagtttttacactttgcatatttgcgcattgttgccttgattggcttttggccttttgggtttgggttggtttggctttggcctagtaggagatgagatgagatgggtgcacttatcaagactccacaggtggatggatggatggatggatggcgtgagtggtgggatgggtttgtttttgcatgcaatacgccatgtgcattagaactgttgtataggagatgggatggagaggcaggtgagatttgtctagtggacagtattgctatgcgtacaaatgaacaatacatgtgggggaaaaaagaaggtaggtgtacatttctagatctatggtttgtggttttcagttggcatgtcttcgtttgaggttccaaatgggggaggtaaagactgaaagaagacttgtgtgtgaattggtgtgatggatgtcttacaaataaatgtttgcataaaacaattttgtgcatgcgtttttatatccacatggttagccttaactcgtgtccgtatttacgtttaaaactgttcgttgattgtgagtttgattatcttccttaaataacactttatcctagcacacttattatgattatgagggtaactctagtattggttcgacatgtgtggtccatccaagcaaacaaattttcggttagatcgtggcagcgtgaaaattgatttgtgggacccacataaagtcaatctcaatcttacctacatttgccctccctcttgtgtgaccccacaaaaaatatttttaattggttacgatcacttctcttttgaagtcaattttattaatgatatactatagattctcataatatgcgcggttggaacttttggtgcaaggttcaatttcagtcttacattggagttactttgatgtgtatacacagttagtatattattttttgaaaagaaaatgttccataatagtccaatagccattaggatttaagagaaaccaaaacacgcaaagaaaaggatggcaatagcaacttttctctctcttttttttacactgatttctctctctctgtataaagggatcgaaaacatcgttttcaatgggattttttttactatctaatagtttgctaatgttattttcttttctttccaggtaggcggtttatcgcctaatcttgttagaggatcctggtgcatgaagcggggttgcccataatcgtggaattatccatgatgtggaataaatgatactcgcccccttctctgaaatacatgctattcaacacaacggtcgaactccactaacttctattttatgagttatttgtgatacacaacaaaattatgctatcacgaccatactcatttctataggaataacatcgtatatgatatttccatgtgtctaacctaaatattgaattcttgttttttttttaaaaaaaagtcaaatacaacgatgtattcataatcagagcatatagatctagaccactcacatcatgcaccagaaagtataaacacacaggcgtctacgaggcaggtcggcatggccttcagacatggaccatcagatggttcggttctgtgaatcgatatgcagctgatgggcaaccatctgatgggcatttgggacagaatgcgcacatctagatcctgggcgcacgtcctctgtcggcatgcatgtacaggctagtacaggcagcacataatgctccaaaaacccagctagctaaatggactcaccaacagcagactgctaattaatcagacaccacgtcgatcacatgcttgcaaggtagtactagcagtatacccatatatatagtccataccaaacaaaagcttcagtaaattatcggcattaattcattgtccaatcagccagaaaaaggtatgtttcgtcctcatgatccatgtataaacccaaataaaatgcgtatttaatttcataccatctatttaaagaggcgagaaattaaacgatgccatacgacaagggaaaggaccagcaagaatgccagatgcatggtccatgcaaaatcaaggtaaaacaccactagcagacaatagcctgctttctgatttatgtccccaaccaaagcgtaaacaacgtttgctacagactacagtgtagcaactagtacgttcacatcaactgcaagcatttttccccccaaaggcgaaaaaaaattcagacggcaaatgttgtttacgatagcaacttctgaggcttctacctgaatttgcaactcgtctagtagcaatgtgcagaagcgcattctgaagcttctacctgaatctgtgactcgtctagcagcaatgtgcagaagctcatatagtcatattgctacagcctacaggcctaaattggaatatgaattaatgatgagctgtttaacagggggtacttctcaatattcaagagagataacagctgagttgaaaccagaacagaaccatgcagcaaaatagtacctatgcaggatctcatcaaagttgaaactgctatcatattcaggtataacagctgccgtacttgcatctgacagatttaaccgaaacttcagtagtactgaaaaatctgttgtacaatcatattacctgacaaacttacttacaaagaacttaagtacgaatatacacagaacgaaacaccaatcattcaggattcaagagattgaggtgtcaatacaactatttctctatactttaatatatccaagaagaactcaaatgatactacatcaccatgctaagaatgtaaaaggtagtggtcagataacaaaaatggcagggattcttggaagaggatcctatatataccatctcatgtatgctatattgttgttctctgtttctgattaattctagctagacatgaactttacatcataaaatcctatgagcctatacagaatacgtgttggtcgtatatcgactgtcagactgtgactaactgactacttctctctatgaaaggataccaaaatccttaacctcactcatacaaacaacagctcatgtacaggaacaagtaatcaacacacttgcctttattggtgcaacatttgatgctgttaaccataatctgtgcgtagagaagctcattccaggagtcgggtactccagggaggcaccagtggctgcagtcctgatatatctgaggcgatttcttctcctcctcagtcaacttctgcttgcggtagacagaagggtgtgcctccttcctgtagtcagtcatccttgtgatattcaggtaaacaacaggtgttttcatcccactgagcacgtcctccaggatgctcatcttccgtgggtatggtgtgaggaacttctcatttgttattggctcggtttccttgtcgcaactgcctcctgaattccattggcccccactgcacaatcgaaacacacaataaacatgatgtcagcagctactccgataacatgatattgcacatgatcaaactaaacttgccagaattcagaaaaggttttgccaacctgaaatgggatgatgagtagcctctgaagaacacagttgttttcttgggatttacactggaatcaacccacttggcccaggtaataagagctttctggaaggcatcatcaacattcagctcactgtatacacggttaccctcttggtagtaatctttcctgtgacaggttcaacatactaacagtggtaagcaacacttgaaatgcagaacgcatggcatgcagatcttcagcaaaatcagaaagcaccaattccaacttaccctagagaagttttttcatgagtccaccagtgcccggtattgaagatgatgatatccgcatccttgtacctcgggaaagagttgctgatcatgtcaagcctaagagtttccttggttaaacccttcctgacggggaactcccattcctgaacaaggaaaggggagcggaagaactccacgctgcagttgtagtcctagacaacaggaaatttgcaaatgagcattcattccttatgctgaaattagcgcagatgcaaagcatgagacatgattgaaatgcacaatatacctgaaacaagaaagaataggagccctcggctctgaattgttgcctgcctgacacctcaaagacctttctcttgtccttgacagaattcctcaagatgcaaaccagggattcccacatgttcctgttgagcgaatcaccgacaaacaccagcctcttccccctcagcctctccaacatgtcactcgggttcaatctgttatgaacatcatggaactgaattttcagctgtgtcacatgaaacaccaagaactgaataaaacagagttgctcaagtagtctcaactcaccttggaatgctgcatccgctgggctgccaccggagcctctggtaagcattatcagggcggccattgagcgggcagttgaaggactcatcgatgtgaggacatgatccctcgggatagagagggtatgagtcatctcggacccaatttccatagaacatatcgcagctcgccattgcttcaatccaatgggttttcttcttcttaccaccggcatcgacagcagcctctgtggtgttactagcaatcccctgtggtgtagcatccattgtactattgcttccacctgaagcagcagctctgcttccactcttgttctgatcgagtgcagccggcggatttgggacagtctggttcttgcctggggctcctcctctctgaggcgcagcgccattgccgtccgtggccactgctgcattcccagtcttattgatggatggagcagcagttccattgcttgaatctacgatcgcacttgcaccacctagctggtgagtagacccggcagcatttcttgcattagctttcactgcggtgacatctccagatgaactcgcgatcacgtcggtgccattgatccgatcaggggcaccatctttggtcatcgtgccgtttctggctgaactgcggcttggaactgcagcctcgccggcggaacccgtggtggagttattggctgcggcaccgcctcccgcttgatcattgggcggcgggttgctctgcatcgccgcagtagcgttgccggatggggagttgccgctcggaacacctcccgcattgctgcttgatacttcaactcctcttccctgctcaccggcaacaactgtactggagccattggttcccgcttgcccacccgtcgcggagaacccaccaccaccgctcgatcctcgccgattcgtcgctgctcctccaggaggctccggggaggtggagttggcggggaacagcgaggagaagtagcccgagacctgcgcgcggtagggcgacgcggaggcgaggaggccgtcgaaccacgctgccgccggcgaggagggcggcggcgccggaagcgagggcgcgaaggcgaggaacgccgcgaacgcgccgaaggcgagcgcgaggccgtagaggcacagcctcgcccgtcgcgcgcggccgaccagcgccccgcctccgccgccgaggtagccaacgtgatcggccacgccgctctgcttccacgcgccgcccttcatctgatactgctcgcactcgcgcgcggcggccgcggcgagagctcccgagggtttcgatcgaagcggaaaaagaagtagccggtgtcggtgtcggtggggaaggaaagaaggcgctccgcgggtggagagagtgatctgcggcggaggattttgtagggaaggagacggcggcggcgccggcgcggcgcgcggtggcggcgagcgcgaggtggtgcggcgggttgggagcgaaactaactttcgcgatctttttgggtttggggggatttaaattccgtcgcgttttcgggtttagtaggaacgtgggcgacatgcgcttgagaatcgctcggggaatttgaatttggctgcgctgtcaacagcagggtgtgaaaaaccgccggtaaccgcgcggttaccgcggttaccgcccgtaccgcgggggtacggttacccgtaccgcgcggtacggtttaataaaattcgtccaaattcaaaaatttaaaaaaaaaagaaaaaaatcaaaaaaaatagtgaaggtagtgcttgatttatagtgttttatggtgaagaaatttctcaaaaaagagtaatatttattcaaatttgagagcaaaacggagaataaatttgaaaattggaaaaagaaaaaaaaatgggccggcccgttactgtgcaacccattacacatcgcgcggtaaccgcgccaaaccgcgtggttaccgcgtcaaaccgcgcggtaaccgcgccaaaccgcgcggtttgcccgaatttttgaattcaaatttcgatttgtaaatttgtcgcggttttgcgcggttaccgcggttaccgccggtaaccgccgtaccgccgggtggcggtaaccgggcccccggcggtttttgaaaccctggtcaacagtcaatagacggcgaatctagaggaggattatggcaattttaaataatcatcactgcgataattcacattgctagtgtacgtattttaaaagaatcttacaaacaaatatctcaaccattaaatctaatcaattgctggttataaaaaaattttgtaaggatttcttttagttcgtgtatcattttcctaaataacccccgtgcaatttaggctatgtgaaaaattctagcttaattttacagggaattaaacagcgggatatcaaatttcagctaaaaatgttggttaaataggcttttaatggaactggttagttaaatagtgttcactatatggcaaataccattgatatttcgagatatccatacttacttaaaaaaattaaaaatatttaacaagtcagattaatatgtgatatatcatatatcatttcacaaacatataatatcaaattcgacattcatatattataaaaaaaaggcaaattaactatgaatgtgccaatccatctctggccccctacagtttcatggttttagatgttctagtcctccatttgttctattcattatattttttggctaaattaacgtaaatatataatcccttatattcatagacagagggagaaactactacacgtatattcacaatatttttttacaacatataatttaacttgcatatttgtgaaatcatatattgtaatattccttaccaattttttcataatatgattttttcataactttttagaagacatgtaaagaataagtagatatctctccatgggttaaaatggttcccactacagtggcgttgcaggcttgcgagttgcaatttcagtcaaactaaaactcaacaggcttcttcaaagtttaaatcatggtttccttacataaatcatggtgaagtacagcaagcagcactatgtttgcatggttgacttcctcaaaagggaagaaaagaaacagaaccgaagataagaagataagagtggtacgtttgaatgcagcattatcgcgtgatctgcctccacttggacaatccggggactgaagtgctatttgactgttcattgtttggcaccgccacgtcatctgccgtagtagcactagtgcgaccctgtccgtacgcacttgtacatcatcttctttggcggcctaactagtaaccacccaactcaaccgggtgcaactctgatctgggccgtccatgccaaatctgacgcatgggacgtgatctattgaaatcaatttttttgccataccaaaatgttggcggctttaatagtgtcaaacgactgttaggtcttgtttggtttatttgtgccaaaactaattcaaattctataccatcaaatttggttatgccaaaacttgttggcacaaattggcttcaaaccaaataggctctttatgatcaccatgactacaaactgaagaaggtttgagccattcacaacaggtgcaggcgtgcagcttcagaaataaatcagttagattggatcgtgttgaatgcgccggttaaatgtgaaactccaggtgatctgatctgaagtgatctacttgtgtcgtttaattagcgtgcctaattccaatgggctattagctatgtaagtgcaaaggttagccatgtcgatacatgtatatgtgcacttggaccatccgcacacgcctgaaacctatcaacagattgccgatttctgataggagagggacaagtctgctacactgcctaacttccaagataagattcataaaataaaaccgacgattgcatgcagatcaagttggattcttttcaatttttaataagtttgaaattttcattgcttcgcaaacctgaaaggctgcaaggtgccaactgccaaggtgtccattttcaggtgagtgtctacccaatgacactggggaacagcctaagttccttgactgatcagatgccaactccatgatccagagattaattaattgataattatactattacaacactgtaaagaacgctgcaaagaaagaaagaaaaagattccggcaaaaagtacacggcctgcgaaatagtgaagtcgagcctaacaccacgagacgtgtaagtgtgcaactgaagaagttgcatgatacatagtcgcccgaaaaagaagtgaaatgaactatgacaaatatcgatatttggagagggttaggtactggttcactcgcagttgtagtaggctatctcaagaggattcgatcgtgtcaacaagacatttgcacgtcgcgttgtagcgttggtaaccagctacttcagaggcagtttttttcctctcccttttgaccaactccttgtcatgcacttgtgaactgccgtgcaggtcacatgcctgcgaaaaagagctccactagagactaaagactacagaggctggtcgccactcaccaatgcctgtttttatgtgaaagcaatgagcataaaccttaagatttggcaatggaattgcatgaagaagtcatttgaatcattctttcggtgcatggggcctaatcgtcatcttcttccgtttcttttgagtgatcagattattgttcaccgtagtatcatcataagcaccacgaactaatcgatcatggccaattgacgacgacgagcaacattacgccgggagttcctttccaacccaaaaaaagcttttacgaatttcggcttttcgtaatgcccatttttttccgaacggtcaaacaggttacttgacgttatattaatagaaggagattaagctcattgagctctagcataaatccttgatgagaattgaggccggcttaagtggatcccagcatagtagtactagtactagaacaggaggagaaacagtaacattggaaagggaagatccatggagtacgggttaagcaagggtccgtgccttttttatggcttttaatttctgctgctgcttactgcgggaccaatcaaaggcgtaacaagcatgccggtgaaagccacgcatcctgcatcttgcatgcagctatgcgaggacgtcagttcgtacacaaaagcagcagcagcaacggattgaaagtgttccgtcgtgtaaaggagtaaagaagcatgattcgtacgtatacagcagtagagtacgtacctgtacgattagattagattactgaagcgtcgcaactcgcaagtggtgtacgaggatcttgaattcttgatgagatcttttagttttaggtgcggctactcctaactcaacggtgcagagtcatggctgttcggttcgagcatggctggctatccagcagtttaggcagctttggctgggcgaagtgtgtgatgtgtcgaccgatcgatgaactgagttcgcatcatgtcagctgtcgatcgagtgtccatctgccattgatgaactgcagcaaggagttgagtgaatgcgtgtctagatagatggtcatcaggccagaaacatgtaaattcgatggtcaggccagcaacatgtgaattctgaacactgaatctgaactcccatccgtttcagaaaaatcagaagtacgctttcagaaaaatcagaactacgcgacgtgaggaacgcaggcattaattcctttagagcccattgcctacttttgggcctccggaactaagattgggccgtcggggagacttgcgccgcatgtgacgcagctcgaagg

SEQ ID NO: 6896 - DNA, 4578 bp, Oryza sativa
  unsure (1)..(4578): unsure at all n locations
cgaatcatttggcccttgtgaatctcaactccgaaagtgtccagggtgaatgagtgtatccgtctccatcgtcagcctgctgatactcagacaatgctgatctaccatccctcctttcaaggtgaacacctatgcccaccttctcttccagtcctgtttcttctactttatcctcactctgtcattccctatttacatgaatatcattttgttcagtttcgtagttcaggtcaacattcatgacttcgacaaacagtctgccaccttcatcagctcagccactggggccatcaccatctcctacatcatgtagctactgatctgtaccatctttatccatcattaaaatttggctacaggaggatcgatttctgaatattttctaaacttggctgcaggaggatatgcacaatgtgctttgtacagagggatcgtgatctaggtgtttgcaaagagcatgcgtaagggtaacatatgttttcataacaaaaatatgttgcaattgtacataaatagtcatatcattcaaatgagacatttcaaatcgcaggctatataccattagaggagctcttacagacaatgcacagacaatatagtatttcaagcatcaggtaggctttcagtcatttacgaattagcatttttctttgtgtgtttgctctcagtacccacttggttcttcatgtagattctagacgatttaggtttggcactaatagaactagactttcagttaaatgaatgatttatatgcaggaagatccaatttgcttgataccctattatctgtgtaccattttcagtacttttgttgtacgactgttatacctatcctgacaatgttatagatcattggatcaaatggactagatccttctttacacttttaattctcttagctggtagatcattgaatggttaatatggtcaattataggttgtatgctaacatggtgtatatttgtctgcaggattttttttcttccctttacccatcatcattctctgcggtgaggtattgntttttatttctattttactcatccaggccttctgcaataactattttgatgaaacaattgtagtttccacaattatattcagctctttgtcttttaaaactgaattactagctgtgagctcagaatagcaaagtatttgttgtcgaaaatagagatgatttcctacagcccactaaggagtgatagcaggatagatgtggctcttatgtattatggtgattcaccttgaactaaaaaaaatatttgtctagacaattaatgcctcctatttgcatcaatgaatagtcagtttaaatgcattgggtatattcgcccagttcattgtattgccagttgtttctgaatgttacttatttagtttttcaaaatatgtagagtaaatgacaccatagtgaaaattttccaattcaaccatatgctcatccattttcttcccttaaacgtggaaaacacttttactggcagttgcacttcaaagttttagcgagaaaagttatttcagtatctcaacttggccgttccttttcaccatatagttgatagcttgatattatagagagataacagaactcgccaaaagcgttataattttgattgaatgcaagataactgtagtatacttccctatgggattgtaaaattcatcattgcttaatctgtcaaccttcaaatcattgtcatcggcaagcatagactaatcttcttttgttttactgttataggactactagggagggagtttctgcggtaatatatgcaacaccaagcatatccgatatacttcccgtcagtgcaggagagtagtttagaggttgcataagtgcatgtcattgctggagtgtaccagtataaaatgtgctgaaattatttcgtagctaataaagtaaatttacaaccttttgtttatacgggttactggtaattagtaagtctctctgacgtgttccggctgttatgcttaattccatgtccagtttgtagttctgttggaccttcaagcaattatatattggttgttcggtgacatcttcaaccggcgcagcgtagcgcgccactatttctagtttctctgaaacacgatgcattgagcacaccgatagagagcagtgatcgggaggtgtgactgatgccggcgtggtgatcaggaggtgtgactgacaaggaagtagctcagggtaaggaggttcggtgcggcgcgtggcctgcttagcggcatacaaggacaaacctgagcaagaacaacctattggagcaagggcaccctactcggagcgggggctgccgaatcagagaagccatggttgtcatccaggctgggccctcccttctcgccttttcccccgagctaccaaggagcgacaaagaggtgtcgggccaggtcgccaccgcatatgtgatgcggagcgcatctcgctcatggaggaagatcaggaatttgcgccaagctgggcagcgtgaaacaagttgatacggaaactatgatatggcgatggcaccactgcttgagcttgagttccgccgctaccgtcgtagcacccctttctcatcntctgcttnctccgcatcactgatagccgcgaccccatcctttccagcccgctcaccatcaccgtcgtcttcttgtggatggcaagtgagctcgagcttgctggctccttctccttcaccatcgtggactactcgaaccccctccgccaccaccgctgccgctacccatggatgggctggccaaccgctgcccctctccctgctaatgagctcctgaaaaagagaggggatatgtggagagatggggaagggatgggataggtgaggagatccggaagttcacttacatgtaggttccacatgttttcaaattttctttttactgattaggatgccacgttagtcaaaacagtcattcatattgtcctacgacattactcgggcagcttttgttaggatgggagtgaatatttttaatattgcgatatactccctccgtttcagattataagactttctagcattgtccatattcatatagatgttaatgaatttagacacacatatatatctagtttctttaacatatatatgaaggtggataatgctagaaagtcttataatatgaaacggaggaagtagtgataccaactaaactcgaaaagatgaggggcggcaagtagacttatttccgctggaatatgctaccggatggtgctaagcccatgcagagaaacttgaccgagtcgcactaaaaaggaataagttcacttcatgacccttaaaagagacccgaatctaatccatgaccctaaaccgcaaaaccggatatcttcacccccaaactattgaaaccggtgcaatttgactcccttggtggttttggatggcggtttcgctgacgtggcgctgacgtggcagtgttgacctagtctgtgtgctgacgtggcgctgaggtggcatttcactcatttacatatatgtggggccatttcggcattcacacacacaagattgtggggccgactaacctgtggcccccacctgtcatctcttccctttcttcttcctctcgaacctcccctcctcctcccttctctctttttgttctacctctccacttcgggcgtctgcggggagcgagcggcggtgggcggggtctgaagcgacgcgaccggtgggagctgaatcggcggcggcggcggcgtcgagagctagctggagcggcggcggccggagctagctggagcagcggcggcggcggtgggctggagttggcagcgtggggcgtgggccggattggtggcggtcggcgagagctgaagcggcggcgagctagagctacgcgagagaggacgacagcgccgacgccgacgagatcgagcggggggacggtggtctatgggccggctacagcttcggatccatccgcatcgccgggatcagagctcctcgtcgccttcctccaacacctccctgcatccatcctcgcatcgcgcgggacgtcgacggcggcggcgggcgcgggatgtcgacggcggcgggcgcgggacgtcgacggcggaggcatcgagcgggttgagcggcggctccggcggcgtgcgggcgagcgcgagtgcgggaggaggcaccggcggcggcaggtgcaggacgtcgacggcggcggcgggcgcgggacgtcgacggcggaggcatcgagcgggtcgagcggcagggctccggcggtgtgcgggcgagcacgagtgcgggaggaggcaccggcagcgacaacatgagctcggcggctccgcttctcccctctcccttccggccctcacgcgccaccgccgcctctcgtgtaacccaccacctccgttcctccctcacgtgctctcctctcctctcctctctccacttggcaaggctgatggcgaggctaccgccgccgccgccgctgccgctgctctggcccacccgccgacgatacagctccagccgcccgtgctccctcgcggccagccaaaggggagtaaagagaaagagaaagaaagagagaagggaggaggaagaaagggagagagaggat

SEQ ID NO: 6897 - DNA, 5022 bp, Oryza sativa
atgttaagggcgaaggcctacttctggaacgtgtcgaacccggtgaagatggaggagatcgactccatggagaagctcgacgacgcgctccggtggtccgtcgagaacaagcagcccatcatcatcgactggtatgatccgcttttgcctttccctgtttcatttttctgatttactacgtgagcatccctgattttgccagcccatgaattctctctgaattcagcaattagaactgcgcttgagtgttacagagttcttagattcgctaggaatcgacctgggattctgcgaccaatgtagcatcgtgttagtttctgaaagttatcattctcttcagaaagtttctgaagataccatgaagtgaaaaagttttgttggaataccccgtttgtcaggttcaaattgcaacgggagtgtcacaagtttaactaaaagacatgtgattcctttcgaattgaagctttttgttaaaaatttgtatcggtggaagttccatgatgaatgttgatttcgaaatgggtgactggctggaatggcccacttggcccacttagtcttaagaaatgtgctaaaataattcatttggacccacctgaacgacttgtgattgttccatggacttgtgaggagtgtgatcaataattgagatgttgttgagatgaatgtctattttctttatcagaatgctagtcttcaaccattccctaaagaaatgcttccgcagatgctgaggttctcttaaattgttcttgccaggatggctagttggtgtcggaaatgcatatatctgaagcccagactggagaagatagcaggagaatttccagggttggtttaaatttcatcaaatgtttgtatgtagggctgacacaattgacaatatgaattcaatcaagttatagaggacagccttgcggggtatggactgtgagtgtcccattgcttcactcgaattaaaatggtatttctcatttcttttgtagagtcaggttctactttgtcgatgtcaacaaagttccacagactgtggtgaaaagagggaatataactgtgagtcagcaaattttgagcttgtcttttttttttctgtattaactgttgattcagagtgactccaatacttatcttattcattctcaatttctgtctttccacgtgtttggatgcacttctatcttcagaaaatgcccactatccaggtaactccacacttccttcacagttcattgtccatataccaaaatttgtaaatatctctcattctgcttaatataacaccagcaattgctggctttggtttcaaaaaaaaaaaaaccaaaatttgatcttagagttctcgttcatgttcagttatggaaggatggagaatgggcagcggaagtgataggaagcccataaagcattgcttgtgatggatgagggtagggaaatgatccagaagcacaagtgactaactacctaaatcaagcaattgatatatactgtaaatagagatttgagatgatctcttcagatattaagttgtaacgagatcaataattaaagcaatattctctaatatattgacgtgcaattcttttgtgcgttcgcgaaaaaaaaataaagcaatattccagctcctactagtgcaaactctcaatccaatacttcgtactgtatagtataatactcctgtattagcatgtacataagaacttcagatttacgccatctgaatagtatacttccaatttacagattgaggaaagcagacaaattgtaaagaatcaaataatccaccattcagtattaacttaattcaatccacatatctacaagatccactctaataatctgcctctttcagagcccagttcccaaattttccatttccattaatcacaaaccaaaccaacccatgataattcaggtttcttcagagtaaccaaactagcacctagctggccagagcccagaagctagcactaaccgcttcaattaatcctcgcggcggctagcccagcggcgcgacaaggtcggcgacggcgaggacgacggcgacggccagggctcgtcggtgccgacggggacgtcggagagcggcgcgaggaagcgcctgacgctcatggaccgcatcgaccggaagctcatggacgacctcagcttgccgtccttggagaagacgctcgacgagctgcggaggatgaggtagaccagcgcctgcaccagcacgaacacggcaaccttcgtcaccgcgtcgcggatctccggcgagatcatcaagctcgtcgcctcgccgtccatggcgaacagaaggatcaaagcttgtgtgtttacgtgtatgcgcgtttgagccgtgtgggagagatcgatcaaagcttgtgtgtttggtcatctcggtctccgctttgctcgctttatatagactcgagccggactgcatgttgtttcggattttcttggtcgtgtacgcaagcggtgaagtgtagtatttttgtttttgttttttgtttttcttggtgggggatagcttcgttcatttgattggttggatttgctttgcaaggaaggaggtggcgagctgcctgcgagcctgaaactgtggaaaatttgtgtgtctgcgatttggtcgatttttttttattgtcgcgtttagtttgtctgatgcggcgtcgtttatgctttggtgtttgattattgggcttgatgacatcggttgtgtctggagatgcggctgctaagagtgcttggatggcttggataagttgtcatctgaagaaaggggaagcaaaggtgacatgcacgctgacatggcgtcctgaatctagataatgacctatcgcgtctacttgttttaaagtaatcactttcttgggatcaaagcagtggtttactggtttataatatacagacgtaattaccaaattagatcgagcacgtttcgtttgctgcaagccttggtcgattaatcaacatttcttcgtaaacggaaattctttactgaatgtttatacagttatgtcacattaatccttgctagattttctttttccttaatgaaacagaaaagactgtaccaatattaatccagtggcatagagtaaattctcctattcccggttgcattctctcgttccactatcttccctcctcttttctgcaagggtttgagtgcgcttcttgccatcatctccattgacactctccttcccagcctcgatacctttctctcctaacctacggtttccgcgcctgaccctttttccgcgcttgcagttgcagctacatcctggaacacgtagataagatgaacacgtagtagcacttgtgtttgaccctgtcactgtacctaattttcgccgcggaagatcccacccagaatattttgaaacaaacatcaaccgctgaaattgacccaaatcatccagaaaacaacagttggaagagaaaagtgatgaacttttggtcgaggcgtttcatactttcatctaatcaaaatttatcttctcttctagatgcatacttggactgtccagaatgcaaccgaattccaagccagatgtcacaatcttctagccgttttaccttttttttttcgccagaaacttctttggactcggcattccatgtgccaattcgattgggttcgatttctcaggaggaaatagcaggaggaaccgaggaacgtgcatgcatgtaattcatttaatttcattcctgccgaattatcatcaccggcatgaagtccggcaccgactagtagccagttgacagcttaattagaatcagagacagctagctcaggagttccagctagctttgaaccttgactcggtttgcaatggcgaggttagccaggcaaatgtgcgatggccggagtgggtcaaggcctctctcaataatggtcagccagcctcggcacagcttgacttgtgggaagagatgcgctagatgctataaacgcttgaaccgtgcacacgtgcagaacgtttgtgttcggtgtttacatacacggtgccggtgcccatgttatcaatcagcaaggttctacacttctaccgtagaagaataactaaagaaatcagtattatgcattgcatgagataaagagagttcatgaaacagagcaaaataatatttactagtaggcgtgcaaaacggaaccgtgattacctaaaatgacttgttttagagtcgagatcctcgacttgtagtccaaaacagcaccaggctcagcacaagcaagcaagcggaagccagagaagcagcatcacttccatgcaggattcattgtactcatgagtgaacagggtgaaaaaaaatatcacaatatcacgtccagtttgcgcgatgtatcgcaagcaaaaggagccaatgcaaccaagtcatgcattacaacccaactagacaggcctacgagcttaggtgtgttttcgtatgacaaaacttattacaacgcgcaaggtcctagtatcccggtctcttccaaaaaactactagctgctatctctaaaagcagggcaactgttagcacatgcggtttcacttcttgacctcctcgtactcagcctctggagcctgctcgcctccgccctgagatcctcctgtctctgaaccgcctgcgccaccaccaccaccagacatatgctgcccaatctttgaaacagccttgttggccgcttcgatattggccttgatcttctcgatgtcatctgaggtcatcacagagcggagatcggcgattgctgtctcaatctcagtggcaacctctgcaggaatcttgtccctgtactctcccagacttttctcaacgctgtaaatggtagtgtcagcgttgtttctgatgtcaatgagggctttccgctcctgatccttctgagagtgaagctcagcctcctggaccatcttctgaatctcagcttctgagaggccaccggaggatcggatggtgatttgctgctccttcccggtagacttgtcttttgcagagaccgtcacaattccattggcatcgatgtcaaatgtgacctcgatctgtgg

SEQ ID NO: 6898 - DNA, 67208 bp, Oryza sativa
caatcaattgaatcttagttgatgaagaaagatgtgtatgacatacttcaacacaacatgatcttaatcgcgaagattattaaatatgctagcttcaattaatccagcccacaatttttagcgagctaaacctcaattaattaaggccccatcaggaacaggaaatttataggatcactgtatgaatagccaggaagattccacatgagattctcaccaaaatctttgtcgaattccttaagtacgttgcaaaatggggcttagtggaactgcttatcaaacagaaacaagggttggtgtttgtatggaatcagatttgtctgcatcgttcaataaattccggtgactatgcgcaagtgaattgccacagaacagcaagctgacgtcttcgtagtatatttatttggaatcgcagatgttaactatctttctaaaactttgttaaagttagagaagtttgacctacgacaaaactaaaaccaccttacattctggaacttgtaaaccaccttacatactagaacttctgaaacagagggactgagggagtagctgacacaagaatgggcaaaccaacccctggtctgtaccaagctttccatgcaggaaatgggtaggtttgtgtttgctgccgctttgccatcagtctcaaagttgaagtaggtatgacatgcccccggaccggcaattcaaagcacctgttcatctaaccatatgatgtttcagtaccacagttcatagggtagttaaagtgacctttctcctgatatgacagacactaatagtagtaagcctcttcaggatacttaggccattcacaatacgcctccgtggcgttcagcctcagcttgagaaacagcatattctataccacgtcgatcgcgttcggagccttattaggaacgcgtagcaaattttggtcacccgttcttcccactaaaagcctgaaaatgctggcgcagtgacagggaagaggggggagagtgtgaaaactgcccgctccgctggcgccgtcgccatcctcctcgccgcaccgccgagcttgtcgccgtcctctccgcaccgccgagctcgtcgctgtctgcgccgccgagctcatcgtcctcctctccaccgtcgctcttcctcgtcctcggagagaggagcgccggagaggggagaggagcgtcggacaccaccgctctgccgccgctccggtcgccgcctcgctttgttcggccggtggagaagggatagagcagagagagagaggagagaaaaagtgagggtaggtatatgcactgtggaacatgtagctaacaatgttcctaggtgttcttgagctgagttgtatatttgcaatgcattgctaatgcccttacgatgcagtcaccaaagaaagaattaatgtatataataatatagtaacctcaatttgcagagttgaagtgtcctttacaaggtaggagtagcatcattatacaggccagatagcttcaaaagaatcaatctttctgacagatttttcatgttaactatgtgggtcataatgtacatggatcaggcctctccttgtctgtggctggacactgcaaataaccatgcttggtgtccatgggggagaggttatccttcctatctactattgactgactacaacctgatacaagttgggtacaaaatgaatcgacgactaacctcgtgatagggacagagaaaaaatgggttatgaatctttacttgaaaactattgtggtggcgatgcttctgaattctgatcgctggtggttacattgaaaaaaatcaacaaggttagctgctgcctgtcaagaggaccactgatcggggacggtgaggaagtactttgacatggctttcctgaacctcttcttgtactgcatcggagatatgacggtcggggactcgttcttggggcctcccaggatgcctgaagctttcacccaggtctcgagctgcttgtcccaggtgtactggcgcaagtagtcaataatgccaatgacaagctctttcttctcctcgtcgattccaacaagtagtgagtaatccatgacatccgctgtctgcaaagtatttcaaatgattaacagtcattttcagtaatataaaatgcaccaattcatgaagttgtgcagttttacaagaaataagtattttgtgcaatcccttgtctgaaataagaatatatatatgagatgaattatcaagattaatttccataacaacataccgcaagaaaagaagtgtcattccaaacggctctttccaatcttcgttttgccttgctccctaaaaatattggctttgtatgcaatgcctctaggaggtttgaatccaagaggactttactctcactggatgtatagcgtgagcgcaatgaaccctttagatcatagactctagatatcttcctttcaaagaaaagattctccatcaccatgaggtccatctttacttccctaccaccttttaagcccttgatattaacctgaactcaagaaaaggcagcagaagttagaaccaggggaatactctatacacttcattcatcatcagataaatcatgcaacaagaagaaaacaaacctgatatactcctacgattttggccaggcaagttggactacctgaagtcagggattccatcaaatatctgaagtactgaggagcaaactctacaaacgattcaagctctgtcctggtgacttgtttgattatgaatctctcatcaagagtctttgcaaagtaaacattgctttttccaccttgcgcattccatctcttgcagcggctaagtgaacggatgaaatcaatatcctttgggcagcatttcttcctaagtgcggcaaaatgctttgcgaaataacaagtaatggaaaactttgctttatcttcagaaagtggcgattcatcatcaaaagaaaacttaaagtgagttcccttagaatccaaatggtcttcttgtgagagcaaggtcccgtcaagtccatggctgctgtcaatggcatttggtaggtgtaagaaactcaaacttgaattcagtttgcgtgtgacttgctgcacatattcttgtgaagtcattgcataggacacgatactggtaggctcatcatcatagactgcaatgacagcatcatcttcatacccaatctgaggcaacagcagccgtgccccatcatcgatcatatgtgaagcagatgagatatatgtaagtgtacgggtaagaacaacatttaatttctctactgcaccaggagacctttgagaacaagccctccgtatgtttggcattggatctttcaggatactagtaaaatccccaaagtattcagcagatctgaatgacgacagatgcaatgaagtaggagccaatccattgcgttctcgctggtgtatagcaaatttagaatcaaatgaatgaattctgacaggggttacagaattcccatagcttggattgtctgggaaattaaacgatccatactcatcaattttggtaaaaccttgtagaaggtcatcttgtatctcactagatccagtccatgccaaatcaatcttatctgaaaaaatagatgcaagtgagggtaacctttcaacaggttccttacccattgtagctgtagtaactggctgctctgtctctccattgaatctgcggaaaaccttgtccagatcttctgcatcatccacaggatgagttacaagatcaatctgtgaatttgtctcacccatcctgtattccgtatcattcaagcagccttctctagatagcaaggattttcttggacttcctgaagattgcgacaaatttgtggattttcctatttttgtatcccccacaagcaggtcagctttccactctttcagtctgacatctaagaaaatatcaggatttgaaacatgactgtcttttttaaggagtgaatctatgtaacaaagccttcgatcccaaatgtaagcatcaaggagaagaccgcgtctcaagcggttgagctcaagaacatcaatagagacctgcacagaatgattgctatctgtaataactggcaacagcaggatctgcaaaacaaacaaagaaagagacagggggtcaatattaagataacataaccttttgtttaacctgaacgcatacaaccaggaaaatctcgttgcactacctcatatccatttctttccattttaagcaaatctttcatctctatgatctgcctttgaacacctgctttcaccggctcatcctctgatgtaacactattttcattatgatgaagaaaatcatatacctctgaatgtaaggtctccattttgctatatatctgcaaaagccaaaagtcaagtatatgagtatcatattattagtaagttcacagcaaaactatatgatgcagtctatgaacatggtcatcataacttagaaaaattgcatacctcaactgccatccttctcatccaatcttgtcgactgcggcaattgaaatccagtactgaggggggtaggttaactgagagaatatcaacaggagaatatctgaagaaagcaaccatgtttccgtacctggatatttagcagataaattgaaatcacattgaaggattgagcaatgttaattggtgaaggatacagcagatacatacccatagaaacgaaggcagtctctctggagagaatgtccacaacttgcaactcggttagcagtagtatggtttgaaaagcttagctccaagaacttcccaaacgacagaccccaagctgcatctgacataattaccctccgtgtggcaggtggtacaccatccttaggttcgcacttgaggcatctatgccacatccatatcctaccatcacgttcacctggtaacttttgagacagaagccgccgaacactaattgttaaactcccatgctgatgagtatagcacctgacatgtgattctgatgactctttgcatgacgggcagcaatatgcctttgcatgaaaaaaaacatttccaaaaattatgataatgataagaaggccatatgatagtgcacatacggattgtacaggaaatacctgatcaaataagtcttccctgaggtacctcccaagtggcttatcaaagctaccataaaacttgatgcggaagagctgagaacgctcgcatagcatgcttttggggatacaagtgcttgaaagggaaactaagatgctctgatggttgtcagtagcaggaaaatattcaccagaaagctcattcgggccatctgcatctcccatcaaataatcatcatgtggtttgggaccatagtggtctacctcttgaaatttctttcctgaaaccatgccttgacggtcatcatttatgggaagttgtgtcgagtcattcaaatactgatattgcatcaccatatctgaagttctaatgtcatgatccaatgaacatggaaatattttatgacctttgcatgattcagttgcatggaatgaatcatgatcatgacaattcatatgttcaacaggaattttagattccctatgctcagagatgaccccctctccttcctcattcaacgataatgagccaggtgatatagaattttccttaaacataccattgactctagtagcttctgaatgtttgccttgtacaggtttaagtccatgaggaataccaacaccagcagatccagcaaaatagttacttgggtcacttcgaatatcatttaccactaccattggccttgaaggaaccttgggaagagtcgcaccttcatcagcaaagaatgatgtttcaagagagaggtgataagctgcaaacacagcaagttgcacaacacgcttaattttctttagttcctctcgacatgatcctctcagtagaacctgcagaagttgaggtacattgattagaaatatatagtcctttgaaaagaatgcaatggtgatggtgaatctgacaccctccccctacaatgtgtacaagctgattttacaattgattcttagttcccgttgtaacagaattgtgattatgtttcagtgtattcaatggaaaaatcatttcttttgaacaggaatgattcatttttattcgtggcaaaaaacgggcatttaactagtgtaaaaggtaaaatgagatattcaattgaaaactaattacagaaccagtgctactactgcgtatgattgaatatacaagcaaggagttatcaatttatgttagtgaaatgaatctaaatggaatatttagggaacagaaatagattattaccgtgcaacctaaacgcctcggacagccttcaaagaacatcagggtcttcattgacctcctgtttgtctgttttcctgatgagaattctgaaactttatgcaccttgaacaattcacattgacctagtcttgctgaagcaatattgtcaattgacgaggcaatttgtgctcctgagcatcttgatatcctatccaaaagcggtctcttaacattcagaactaaagaaatatcttttgccaagagttcctgggcataagatgagacacttttctcaactagcagcacatttggtcgccgagactcaatctttgcaacaattgccctcaggtgctccttttcctgcatcaatggtatttcattcagcaaaacaagaaacaacaaatatatgcaacacaaccatgaagaaaacacaaacctgttcaagtatagtatcaatggatgctagtttgttcgtgaccttctgatactcaagtgctccccctaaaatgagcaattttgcattcacatgctcagaggccatgcgtttgtgttttacattcttagagcaaaccactcctctaacaagattgctgcataaaaggaacacccatcagtttcatatgatggaaagtacaaacatgtaaaaaccagtcaaacaacaaagctaagaacatacctatcacttggatcccctgatgctaaacatttaactttcacataatcagtaggatccatgctgccacctttcttggtatctggtctcacatagccagcagctagccaagctagggaggatactatttcaagccagcttttggatccattgtcattttccagatcaatacattctcccttaagcaattgagccacaagagcccggaaatgcccaagtacagcattcctcagaccctctttgtgagctatgtctgtgattgtgtcaacaccaactattttgttagtattaaagttaccaagagcaagaagcttgcccgagtccccagcctcatcatcctcgtagtcgaatccaaataatctcgcttcaacatcgtcaccctcatcttccggtgatggcgggagccagacattggcatcgaaatcagcaggataacgggtcatgtcacctccactcctgtctgcgatgccaccgttcagcctggtatcgcaaccaagagaatccaggctgaggcgctcgttcctcttggacgttggcgaggcgtcgttgtgccccaccatccaagtcgggctctccagagggcttggtgtcaaggacctggcgaccccgttaggagtactgacgctaagagagtctgtatctgaaaagtcatgtaagtagtcattccctggggtgaaaaactgtaccccgggctcatcgtcgtcctctccatcgcctcgcctgcatccacgaaaacaagtaccacaacaaattcagcacaatagtatttgcgaatcgattacaaagcagcgccggattaacaccaacaagcatacatgaacatccatgagtgctacctgcatatgttgcataatccactacacctaaattagtcaataataggtggtatcaccattcaccaacaccatcgaaaaggttagatgccatgtaagtgattacttaataataataataataataataataataataataataataataataataataataataataataataataataataataataataataataataataataataataataataataatatcgtaataccaagcaatctctacctcgcttttccccttttcctccatagcaagccaaggaagaagaagaagaaaaaaaaggaagtcgtggtagcgtaaggagggcatgagaaggcgatggaaatggagggagtacctgacagcgtggcagcggagcagctgcggcgaggagatctggcggcgcagggcgatggcgcgcctgccgcccccgggcctcgcggggagcggcggcgtcgtgtccgcggcgccgctgcgcgatctcgtcggggtcgcgggcgacggcgggccgctcgtctgccgggccacctcctcgccttcggcggcggcggcggggggcgtggggccggcgatgagggatctgaacttctgcaccgcccccagcaccgagaactccaccactcccatcaccaccaccaaaatatatataaaaaaaaactctagaagaaccacgccttggctcgcgtccgccgaggctaaaatccctcaccggcgacgacgacgaaggcggcggcgggtatatgtacagggttcggtttggttagtcagtggcgaggcattagggggtcagccaatgccggactggtcggggggcataggtcaggttgcccgtcgctgcggtggtgccgggttacgcgcgcgcggaggcggacgagaaggcggcggcgatggtgcggcggggggtgccgtcggagagcatcgccggagagagagagggaggtgggggtgcaaacgcaaagcgatggcggaaggaaatgaggggaaagggagggagggaagggggggtggttttaattgcggggatgaaggacggcaattcttaaggcctcttgcgtcacaccgaaacacacaaaatgaggcggtatttattgctcatacatactctctctgtccgaaaaaaaaaggcaaaccttatgttttttatccaactttgactgtccgtcttatataaattttttttataattcgtattttattgttgttagatgataaaagctcgtacatgtacagtgatacccgcgaatactttgtttaacccattcactcttagttttttactaaatgacgccgttcattttaactatttattttactaaaaagtttatatatttattatttattttaatgtggtttaatttgttatgagatgttctttcagcataatttaattttttacataagaatttttaataagataaattgtcaaatattcgttgaaaagtcaacgatgttatctactgaaaagggaggtagtaattgcatatccacaaatatgttctcaaacacacgctctagaatctggtgaacattaaaagcaccccctccctcctttccccttatttcgttccgccattaagaattttctactgttcatatcatcgccttaacaccgtcatatgaatagtcgtagaaaatcatgcatcaatgactactcatatgatcggtgttttctcatgcgatcctttaattaatagtaattttttaaggcatgcacatacacacacttaattcaaaatatattgtcattacatgtttttaatatgatcttataatttttcaatggaatatcttgatatacttttcaaaagtaaatgtgaaggtcaaaaggtaaagtcaacaataacgtatcatgagcattgagttgtctatgttttagtgtgtattcaaccggagtgagggagtttacttgatcaaatacgaacctaatggtacaacggataggttgtcagattaaatagaaaattacgaccctaactgatcgaacagtcggaaaaaaaatattagtacgaatggtctgaggtggtgttcttttttaacgaagataaaaaattaaattaaggcacacataaaaaacaaagaaaaaccattaatacgtgattaattgagttttaattatttcacacttaaaatataaatttatttaatatttaaaatcaacatgtatatagaaagttttcgtatgaaacgtaccgtttaatagtttaaaaatcgtgctaacgagaatcaagataaaaaaaatatgtatcttaatcagaaaaaaaaacaccaccatcaaagtgtttatttgtatcatgagggtagcatgagggtgtttatttgtatcgagatataaattggtgctgtacaaataattacataaatatttatcaatctccttataattgcactctttttcttatatacaaatttttaacaacagaggccaccatgttgttttcggttaaagaaacatggtgacaattgacaaacatctacttccatacccatcttttttcaaataaattaaatgtataaatacttcaaaagtattttatattaacgaagcatgttgtatcctaaacattgtcatatgatatgtctaatcatttaaaattaggtgatggcaaaagttaaaagtataatggtcaaccgtgacagttattacttaaggccggaggaagtataaagctaaattcacttaacgggaaaagaaatgtctagatatgaattctgcattacaagtcacaataatactaatactaatatttatggttggaataatttattttctcgttccaattcgtattgcatgatcaaacgtttgttttcgaaaatgtgtacaatactaatgtttttaatcttcttaactagtactatttacaatgcaaatgcagtgccctcttgattatatccgaaataacttaaccaatggatcaaccaggatttattatttatcaatgaaaattgcatattctgatacatatggctgctaattttatttttgggtggtgttttcaagtcgtgttgcgctgccctcaaaagacatacgtatatacgcacatttaaaaggggcagtgtatacgtgttaggaatcaggagcaaaattaataaatacgactagtcgtcgcaaagtaatactcctaccgtgacagttgagagaacccaattatatgatgaaatatgggcaccataatttctatggcccacatgtcagccttaggttgagttaatttcccagctttcccaactcacctcttacttttccgcgcaaacgtttttaaaactactaaacggattattgtttatataaaagttactttaaaaatcatatcatttatttttaaaaaataattaatacttaattaattatgtgttaatgagtcattctgttccacttacgcgagggattagtcccatccccaggtactgaacacagccggaggattttataacatcaaagtatatttatcagttaagccgaaagtggatgtggtgtgtgtcatgcatggtcggatagtcggaggaccatgtcaatcttgtgtggctaactcatggattgtcggctaactgttgtgtggtgtgaagcgagcgattttattggggtttaataaatactcctgtcttttcttaaattgttagggtgtgtgcgtatcacaatctcacatcattaacatattatatggagtaattaagttttgttattataggttagaaatataatattcccttcatccttgtttgataatcacttaagaaaaagcgcagagattagggacaataaaattttcatcactctgtagttaattcttatcaattaacatgctacatcgctttttatcccgtgaattgtatagaattttaaatatttacaccaatataaattaatcttaggtagctgcatgtagcacatttaatgatgttcatttactctttatttactctttgtccaaataaataaagagatacttgatagagaataatcatttggggaatacctcaaaaatcttaggtgataatcaaaatggaatagagggagtacttgttaatttgtgttattcttaatttttttttataaaaatatgattatgaaagatacttataatcatgtgtgcgttaaaggatatcttatacgcaagttataccataatttaattgaaatttggtacaaaattaattcaaatcgaaaggcataaataggtttaatttttattgaaatattactattgattaatttgttaagatcggcactacatatttaataaactctgaagttaatcttgcagtaccatgtaaaaaaaactatctccatcttctagtaacaatgaagcactcaaaccgattatctactttttttttccaaaaaagaaagttaatttacctaggtatatacaggatgtagaaaaatatggtctgttataaagatcagtatccagtcagtaaaaaatgaaaaaaaaattaattagccaggataattatttcaaatgtgtgtggcagcccttgcataactttactctagagtcaagtcatggtactactaatttatctttagttcccacaagtcatggtagcgttgcataacgtaagtaaatcttgcttctttcgattttgaatgtaagttgttttagcacctctttggaaaattagaattttcatggtatttaaactaattcatgtgaaattcctccaaaatttctcaggttcaaacgcgcacttgtgattttcattttttttttcaaaatatgagttgttttgaaacacctaggcacattttccaacttttacttttgagtttgctcttgtcgagttatcaccacttttacaaataaataattaatccatcttttctaatgtagtatgaatggaagacatcaaattaatttgagcttttttaattgattctggtacataattaaatactgagcataaaatggatcattcatgttttctaatctagtaagagcatccctagcagatgctccatccaatcctccatctgagaaatagcgtatgggagtgaaaaatcggcctccagcaaatactccatcggctatgccaaaagtagtggatcgccaaaacaggagagaggaatgccaattttggcgttcctctctccccacgccaaatcgcaaccgccgctctcccgccaacatccagagttcacagcggcggcagacaaagcgggcagaggaggaagaagggaggtagagaggtggcaccagccagatctgggccgggaaggttatcggagaagaagcgccgccacagctcctccgcccggcgactgcccgcgccgttccgcgccgacgaccctgccgcccgtgtcgcggctcctccgctcggtgaccgcctgtgcaactccccggccgcgaccccgccgcccgtgccgcggctcttcttccgcccggcgaccgcccacgccgctccccgcccgggaccccaccgcccgtgccgttgctcctccgcccagtgactgtcgcgccgctcctctgcccatgacccaccgcctgcgccgccggtcctccacccacaagctaccgccgtcgcccctccgctcgtgagccggcgccgagatgctgccccttgcgcccctcgtgagctgctgcttggctggaggcagaaaggaagaggaagatgaaaagaaggatgagaggaggtagagagaggaggcagtgaggaggaaaggaagaggaagagggaaaatgtggaaaagaatgagaaaaaaatagaaatatttattttgttataatttttgttcaagttgtatactttacttattttgctatgattacaaatatattcatttcaaacatatatttagtcattcaaaataaaatccttgtaaaagaaattacacaaatgtatggttagttagataatactccctctatctacttttgatagtcatatttcatcttgacacatagatcaaggataagtaattctacttatcatccatttaaaaatgctactccctccatctacttttgataatcatatttcatcttagcacacagaccaaggataagtgatactacttatcatccatttaaatatgctactagtcattcctcgtaaacaagcgattcattaatatttatatttctcgatgctcatgtagccaatcttgtgtggaagaatggagagtcacgcattaaatccaataaagccattaatatgataagttgttggattgaaatatgcctatcaaaaataaaattttcagatttggaaatatgactatcaaaagtagatggagagagtactagtcattcctcgtaaacaagcgattcattaatatttatatttctcgatgctcatgtagccaatcttgtgtggaagaatggagagtcacgcattaaatccaataaagccattaatatgataagttgttggattgaaatatgcctatcaaaaaataaaattttcagatttggaaatatgactatcaaaagtagatggagagagtactagtcattcctcgtaaacaagtgattcattaatatttacatttctcgatgcccatgtagccaatcttgtgtggaagaatggagagtcacgcattaaatccgaaaaagtcattaagatgataggttgttggattgaaatatgcctattaaaaataaatttttcagatttagaaatatgactatcaaaagtagatggagggagtatctcagatttaatgtgtgactctccattcttccacacaagattggttacatgggcatcaagaaatgtaaatattaatgaatcgcttgtttacgaggaataactagtactcccttcattccaaattgatctacatatttcataggtacaccaaaaccatgaaaagctaataactctctcatactatatttactctagcaataaacttgatgcatgcaccatttctactatttcctagccaatagcaaatcaacatattgcatgtgggttataaatatttgtttgcatggatgcatgcattaatatccatttactccatgcatagataacgaatagacttaatgaatgaatacaaatatgtatgttatttaggaataacctcaaaaacactatatgtagatcaatttggaatggagggagtagtatgtttaaatggatgataagcagaattacttatccttggtttgtgtgcgaagataaaatatactccctccattccataatagtataatgtacaaccactttgtttagatgtttcataatataagacatgtatacatgtagacaattaactatggcccctttttcattaaattattacttttttaaatcatccactctcatgttctctaattctattggatgcatgtattgtatttattaggatgatccaaactacaagatgataataattatttcttagtctttaggttaggggtagttatgccttatattttagaatgaaagaactatcaaaagtagatgcaagggagtacaatggttgggttatccacccgagctaggcagctactactactattcatctctcagtcaccttgaagctttcgctgaccgttgatcactttatctcccttttcactgtgcatgcactgcacggcacaagaggagcagaggactatcagagattcagtgagaaatttattgcatgtcttgagcgagcgacttaattggatcatcatgctgcccacattactacgccactgtactactaaaattcgtcctaaaataatttttactttttttcatctcatatatattaataaaaaataagactaaaatattttttctttttttaatcctaatataattgtcccctacattatctagctggtcatatatttttatcaactctaatataatgcttgttcatgaataaatttgttttaacataaataagaggagacaaagacgaagggagtgcgatttaggtctaatttagtgctctaactcttaaggctgtgtttagttccacaccaaaattggaagtttgaagaaattggaacgatgtgacggaaaagttgaaagtttatctgtgtagaaaagttcgatatgacagaaaagttaaaattttgaagaaaaaagttggaatctaaacatgtcctaaatttaactttagaagttgggtatagaatatagttgtgaagcagttaaacccagttttatttctctaattcatttgtaagagtgctctagccagatccgctctagtcagagctgaaactatttagttgcgctcaagctctaaaagagatagagttagagagccctgtaccaaacaaactcttatcacagcttagtactccagtacagtagtaccaagttgactctgcatatttgtccgacttacgccgtgtttagttccaaaataatttttcaaacttctaattttttcatcacatcgaaactttcctacacacacaaactttcaacttttttatcacatcattctaatttcaaccaaacttttaattttggtgtcaactaaacacagccttaattaaccagcaagcgagcagttctttgtctcgtcaaagatatcacgaactgaaggactgtacactagaaatctttccctaggggtactggaaattaagcgaatatgatcgacctacccacatgtagtacagtcgtgcgtgtgttcattacgcatgccatgagaaaaaaattatcgtatcggatcatcgaaattaataaactgaacacggaaaacccttagacttataatatgatgtgctatctaggttcacaaacccttaaaatatagtttcgaatctcaaatttgttttggatgtcatgtcacgatgatgtctatgtgttgtgagactatgattttaaggacctatataccagtcacatagaaaaacaattaaaaataaagaggggagagaggacataaggatgtttttaattttgaaaaataaaattagaaaaagatagagaggagaaaaatatgttttttatttttttatatgtgtgtcagggttatagataccacatacctaatagtagttgactaaatcccggcaggacccaccacataccatgtcttgtatggaaataaccttcgaatataggaggagttccacataaggaaggatgaatagagttctacatggaaacgacaaggactactcagattatatccatattggtttccctagttctacttggacaatgggacacttatgggtataaatacaaggccccctaggaggagaggggacacgaaacaatagatcaagacacaagatcaacatacaagccaacatacgccaagacaagacgctggatatcgacttcagagataagcatggctagtcccctacggtgtctatggatactgataggagagacatagcgctatctttgatcttgccggatgcagattcgaggaggaaggctaccctgttgtcgactacgagtcagcacttcagaccgccaagtcgacaacagttagataggctaccccaaatattgtactggtgtaattatagtgaataagagcaacgaccggcttcggccaacaggagtagagttattacctgacaattcaggggcccaaacctatataaaaatcatcatccccatctcttttattacaatctcgcatatatcctaataccaacgatccccatactatgtaaataccggaatcgcgacatcaaacgtcgacagtgtgattgacacatgggtcctactaactttttatatgtaattttctatggctaattggtcacagccaatcaaagcgtaactatgcccattctttgtaccgggcgtgtttgtctctaaatatatactccatctttttccctacaatgttaagttaatatatagtatttgattagaagatcaatatatcattgttttatctataattcactcaagttcatgctacaatgttaaaaggctctacaatgtgaaattgtcgaagtcatatatatgggggcaaaccatccatcccctacccacctatctctcgtcgccgctaatgtcgatatcctctattgccattgtattataccaacactcttaatccaaaaacaatcattttcaccattcattccaaaatttcaatgctttgaaggttgtgatgtctcacagcttatgtgtttagagttagggtccatacaatactgcagaggatctgaatttaagccaaacatgtatagtgattgagttaagtagttcctcgtagaaagtgaagctgtctagttctatttcataatgttacttttgtgcagaaaatggggaaaactcgagaccattgttccaatacagatactccataactttaggaatgaacatatcaattttgatattgtgttttgctaacggaattctattttaaaaaaatatgaaaattaaactcgaagcatgaagacacacagtgagtcttagtaccgcactgctgtacaaaaataatactgtaggaagtttctgaaaaagggaccgagttctctaaaattgaatcattatatttaacattccaatttaattgtggtagccttcgtagatatttgaattttcacaattaaaattgagaaaataaaataaaaactgccgtgcaagatctccacttttcgaagttcgattcagagttttgttttttttttaaaaaaaaaacaagctgtaaaaatgttctaccaaaaagtccttcaccattgcagtttgtttgctccagtttaatttatatacacaattttttttatctagaacagttttaataggagttgactgctgatttctgaatatacaaaacccgttcggtgatctggaggaaatacaccaggaagcttctttgtttttgaccataaaacaaactacacattattcatattatttttgcaaaaaaggggtcagggccttttcaaattgtcctctgcgagttcttcgagccacctggtcgatacagcgcatgcagcacccatttccgtgagacgtttcgttcgcatttagatcacatattaaatcaaattatatttgttaacaattttatgaaattaaattaaattaaattgtacttgcgcagttctattgtcgaagtcaaattttagttctcgaacgatgcagcgtgccttgcatggaaaattctccaattttttatccggtggacagctaatatggatcattcaactttggattttgtcctcattacaagaacattatgaatattctgaccggagaatatatcttgaccaaattctcttgtcactaatcggataaggggaatgatcgcgcttgtgcaagccatgtcatcactagcaattaattaattgtgcaattattaattaattactaattgttttaaaagttcatgatagaaacgagccttgctattggtcagttggtcaagtcatcctcactgtgcaggaattgcactcaaatgctcaatgcaactaatcaattcaaaatttaggtgatgatttaattaggtacccaagagcaaacgccaaggccgagaataattagcatgtgaaatcgcaggctttttgcatgctttcgctgcatgattaattttgtttgttgaagagcaaagatcccatttaaaattgaaattaaaatatataaacacgggaatcagcggccaagagcaataaggacattagcaggttgtgcttagagaatgtgagcatgtgttaggagggaaagtgttttatgtgagttgaattaaaaattaaccctgggaaccacttttgattcgatgcacgagtaccattttcccttttgaaaaatgtgcaaatataaatacagttaaaccactctttcgaagcactactgacttgtatagttaaaccactcattctcacattgaaataattattacccctttcgttttaaaatatatgatagtgttaactatatatcctttctctttaaccactaattacttttaaacggttagactatgatgaacaaaattattatgcatgtatttaaaattcagtacactcgataatataatagcttttaaattacttataataatattactgtaaataaaaggagagatcacgagttttgagaatgaatagttccactatcaataatttaaaaatggaggaaattttggaccatatgacttgaaaaggaaaatgggttcaaaaagattatttagtggggctcgtatatatattgctccttataaacaacgaaaaattagaggtaatcgagtttagccaatcatcatgcatatctccacccaatatgaataattcaaatacaacactcggctaattgtacatatattattatgaagacctatggatttagacaaatcatatcgattccaccactccaaacatttcatcggttttctttcgaactacccctctagcattacacctagtatatagtactatagtggagcgacttgtaataaaaaaaagttgactcataataagtggctggctggggtttatttgactccgaaaaggagaaatggatggccactaaaatgtatggaaaaaattggaaatggcaaggtccttgtggccgagctgcacagtacatccaacctatcctgtttaaaatggtcaaaaacccatgctgcacgttataaactattttaaacttttaaaatatattaatatggttttttaaaataattttcatatatatatttttttaaaaaaacacatcgtttaaagaagagtgcacgcggaaaacgaaacataactttccggcaatctccagctgccgaacgcagcatgcaggaatcagcaacaggaaaaaggcagagaagatcggtgggcggcggcgcaagcggccaagatttggctgcatcaaaactcaaaagctgatgcctttccaccggccttggctagcagctcatgacgacatgtgtaaggactacgggccggtttggtttgagtcctaaattggccttatcaatatttgataattttaacaatgtttaatgtctatttggtttgaagcaaaattttagcatgcctaagaaaataggctatttcaatagttaacttaggctattttggcttcaatccaaacacaactttaccttgccaaaattagccatgcctaaacttgctaaaatttggcatcgacaaaaattggtaaggccaatttaggtcacaaaccaaaccagccctacatgtggattaatctgtaaatccacttaaaagttaaacaagtggataatttgtttggatttgtggattgatccacttgcagccttagacctctgtatgaccagtgacgtgaagttgagcgttaaagaatcaccaacagtcatcgtatattgtttccaaaactgattttgaagattttaactgaaaaatcggatccagcagatcccctcacacgttttggagttctcttccctgtatttctcgctctgtcgatttgagggagagcgatcgcttcctctgactcccaatcacttacgcgctggaagaaccacatgatctatttgcgtgcatgtaggaaaacagagaattttattgttagtttaacataagggttcacttttatttttttttgataaaatttaggctctctcttgaagagattagttatttttattttctattttcagtttaaaacaattttttttgtggaagatcatacgtaatctctaggtgatgctctaattcggtgatgccagtggagatcatcgtaaaagaggtttagtgagataattgtgctaaatctgaacttaatctctctactccctctaaatattagggggaatctatatattcgtcaatcatgtagttgattttttcccttatctatcaatctttttttctattctcctgtctcaaaatatagcaaaacctattagtagattagactaatactacgaatatagatcgaatcgagtaatatataaattagaacttagcaacttacatgtcaatccttaattttattgaggtgaaacaatgacagctatatggtactccttccgtcccataatataaggaattttaatattttgtttgtactgtttaaccacttgttttatttaaataacttgtgcaaatataaaaaaacaaaaagttatgcttaaaatactttggataataaagtaagtaaaaacataaataataaatctaatttttttaaataagacgaatggtcaaatagtgcaaacaaaatatcaaaatcccttatattaggggacggagggagtaacaaacttgttggtgtggcaaatttcaaaaatcaaatattggtgattgataaaccaataagcaaatgattgatatattttgaattgtacaagtttagtctattgtcgtgcaagtgtagtcatccaaagagttgaagaaaaatcaagtgagattaacgaatactctctgtacgagggaaaaaactaattttgtagctatggatttgtataaaatttaattctttttgatacggtggagtaccaaaaccgatgtaatatactactgcctttgtcctaaaatataggaatttttgaggtgggcacagatattaagaaagttggtagaaatagttgaagaaatattgtgattggttaaaaagagaaaataagtgagataattaaatgtagaatgactgtgattggttaagaggaggtagttgaaaaaataacgttattttgagataagttaccgtgttagaaatagttacaatttttacacagaggaagtagtaagaaaatctacatagccggagtatcttatagtatcaatcaaccttttcctagaacttttgcaaacatttcccttctcctagattagatgttcatgttctctgagaatcccaaggacaatggcagacatgccgtgacctagtcagaccccaagctttacagctcgatctcctccactaaagtgtctcctggcgagcatgaatgcatatgatcttttttcacagtaccgctactccctcgttccaaaataagtgtaattttaatattgtttatgttcaacgtttgaccgttcgtcttatttaaaaaaataattataattagtatttttattgttattagatgataatatatgaatagtactttatgtgtgactaatattttaaatttttttttataaaattttcaaataagacgggcggtcaaaacactggacacggatatctgtggctgcacttattttgaaacagaggtagtacctgccatcaatctcctctcatatcactcaattaatcatacatatcactcaattaatcatgcatgatgcatcaagtgcacactctgacagtccacactgcacaagtgcacggtgcacacacaccagacaccaggcagctggtacaataatcacctctcactcacagagctcacactgtcagaattaatgggaaaaaaaatccagatccttcaggtgggccccacaaagcctcctagtcagatatcagtatatatcacagatcagtaattcagcatcacccccataaaaagcctctttccatgagagggacacatattatgttgatgcagcttgggttaattaattagttacaatttccttccttatctgctctacttgactaatacatgacttagttactatttttactatcagtagtgatcaccataaaactcgtcattatcactatgtgttactccctccgtttcacaatgtaagtcattctagcatttctcacattcatattaatattaatgaatctaaatagatatatatgtctatctagattcatatatatatctagattcattaacatcaatataaatgtgggaaatactagaatgacttacattgtgaaacggaggaagtaccatttatactatcaatagaaaccattgcaaaactcgtcgttatcgctgtatgttaccatttctactatgagtaggaccaatcataaaattctttgttatcgttatctgttaccatttatataagagcaagtttaatagtatagctctaaatcatctataactaatttaatagctcattaatacaatagtcatatgtaaatatatacttcaccattaatatatagccccacctctcatacacataatgctttagaggtggggccagcatgctgcagttggctacaaatctataactcgctttccttttctatcttctcttatcacctctacatgtgcttatagcttacttgtagtcactattttactgtacgctcgctttgcactatgcactcttgtcaccacacagtacataccttggctggatagatgcacactgtccatccaagttgccattgcatcatgtttcatgagctgcaggaaaccaaatggagccaggcactgaaactcattgagcctatttatgggatgatgcttaagttcaatcaactgtgtgattggaattgtttctggggagatgaatttccatggccagtggtgctggagcatgggtggtgatgagctgttgatattaacctgtgccctaggtgtagggtttcttggtggatcatttgaatcaaaattgatcaggttgcctgagttgtcaggatcatctaggggccatatctttacttcttgttggagtcacctcaaacccaaattgtggatgtcatggtgatcatcagctggggatttattataatattccacattatagggctcaaatgatgttcatggattagacatggataactctttggtttgtcattttcgttgaattcaggatatgatcaatttgttgtggaaattaattctttttgccaacctttgtgtggtgcagtgtcagcctaaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatcccatttcatgcaaataatcattttttattcagtcttacccctattaaatgtgcatgacacaccagtgaaacccccattgtgactggcctaattgtcaagaaatgattttgcatgcgactgccggcattggaatccggaatttgtttgatccgaggacaaatatgcagcatgctgacaagttgaataattatgcaccattacttcaaattgggaataacatgtaaatccctattttaattccatgtttgtggtaataatgccgggattgaattggcctgtgtgtgagggcagcaaaagtctggatttgatcttcaaccaatacagcaagttgatgcatgcacaaccttttcaatctcaggttagcaagtggtttaattaagagcattttatcttggtacagctcatttttcacagtacaagatgacattaaattgcaatttgcaagtgctaactaaaaagttgtgcacacagttaagattcagggtaagagaaatttaagcatttgacctgcaggataaaatagccaggttggaagacttataatttccctttgcagctttgataacattattaattacaagcaaaagtgaaaatgtgagtagctgcaaattaatccccagggaataactatatatactttgagaaatgggaaaattaaatgaaaactaaatgtgcttcttgcatcctaattttgcaggtggaacgtatttcttgggtccaatcaaatcagcagataagcatgcaaaatacgcacaaaacatcagatgacatttttttagaagatcaaaagaagttaggtacacattatgtcactgagaaaacaatgttatcttagcagctctgatacatgtttgaacaagaaagaaaatgacaaggcaatgaggtgttcaagaaaggaggagcaacagtgaaggtagccattcagagattctatggccaaaatctaagcagacaacaacagtacatcaccacaactgctagctatatctttttatggaacaataatatcacattaaactatgatgtacagtcatctcaacagagataaattatcctccagaagcaatatggatcagcagtgccctggtctcacctttttcttatgaaaagaaaattagttcctagtcacatcacacaattcacagagtcacacaccagaaataggccgagtttagttccaaactttttcttcaaactttcaacttttccatcacatcaaaactttcctacacacacaaacttccaacttttccatcacatcgttccaatttcaaccaaacttccaattttagcgtgaactaaacacaccgatagtccattttaggttatatgtaatgttcatgattacttgatcatcaaacactactatgcacatcttattgtacaactgaaaaagagatctacaaatgtacaggtgtagaactttctgcttcccttgtggcataaaacagaaggactgaactactgaagcaatgaaaacttgaaaagtaacctttggaaagaaaatgttggcatggcagacagaaatggttgcccatcactttacatccattgtcaatgtgggttgtcattactgtttttgtcaccaagaaaaaatgggaaaggaagttttgtttttcgatgcgataaatcgctatcaggagaaacttagcaggacacttagaagcctacaagtcatcagaaatgatggaagcaaggaatcttctgattgtgtgatgacaacatgtgctcctgaaagatcacacaagaaggttagatggtgggaggagctgtatctgccaatgtttggtcccaattattcctggaaaagtggtgtaagagacaacaaaaggatgaagcaaaaagaggaagaagatgctgtgacattgcatccttgattaattagctttttggaaattatggtttgatcatgggcagagttaactttgctttggctgtgttaatctgatgtgtagcaagaatgttcagcttccttagtagccaagatacttgtgattcagtaaagtggactggcttttttttctgtaaggttacttgggatcttggcaagaactttcttgtgagctgctctgttgcttgagagtagctctgttgttgcatgtgcttgttgagattattcggtggttggttaataccaagtacacaaatggattatataattaattcttgctattgtaaaagtagttcttgcagaagtttgagcaagatgaattgagaaactaatttggacaaaaaagcaaataaatgtgtccacttggattgaagtttggttggcttatcagtactgtataagggttagctacatgggccttaagtgtcaacgtaggacaaataggcccatagtgggtggatttgtaagccgagtttagcaaggaataagttcactttaggtccctcatcttgacgatgagtttgaattacgtccttgaaattacaataccacatatatcacgtccctcaccttttaaaaccagtaaaaatgtaattccaagatagtatcgtaagctgttttggctaatgtggcgctaacatgacaccagaagcaaaaacaactaatataaaacctcatggaccccacatgtaagtgaaacaatattggaaccggtgaattttatgttgtttgtccatcagaagagcccatatgcacagtatgttctcgatctattgatccaccaaaacaagcagattatccaggctgttatgtcaccaagattagctttgcagtacaaaggagtaggtggccaatttggccaggttatcaagcaacaagaatacatgaaaaattaggtccaaatatcacattggaatgacagaattgcagtagattttgagctacattttattcaccaatagaccaatctaaaactgggaagaggggcggccgccgcggaggaggagggagcaccgacgtcgcgtgttggggatgctcatcgcggaggaggagggagctgccaccgcccgctgtcggttgcgcagcctagagacctagacagagatgggaaagagaggggagagggggagatagagaggaggaagatgatgttgtttcactaacatgtgggggcccacaagttcttttagtatttgtttttgcttcttgcgctaagttaacgtcaggtcaatcaaaacagcttacatacttctaccggttttgaaagatgaaggatgtgttttaattggtattgtgaatttgtgattcaaggatgaaatttaaactcgcggcaagatgagggacctaaagtaaaacttattccatttacaaatcattaggcccccatgagcacattgatctcccacaattgaatttgaccaacggttttgctatttcacttccgccagatttttgggttcgtaacttttgaaagattaacaagcaatccatttgatcaattctgaacgtgttatgacatctctatctcattcctacgattccctcccagtgtctaggtcctcacatccaggcccacctccagatcgcaaatctagaggtcctggtcttcgtccatcatttgatcgaatttactgttcaaatttgaaatgctcaaaaatcatttaaaatttgtctcagaatcttctttcatctcacactgaaacctcaaaatttttgtagctttcaaccaaatttgaacatgaaccttgtttgccacatcatcgtcgaactattgatatcccaggtggctaccttcccaggcaaagcactacctattgcagaccagtgtatcggatggtggatgggacatgaagcccatgacagaaaagagcccatcactcatcgacctgaccagcagcccacccaaccggcaacggtccattttaatttgtccagaccatttccgcgaacatttgtgtttctgaattatttttcatcagattttttttaagaaataagtacaaacgtagccattcacaacacgggtggcgcacactcacccctatgaatacacacaccctatatgagtacttttgaaaaactgaaccgatatattttaaaattaatgcagttatcatggacgtctcattatcgatgagtacatcacttatcactgaaagacccgatttagaaagtacaaatgttaaagtggtatattcggtcagtgcgaatttgtgtgaccattttcacaaatattcatgccatgtcttttatgctcccatttttgctagggattttctttcttttcgagatgttacatcatatctcccctcgtctttcttttcttcctcaacaatgagccatgtctttgttgcctctttcacatttttaatgtggttgacaaagaggtgtgagcacccaaccacatgtttctcaccaccaaaatgatgtggctcagtcgtcgtcactgtcaccggcaatgaaaaaactcaaccgctgaaggaaagattatctgatgaggacacaactagctcgaatataaccataactaccttatgtattaatcaacagaaggtgcatatgttctacattagatttacatgttatatatttgaaaaaacgttgctacacaatgagtttcatgtgtttttatttgcaaagatacttgcttgggagaaggaaaaaagaccgagcgtaacgaattcatagatgataaagaagttgattggggaccatatcaagaccctctccaagtccacttccatctcatcacgtcacttttggtccatagaagacaagagataaagttctacacgttttggattcggattcgagcctcctgacagcatcaacttcaaacggacctagccgctgatctagaaggaatttcggggcccatgagtacttgttggaaagcttatggagtctactttcagatggttttggtcccacgtcaaaattcctaccgagctgctgggaatctgcaaaacaagccacgtatctcatccagtccgaatctgactcgggttttgggccttgtaattttgtcgtgggcttagcccaagggggtgtgcgccctagggcaaccctaggacgtccctaatcatattaattcagtagccgtcatcgtttagagttgggttttgcttagattattctgtcaagaacagtttcgccgctagatcggtttgtggaaccccaaattcgagtgcttaatcattcatatgcaatttggttgcaatctatcttgttcttgcttgtgtttttcgattcacatgcagggattagccttctcggcgaggtcaaccaggtttcggcacggttgataaccagaggagacgtggtgctgcgattgcgaggctcagtagcgtgttcgttcagaagtcggatcgagttatgtcaccactccgtccaaatcgactgtttatcaatacctatcggaaaatcgggacctacctccctcgtcactatccctacggtttttcattaagaagaagaagaagtctcaactaaaatgagggatgaggcaacatcgaggaagaggatgcccctaggttcctccttcgttgtagacatcgagattgtgtgctgctgagggcaaccaaatctatgatggttcattaatattgttagttaataagtgtggcttatgtagaatttgttaacttaaaattgttgtaattctgacatatttagatgaacactcatattattagtgtagaaataactataatgactgattagtatgtacatgtacaaatatgctgatgatataattatgaccgaccacatatgcacactggtttgcgctttgcagtggtggagaaaggaggggcaaccaagggttcaagacgttcagcctccctgaatttctcataatttgcagcttgaatgaagttttataagatcaatatcactggtctccttcaacaattctttttttaaggcataatttgctacatgacacttaaattttatgttatttgctggtagtcataaaaatgtgtcacggctaaaagacactctaaaaactagtaatttgctggatgacactttcagtttaattgaaaagataaattcttcaaaaagacaagaatgcccctagggtcaaaagcttttgagctgaaactagagtgaagatggaatataatgtatgctaatgatgtacttagggtgatggcaaatttagagttacataatttctaaattttactttaacgtcatatttgagcatgtggtcttagagcattctcgtctttattaagaatttatcaatctaattgaaccgaaaatatcctcttgtaaataccaattttttaggatgtcttttagccgtgacatgtttgttcgatgtttattagcaaattgcataaaatttagatgtcctatagcaaaatttgccttttttttaaaaaaaaagttttctggctctgctgctaccagcttgtctatactgtgtgctatgtgctttattattagctagtacacttcagaattgaccagactactacagtatctctttctttacaatttactagtaggtaggtaaccaatataggagaaaagcacaatcctttaaaaaagtataaacaatcatgcagaaatctcgttagctaccaacaaattaaccagtactaataatcaatctcactaaccaaccgtttcttggtccccatgctcatggcaacatcaccccaactgtgcctgtgtaccatgcaaatcatatttagtatgacgtttaccaaaccttctagtccaattaaggcacaaataatataatcaagatgttaattaagatccaactgcaaactgcatttcgtcatcaaacacgtagtagtccgtgagagaagcaaaagctgaacttctcgacgaagttgacgtggcatttatgcgaggaaattaaagtcaatattgatcattggatactcacacgtgctatagatgcagagcaatgattagtatgacgctagctaatcatcgtatatttgaacatggcactaatctcgactaatttgtcaatcagtttcttattaccatcccaaatccaattctcaaagagcgagggtctcgaataagaaagaaacatgaaaaccgagttatgaatttgccccctgtttcaattgaaaataagagggaaactcgcatttctttttttttttctagtacaatgcgcgaacatttacttatgtgaatacactagtacaccttagccctacgagcacatccgactggtccagtatatcttgaaattaatcgtaaatatgagcactcgtgtcactcactttgtgctttgtttgcattttgaaactgaacaggtaccttgattgattttaacctcataaacttgcttgaattagatattaaacgatcaaggaatgtgctctcatttgttagttacgatctaaacaattatgaaccattttgaaaaaaaatagataacacaaattattgtgcaagctttctttgaagataataaggcatactttgttaataattaaaattaaacctgacctctccatctatcaggaatgcagaaaaaaagggaagaataggtgcaaaaacctaggatagggatcacaatatcatgccaaacgccaaacactcgaagattccaacgattgaatctgtagcataagtatatatgatgcgtactgtagaacaatgcctttaagaagaaaataatttttgtccactggtatcattcaaaacaacccaaatatcaatcggtgctagattttcatccatgtaaaagttagagaccacattcagcaacgaaacaccaaacatttatcaggcattgtcaaactaaatcagggttttcatgctagagttgagtgccaacattatacaaccgtccatgataggagtttgtgccctcggcaaaagggccaccatctatcagagaagaaaccacacacacaataaatcgtgacctcgaattgtcgactaatctctccgatcacaacgaaagaaaccacccgcatagtccctctcgcattattatgtactccataagatatcccttcacaagtacgcatgttatttttatttcttcacgtgtagattaaatctaactatatatgtctgtgtaaaggggcagacaacgagagagtacatgctctctagtctctagggattaaaatagttaatacatgtccctctgttcatgtcatatttttttcatgcccacattcaaaccttgacagcatagcaacccccacctccaacaacacatccacttctctccctgtaagagccatgcttcctattggaggcttgaatattgtaaaatcaaataaatttgcacgccttttcattcgagtcacgaggagctggatgagaagaagctctcatgcataggtggatctaggggtggtcccggaaccattcaaataaaatcctagcataatgtataatatacatatgtaagaaaaacttttgaaacaaagctcttttattaatatattatatgatgcacatttaatcaatttatttttctaactttgttatatttaggatatttaaaaaatatatatatgttagaccacctatataaagatcctagatatgccactgctctcatgttcggttctatagtaaggatgaaaaaaaagaagagaaaccatcgactataaccccaaaattaaaaaccacattatttcttaacacacatataggagaaataaagggaaaagcctatcgaggcaatcatatttgtttgatattttgtaattatcattttttatgtgagttatgttatcagtaaaagtattttaagcacgatttatatctcatgtatttgcatacagtttttaagtaagacgaatagtcaaacatatgtctaaaagtcaacagcgtcatctattcaaaaatagaggagtatgtaggtcgaaattcggcctttgtatccacgagtagatatacacatgtaatttgtttggttgatatgttatccaagcagtcctcggcacatccactgagattaaatagcgatcatccatgctttccaaagttgaaaaaaatcccttatctttatccacggtcaaagtccatatgaatgcaacaagatgcgcactaagaaaaaaaggataacatcagtagcaaaaagaaagaaagggagatccacactaaccggacaataatatgtacaccgagcagtccatgatcacactcacacacacacacacacaccccacaacacctttagcatctgttccttttctgttttttttttcttcttttcctacacaccaaaagtcaatcaccaactaattctaagccgtttctgacgacaagaaatatcagataaatattcagattaggctactacagctgcagatgacaagacttcgtcaggctgggagagacaggaagccattcatatcttcacatcgcagcttctcgtgtcagtgctcattgctcccaattaacctgcaaacgcgatagtaatcgatccatctcattatctcctccctgaaaacattaattctctaaaattcgcctccatccatctgcactactgtttcatggtgatttgcatgcaataatgccgatcatcaaatgttcagaagtcgatgatctcgtcaggtacgtcagtcataaacctcgccttcttctgccaaggaatcaacacacaagagaaaccaagttcagaacgaaaacatacatttcagaaagattaattcaaagcgcatgaatttaaacattccacagcatctgcttctcctcctaggtgtgttttgatttggtgtcaattagctagaggggattaattcggattgctttcgttcggacaaggacgaatggcttttgtgtggtgtgtgcgctgcttttgcagcctgtgcttgaatcagaagctatccatggatttggatccctttctgaccggccatgattgtgtccgtcaggacagaggacgactaactgcaccgtttgatcgattcgacggcctaaccgacactccaatgccggccataagctggtttcatcgagaggaactgttgaccagttcagataaagttcagatacgtttacatttcttatgtgtgtatagaacaaaaaaagttcagacttcaatttttcccaaaagaacacaggacaggggagcttgtgattttttttcaactactcgtgagaatatagaaaatttgagttttctactttctatgttctgattcatttctagtttttataactatgaactattgaaatcttgtttagaagttagactactttaggaagctgaagattctgaaagaagccgcaagtgtctaaggccctgtttaggggagcttgtcccagctgcagcttttcccaaaagctgcttctgttagaagctgcctcaaacagtccacagctttacagattctgaaaaatgaactaagaagccaaaagctggagaagctgggtttcagagttttttcagattgtcagaagctggctaccaaacagccgcttctcagaatctaaagctcccccaaacaggccctaaacctcttctaacaacgccatagtatttaagcatagattctaaagtagttgcagatagacaaccctgatgttttagaagtacattggagtgtaatctaacttaggtttagttccatcaacttcataaacacgagaggtccaagacctgtccctctaaattaatcactgttctaatgtattcgttaatgatactgtacacaattgacattggagaatggagaatgcattgacagcttccacgtagcagccagctactagctgtacctagtactacatgaagtccactcttgcaattaaaactctctctagaaaaaaaaccaacatgtcatgatcgatcgattcgcgtaaacaacgtggttaatcagtttcagtctaattaaccaagtgccagaatctaagcacgtgtgattagttgtattagtagtactagtactcaattacattagacttacttgctcatcatttgacctcaaattactcttcctagcaactcctctacatgcgaaatttacctatttaaagcaagcactcttctaagttgaccattgccatattgacctttctttagtaggaactcaaccacttgatcaatggaatatataaagttataaacatctcaatgaaccattaactatgttttatcatcttttatatattttttcctgatcagtttaaacttttgcatgaattggttaatacgtgaagcacctaacaacctcatatgcaacaaggtagcacagacactactctgcacactagggctgtgttcggatgcctgagttcccaactctaacagtgcgcacgaaaaacggagcgatccattagcacgtgattaattaagtattagctaatttatttttcaaaaatggatcaatatgtttttttaggcaacttacgtatagaaactttttataaaaaacaatccgtttaacagtttgaaaagcgtgcacgcgaaaaacaagaggagagtattgggaacttggagttccgaacacagcctatgtcactagcaagaaattataagaggacattccactgtaatactaatactttttattagatcatcataaaaatattcataatactcccccatttcagattataagtcattttgactttggtcaaagctaaactactttaaatttaactaagtttgtagataaatatagtaatattacaacaccaaatcagtttcattaagtcgataattaaatatattttcataatgttactatttttttctataattttgattaaatttgaagtagtttagctttcaacagagtcaaaacgacttataatatgaaacggagggagtaatgattaggtgggtttcaaagcccgcttacatccctaaaaaaagatttactaactactgcactgatctctgaacatcaacggccaatatcatgataatgacttgacttactccctcttaactttgggagttggagatcatgatcaatatatgtatgacccctccaattattttcaaaggcctcatttaagtgccacaccaaacttgttcacacaatatatgcttctaactaactaaaccaattaagcccttgcacatggtcctccattgacacatatgcatgtccccttcatccatatcacatgcatggacacatcaacccaactattctaggtcaccatggatatctcttttaattttccctttgtttcaaaactgttcatgagaccatgtttcaaacacagggtgaaggagaggagtaggcaactagaaagaaaagcaagttcattcacttgttgcatgcacagctctgcaccacctaaaccatgtgaaggagtagtgaaattctgacacgaagtggatttggattaggggaagtcaacgaatcatggacaactcattgctaattgttggaaagttgaagtgatggattgagattgtttttttttatttttaataatgggatagtgatttgcacttccgatccatggagtatacatgatcgaatagaaaaaaaaaaattctgaatcattggtctacgagtatatttacggtggtgactactggtagtattaataatagcaccggtattaccactaataggaacaattatatcactagagaacaccgtaaaaattgtcaagacgcgagacatgacttaaagtaatcgtcatcctcttaacaacaagctattagtgttttctaaacagattgcagttctgatagatcctgttatctgctatcatagtcctttttagtaccactgagctgaaaaaaaatattttcaatctaaaagttggtatagtcaggtttaaaaatttcaagctgaaagtgctcggtggttaatctactaatgaacacttcaattacttcaacttctgacctgaaattttgattctttaattgttcttttgccgctgaactcatacatttcgaagaggtttcagagagtatgaaacatggcattgtcgaagatttttgaaaatttccgccatttttgtggtttgaattcgaagcagaggaaacagagcaaagggttagaaaacagagagagtatgttatatgctgttccttacctgcttcttgtcggcgaccttcttcttgtccgacgagacgagcgccgccggcagcggcagcggcagcggcagcggcggcgggcggcggaggacgggggtggccggcgcggagctgtggtccctgtcgacgcagagctgcatgatcttctcggcggcctcggcggcgtcgcggctctccttcacaagccgcgccacctccgccttgggcagccgcatccgcagccgcacggcgccgccctcgccggcctccaccgacgacaccggcgacgccgccacgtccgacgccgaccgccgcgacagcatcatgctctccaacctctccccggcgccgccgacatggacaagcgcgcccgaccacgtccgccgcggcgcgcgggcgaggcgagggagctcgacgaggaagtagagcttgccgggcttgagcggcgcgtcggcgtcgagcggccgcgcgcgcatcccgaggcgcctgacctcctccgactccaggacctggtagcccgggtggtcgcgcagcgccgccgccgccgacgccggcggcctgtacttgtacgtcgtcccgtccaccgtcatcaccctcgccgtccgccgcctcccgccggcgatcgcgttgcccatcgatcgatcaaaagcttagctgcctcactcagctggctgctgctgcttcgccgacgagctcgaattcgagtagttgacgtgagctcgcgaggcaagaggaagaggagagaagagcatataaagggaggcacacgcatgtgatgtggcaaagtcaaatctcacgtctaattgttaaattattcccaattttcaaattactcgtcgctaattttatgctaagttaaaacagttgtttttaaaacgttaataatttaaaattttgtgtggtttaataatatttgaatattatatatttattacgagagcgtgaatctaaaaagattaaccttataatgttgttggcttcatccatcatgattcaaatactgatacacacgaataaaatttagtaagatgtcgttggtttatgtcaggaggcgtgggtatagaagtgtgtgagtatgttgttgcatgtgtaatggtaaaaagatagttaaactatatgatttattttagagttagatggacatatgtacggatttctgattaggaaaatcttaaaacgctgagtaatttaaaactgagggactgtactagtttaattagttacaggtgattagaagcataatcttttcgatacctgcattattcaagggtccaggcgtcgacgtgtcgtggtagctagagatgcatgttctttaattagtacatcgttgtatgggcgtggcaaaataattgcattttggatttacttggacactaataatgatgtacatatctaactattatctctatcctaaaatgtttgacgccgttgacttttttaaaaatatttgaccgttagtcttattcaaaaaatttaagtaattgttaattctttttctatcatttgatttattgttaaatataattttatgtatatatatagttttacacatatcacaaaagtttttgaataaaacgaacagtcaaacatgtttaaaaaagtcaacgatgtcaaacatttaggaaatgagggagtatattactaatatgttgtactagtatatagtgtgcagtactgtactatagtacatacgacgagcaagagggccatgtgagctgtttgtatatgatcgatgttctaggtacggtttaattctatcatctataacaatgccatgcccttaattaaatgtggttgatcatccatgcgtagactagctaacaaaaacagtgattaattgcgcatctaaatgtttaatttgttggttgttagctactctctttaatgtatgacgtttattgtctcttgtacatacatttaacatttaaaaaaagttaaagtaaagatcacaaagcgcaccatgctttgaccacatctatctcaaagttcatatgctcacctgttgtaattgttttgctttgacgaagatagctgaattaatagcgcagaagtgtcgagaatgacatcaatatgcaagttttgcgagaacttgggttatactccctccgtccaaaaaaaagtcaacctctaaagtttgaattttatcccataaaaaaccaacttctaccatccagctaccaaccctcggcacataaaacgagaagttttatttcttaaatacccttcacctatctatcaccattactattttttttaataatgaggactatttttggcatttttactccccactaagtttaaattgggatgctaggattggtcttttttttttaacgaagggagtacttatagcatgatgaactaagtgttaactgagtgaacggatttctaacataaattggtacttgcatagtagagtaattgtattgttgttcatatatattacttcctccgttttatattataagactttttagcattgcccacattcatatatatgttaatgaatctagacatatatgtgtgcctagattcattaacatctatataaatgtggacaatgttataacctgaaacaaagaaattgtttccgtgggattagccaacaaaaagggagaataatagaaaacgtacggaatatgggttctatgatacaatatgccccaagaagtgtggttttatgataaaaactgctaaacctatggttaaatttgagatagatgtgcccaaaaactctcggtgttttacgatatttactgctaatataaatatatagaaaattacaaatcttgtctaaaatacctttggtactccctccgttttaggttataagacgttttaactttagtcaaaattaaactgttttaagttagactaagtttatagaaaaaagtagtaatattttcaaccaagaaaaatttattatgaaaatatattcaattattaatttgatgacactaatttagtattataaatattataatatttatctataaacttagtcaaagttaaaatagtttgactttaaccaaagtcaaaacgttttataatctgaaacggaggaagtaataaatatcacaacaaattaaatacataataattacgcaattttcttaaccatgtgaatgcaaccagatatataaaaattttagtaacatcatacattaaaaactaaaacccagagagagtactagtactacatccttctagacggggcaacgggcaagctacaagtgagaaggggcgtgcgtagacggcaacggaacagagatagaactgcgagtgcgtgtcgttgttaatttttggcggtgtccggtgagaacagggaaaaataaaagtgtggctagctctccatttccgttaaatatctctttcattagtcctaaattcttggcttggttcaagaaaaatgttgagaattagctttggctgtagtacatacgatcgagctgagttaccctcggtgtcaggttacctcatggccggccatccagcgtggattctggagatcttttgagaagaattctgtgaaatgtcagtcgatttcaatttcatgtcggttatgagagaaccttctgtgtcgatcgatatgattccaagcgttttaccgcgggatatatgtgatcgataaatgctgatctctgtcaggtaaattccatacgtgaagaggacaagaggcagctagttagtgtagccttttcttcagcatgtccaaattaaactaatcgtcgtctctttgtcagcacgtacagtacagtatagtaaagtttgtgctttagctaactagctgatgactagtccgtacaaatggcaattaatattatttttgcaagctagtcccctttcatctaaaaaaatcaaattctagttataaatctaaacaactatatttagattcgtagatagaagttaaatttattttgagatggaggtgtactagccagtaattgtgtaatggtagtgctaattacagtgtgtaagtagaattaatgaaccgatcgagtagtcgtgtgatgtatatatactccctccttccaaaataaacttaagttcatgataggatgtgactttatgtttagattcgtttatgttgggacgaacgatcaacggtagtacagatagtactgtcctaatgtccatgctcagttgctcacaattcattcacacctgcgctgcgatggttagtacctttaacttgtagcgtaggacgtaggtgcatacgtaaggctgacgtgtgggtgacagaagttggtcatgggggtgagcgagtgatctatcgatctgtcgacgaacgacgacattaaatattttgtctcgatgtccaccatggtcgatggagacgactatcatatatactacagtgatcatatataggccatgccatgtcgttctctggtgatagatgcacgaggcaaaactaaagacgaagaagaagaaacagcagcagcagcagctaattaaagaagaagactacatgctgacgctgcaggcagatatgccgcgagtcacgggaagaagacgataaaaggggaagacagtaggaaggcctcccgggtttgtcgtacgtctcatttctgacccattactgatatggagtatatacgtatacgtttgtgttctaaaatataccactctaaacatgcgtttggttgaagaaatgatatgaatagggttgagtcgaactcaattttaaaggtgtttggtttgagaatgaatgggataggaatagcatgatcctctagaggaatactcctcttagatctgggtccaagccactcgagaaaatctggcgaacgagctcgacctaccggggttgagcgcacggcgtgagccgtaccgttcttccaccgctcaagctcccacgccgtccatccgcatcgcgccgcgccgctccttgctcgctggccgttgcccatctggtcatgatccagctcctccgctggcagatcttctcctccactccacctgttggattccgtcactactttgtttttgttcggcagctggttgtcatcaacttcctctccgtctctagtcgattgctggcgtgggcttccgctacaatccagtcgccatatatcgagctcctccagcagttgcttgtctcctccacccgttccttcacccgccagattacatcgctccgcccattagctggttgctgtatgtcgggctctaccacactgtcggaactggatatggacttagctgcaaacattacccatcttctaccaaacaaaatgattggatcattccatcctataaacaaaacaggaatcttggttcttaaaccaaacacacattaaggtcccctttggtttggagagtaaaaatatgaatttcagaagattttcatcctataggaaaaattcctatgaatacttttgaatcaaaggattgaatcatatccaatcctttaaaatcccaatgaaatggacaatcctatagagattttgaagaaaacttagcaagagctcaaagctcttggaaaatttcctttgagtctatctctctcatccaattcctgtgttttttctatggtctaatcaaatgttcattcctgtgtttttcctatgttctacaatcctctattttaaattttcattcatgttagaatcatgtattttttctattcctatctattttcattcctacgatttaaaggggctctaagattggaggaacgtttctatttagattttagattaatatattttgggatggagatactaactagtatcaatgctagattaaattaactaggagtgagatgaataataattgaatactacttctatgatcgattgatatggatgtgtggtttagctagggaggcgagagcgaggtacggtgaggccacgtatgcatgtaatgggatcgaccgatagaatctgtcagatcaggttatgttcgagcctgtttagatcccatgtcacgttttttcatcttatcacatcgaatatttggacacatgtataaaatattaaatataaataaaactaattatacagattatgtgtaaattacgagacgaatcttttaagactaattgctctatgatttaacaatatgtagtaaacatttgctaatgatgtattaattaggcttaataaattcgtctcgcagtttacatgcggagtctgtaatttgttttattattaaaccacgtttaatattttaaatgtgtgtccgtatatccgatgtatcgacacggcaaaactttttacactcgatctaaagacagccttagtctttgccttctgtcggctgcctgagcccctgacagtaggttcattatcttatatactactaattaacactccctcatcttaattatatggatcacagtacgtgtttgcacagcacacggcgacacacaccacgagctagcgtacgtgcagctacgcaatcggttacagcagcggaggacggcgggttggcctggctctggcttggcttggttgcatttgcatatacgatcgacgacgcacagttgggcgtggggacgaagaggaggccacagcgaccgaccgaccggacaaatctctgcagctgatgatccccattatcaatctgatgtaatgtaccgaacacaggttaccaaccaggaacatgcattgagctaggtaattaccccgatggcaaactgttgaaatcaaaacatgaaggatggcccttcttttacatgcatggttaataagtattttggtgggactagaatgtctatactacttttaaatattattccctccgtttttaagtatatgattttttaagatacgtttgatcatttgtcttatttaaaaaatttatgtgactatcatttattttattgagacttgatttatcatcaaatgttctttaaacctgacttaaatattttatatttgcataaaaactttaaatagaatgaatggtcaaatattttgttgaaaagttaatagcgtcgtatattaaaaaggtggtagtatatagtagtgatggtggtggtcgaatgtcacttgggttcatgatgttaatcttcattgtatgaatcaaatacacatgggtaatttatattcaattgtttctcactacgagtgactgtgtagctcaacacacatgtacaaaattgtaacaaaccctgttgcatatggatatgatgtttcactatatgtatcgcaggggtatttagctagtttcaaaagaaaccgtatttgaaagaaaggatatggtacaccatttgggaggccaactggatcccctcaagccacaatctcaaagtcaatacttacaccgccagaaggtaaatttctcttatcaaacttaggtaaatgatttgaataatctagtagtttgggatgaatacctggtctaaagtttattttcggcagttaatcgaattttagagataccactggtagaattccaacaccagtttgttcactgttagatatgcataggaaatgctacttaatggagaaggcaacgctgatatttctggtgttcgggatagactctagaagatgaatctgcctgaaaaaaagttaaaatctttggttgaagagctttacatggcatggtgtctcctgctccaggagtactagcagggaataaacacatcaataatcagggaggttgtcttgtgtgccaaactgatggtggagattgtggataccccatacctacacgacatgtatatccgactgggtatggggtgccatgtatagatagaatatctttaaagggactcgggttaaattccaaacttgtatgtcaaggaaatacccgggatcctagttggttacgattgtattttgtatgtaactacctattccattagagatatggactgtacttaggaggggtccgggtgcctcttggggcacgattttgctcctagatcatacgatcaataatacactcggcggatcaatccccggacaggagtagggtattacttcttgttaagaaggcctgaacctgtataaaattccttgtctctcaacccatccacttttccagcttgatagccacccccttttagtattgccgaaatcttgtttcgacagttggcgcgccaggtaggggtagcgtcaagtttttcgccgactagtgcgatgggtttcgtctctggcatcgacgactttgtcttccctctcgggcaggcgttccggttcggcagcctcgacttcatcaccaacgacttcggcaagatttctctcctcgactcggattcgaaccagtcgggaagaggccaggtttccgccccgttcggtatcccgaactcggccgagacctactccaggatcatctcaaccgagcttgcttcaaaccactcagacgagatccaatctactccaacacgacctgatcaagacgatggagcttatccctcaatcctgatgaaactccccgatgacttggctgccgtcttcaccacaagggcgtcctctccccgtaggcctacgcgggatctggcctcgaccccgatccagtctggctcccgggaagttggcgtcatactccagcctctcggcacggtttcgacggaacaataggacggctacctcagctcccccggcgtcgactctcgaccaacggagatcgtagagtacgacgacttcggctaccgctatgactaccgcaaccttgacgacttcaacgaaggctacaaagataactacacgcccctctacttcggcattttcatggccgacaacgagacggaagagcagcgtcaagcctgagaagcagaagaacagcgcgtacgacaagaagccgaacgttgccgactggaggaggaacgccaagcacaagagcgagagcgactgcagcgtgagcaacaggagcgcgaacgggctgcaaaggaggctgagtaccggcgacaacgcgccttggaggccgggcgacgagcacgagagctcatcgggcaacaagacgtcgaggggacgacggtttttcgcacccccccagcagaacacggttgcagcgatcacccttctcgacaccctcctcaaggaagacacacttaattaggccaatcacgtcgtcaacatcttgaactagactaagaccatgatcaccgcttcggtcccggtcaactccgcaagcatccgtacgccgactggcagccgagttccgcctcttcgatctcaagactatcaccaaccaagcctcagcgtcgtcagtgcaggatccagccgcaggagcagggatcacggcgaatgatctgtccactcgcctcctgaccggcacagggagcgtcgggctgaacatccccgctccccacgtcgcatgcatcccatcaatcttcgcgaaactatcaaccagcgccgtgcggcaagaggctacatcccccaccattcaccagattgttacgacgacgacttggatggagatcaatgctgttcagcccgatacgccccaatatcttcggtggtcagagacagttatcaagtttgaccgctcggatcatcccgaccgagtggtccacccggggcggtaccccctggtactagacccagtggttcgcaatgtcaagcttcgaagatccctcatcgacggtggcagcgcactcaatatcctttttgccaagactctggacgacatgcagatccctcgcgcagaattaaagccgagtaatgcgctctttcatggagtcatccccaggctatcttctactccactcggccaaatcactctgccggttactttcggcactcgggagaactttcgcacagaaaatatttgcttcgaagtcgctgatttcgagatagcgtaccatgctatactcggacgcccggcgttagccaagttcatggctgtcccacactatacctacatgatgatgaagatgccaggtccccgaggagtcatatccctgtggagcgacatcaagcaagccgtcacatgcgacaaggaaagctgcgagatggcccagacccgcgagatcacgcttgcccgagaagaaatccgactggctgcgtccacagcaaccgaaggagaagtgcctgcaaccaagatgccaaagagcggagaaggcgatgccaagaccaagaaaattcctctagatccctctgaccttactaagactgctgtaataggcgctgagttagattgtaaataggaaagcacgctcatcacatttcttcaaaataataaagatatctttgcgtggaaaccatctgatatgcctgatattcctagagaggtgattgagcactctttgcatgttaaggaagatgctaaacctatcaagcaatgactccgccgtttcgcacatgataggaaggatgcgattaaggaggaattgaccaagctgttagcagcaggcttcatcaaggaagtcctacatcccgactggctggccaacccagtcctggttcggaagaagacggggcaatggtgtatgtgtgttgattgcaccgacctcaacaaatcttgtcccaaggatcccttcgggttacctcgcattgaccaggtagttgactcaacggccggctgcgagttactcagttttttggattgctactcaggatatcattagatccgactaaaggagtccgactgcttgaagacttcgttcatcacacccttcggggcctactgctacatcaccatgccttttggattaaagaatgcaggagcaacttatcaacacatgatccagagatgcttttcaactcatattggtcacaacgttgaagcttatgttaatgatgtagtcgtcaagaccaagcagaaggataatttgattacggatctagaagagacctttgcgagcatccgcgccttcaggatgaaattaaaccctgaaaagtgcatcttcggagtaccgtcatgaaagttgcttggctttatggtatcccatagaggcatacaagccaacccggagaaaatcaatgccatcctcaacatgaaactgccgagctcccaggaagatgttcaaaagttaactggctgcatggcggcgctcagccggttcgtctcatgactcggcgagcgggggatgcccttcttcaagctgctaaagaaaaccgacaatttccagtggggacccaaagcacaaaaagcctttgaagacttcaagaaacttctcactactctaccggtcttagcttcgccacatccgcaagagccgctgttgttatacgtgtcggcaacttcccaggttgtaagcacggtcctggttgttgagcgtgaggaagaaggccatgttcaaaaagtccaacgaccaatatatttcgtcagcgaggttttggccgactccaagacaagatatcctcaggttcaaaagttgttatatggtgttttgattaccatctggaaattatctcactattttcaaggtcactcggtcacggttgtcacatcgtttccacttggggatatacttcataaccgcgaagtaaatgggcggatcgcaaagtgggccttagagttgatgtctttggatctatctttcaagccgcgaacttcgatcaagtcccaagctttagcagacttcgtcgccaagtggaccgagtgccaggaagacacgtctgcagagaagatggagtattggactatgcattttgacgggtcaaagaggctttcgggcaccggagcaggagtagtcctaatttccccgactggagaaaggttgagttacgtattgtggatacatttttctgcgtcccataacgtggcggaatatgaggcgctcctccacggattaaggctggcgatatctttgggaattcggcgtctgatagttcgcggagattctcagttggttgttaatcaggtcatgaaagagtggtcctgccttgatgataatatgattgcttatcggcaggaggtacgcaagctagaagataagttcgatggcctcgagctaacccatgttcttcgacataacaatgaggcagctgacagactagccaatttcggttcaaaacgagaagcaactccttccgatgtgtttgttgaacacctttatgaaccaaccgtaccaaggaaagaaacagccgagactacggacactcaagtagtagccatgattgaagctgactagagatagcccctcatcaaatttttgaccaagcaagaactccctcaagataaagacgaagccgagcggatttctaagcgcaacagactttatgtcatacatgagaccgatctgtacaagaaaagtccgtaaggaattctgcaacgctgtgtgtctttggaagaaggacggcaattgctaagagatatacactcgggcatctatgacaatcacgctgccgcacgaaccattgttggcaaggcctaccggcagggtttttttctggcctaccgctgtatctgatgctgacaaaatcgtgcgaacatgtgaggattgtcagttttttgaccgacagactcatttaccagctcaggagttgcaaaccatcccattatcctggccgttcgcggtttgggggctcgacatggttggcccgttcaaaaaggctatcggtggttacactcatctctttgtagctgttgacaaattctccaagtggatcgaagccaaacccgtcatcacaatcacaacagacaaggctggagattttttcatcaacattgtgcattggtttggggtacctaatcggatcatcactgacaacggcactcaattcactggcggagtatttaaacatttctgtgaagactttggcatcaaaatttattatgcctccatagtgcatcctatgagcaatggacaagtcgaacgcaccaacggtatggtacttcaaggaataaaagcacgagttttcgaccgactgcatccctgtgctggcaaatgggtagaacagctgccgtctgtactttggtccttgcgtactacacccagtcgggctacgggccagtcaccgttctttctaatctatggtgcggaagcaatgttgccaagtgaggtagaatttgaatctttgcgatttcgtaacttcagcgaggagcgctatggagaagaccgagtggatgatctcaaccgactggaggaagcccgtgaagcagccttaatccattcggctcgatatttacaagggatgcgacgttatcacaaccgcaatgttcgatcacgagctttcttagtcggagacctggttttgagaaaaattcaaaccacacgagatcggcacaagttatctcccttatgggaaggaccgttcataatttccgaagttactcggccaggttcttaccgactcaagcgtgaagacggtactagtgttgacaactcttggaatattgagcatcttcgtcgtttttatgcttaggcattacttttgtactttcctctttgactgctaacatcaagctactccttgagttatcagtcgggggctactataataataatggagtgtgatttttatcaattcaatttgcttacttgatttatcattgctttgttcgattttttggcttagtcaatgagtactgaaagtttttaagaacttttgcgggttttaggctcaataaggtttgacagaaacttttaagaaatccggggctgagtttaaatcatcaagcacaacataaattcatcagtattgtacaaattgtgcctccatcatcatcagaatacaaaatcaatcagattcagttttttcatcatcagagttatcagacccagtcggcttaagatcgttgtcatggaacctctcaactacatcagcggctatcttgtcagcagctttttgcacatcactgatgagatcaagggcggcttcctcacttgtcccatctgcaaagccatcaacagcatcaatatcaatcttcgggtaccaggacttggtcatcgccaatgccagactcacccctatatttccagcttctttgatgttcttaaaataggtatctagagtagatctcagtttgtcgaagatttcgacagcatcaattgaactcggaccattgttattgaaaaacatggcttggaccgagtggcgtagtggcgttggcgacttcgtctctggctccttcaagctttttgattttgctgaccaagacattgaattgagcctgagatttgactttacgatctgcacaaatggttcacattaacgataaagcatgaagacaagaatgctttcgaggtttcagcaacaagtaccttcgacgtcttttagagccgagtctctctgtttggtcagttcactcttgtctgtttccagggccttgattcacttttctagttcggatatcttggcagcttgcactgtatcgttgcccactggtcaatcacatgtgaaaagcggctcagacaagtcagacaagaataaaagttacctttggacgaaccgctccgctcaatgttggaatcttgaagctcggcgattcggtctctaagatcatgttcagtttttctagcaagctccttggcttcacgaagttggtctctggttgcttccagggttccaaggtgggggaccaatctctcgagagttgcggtcttcgccttatttctaagatggattctctgcattgcaatttcatctttattcagtaaagttgccgacagggtgattgaagctatgggtaaagagacatacatttacaagacgagtggcttgactgagtgtctttttcagcagacatacttcctcgtcttccttctgtttatttattacaattccctgcggttgcatttcatcatcccaccacttaactaagatgggtgggcaagaatcttcagctaaccgtatccggaggacctcttcttcatcgccgaccattgggccttacatatttatgaacgatgataaagcaatcgaagaaagtttgtcggatcaaaatggatttggatcttctgtttacctgttatgacttctggtcggggacgagcaggcccttgcaccctaacaggtgagcctaacctcgggtcggcgctggtatcttttcggagagggctgcttgtttgagcctctacttccgggatgtcttcattttgttctatacccgactggtttccagtcgggggctcctgatcagcacctatctcagcttcggccgactggtttccagtcggaggctcgttgctggattgtacattgtcggttgctggttgattattactcgggcgatcttcggcagttggcccggtttcagttgtaggaccagtctccgtgctggtcgtttcagagttctttctagaaggatcgatgtcatatggcttcctgcaaatttgagatatgctatcaacactacttcaatggtgaatgaccagcgatacgagggaaattgctaaatgactcatacctggatgacttcctgatttttggtatgggacgactggatgttttcttctttggattagcttgccttggttgtttctcagtcgcccctttgttgcctaccttttccacatcgtcgccctcatcgtcacttgaaaccaacttcctcttacgagagtctgactggttaattgacttcgaggtgttgggttgaacgtcggactggattttcggccctccactagcctggccagtctgccgacggggtgagcggcgttgagcgatcggaggatccgacttcatcaaggcgaattcctgtgcatgacattccaagttttcaattaaacttgtagaagacaaaaagatgtttttcagagaggccgagatgtttgatacgtaccggaggaggagggttgaaggcattgtatggcacgactggcaacaagtgcgaatagccgaccacgataacattcgagaagattttgtacattctctcctgcatgattttgaactcaagagattctgggtcctctcggttggggtcttgcttgccgtcaaactcgaaggctgtgcgggatctctctttgatttgctccccttgcagaccctgttctttaagcttcagcatgcggtccaacagggcaagtgcttgggcggcctcttctcctatgggaagtgagttccaggtatctcggtatactggaggaagacaggagtacccgggaaatgctggctcggggttttgcacaaagaaccaatttgcatgccaacccttgttcgaggtcttgaagggcatggagaagtatttttggctcaaggttacccttagttgaaaaccggctcccccaacaacgcacagtttgctcttgttcggctggggcttgaggaagaagatgcggcggaatagggcaaaatgcggtctaacacccaaaaaagcctcgcaagcatggatgaaattggcaatatggagtacggaattggggtttagatgatgcaaactaatcccatagaaatccaaaatcccttggaagaatcttgaggttggaagagaaaacccaccgtagaagaaatgggagaacaccacgacctcgtgtgtatcgggggtcggaaatgtttcaccgcacgccagacgccacccgatgatctccttcgccggaagaacactgtgcaccaccatttccttcaagttttcctctgtcacatcggaaggcgcccactgactctcgaagctttctctctcctccgccatggatgcgaattggatgatgcgatttggtttgagaaatggccgggaatggaagggagacagatgcggtggttgcgcagaagatttttgtggagctctagcgaatggattggagggaatttgtgaaccctagctttgccggtgtggtttcgcactgtagcagtgagtggggaaagtggcgagagtttcggcggggaagacgaaacgacgccttgccttcggcgtttatttcgctaggatatcgaaagtgctaatgggcctgggcctaaacagtatttcagcccaattttattatcagcgtggctagttgtgatccttagggacttaggcatttgtttttgctttggcaacacttgctcacgacagtatagcccaatgctgattaaaatcctttttgacgcagttagataattttttggaattactacaatgcacataaaaaggtgcccaacagaaaagtgttatactaattttgtaggccttcttaggctacaaagctgttcgggttttgttgagatgactggttttgaatagtcattctctcagcatgttatatgcttattttaatcatgacgtgagtcatagcttaggctatttagactcatcgtttgtcatgctttataccacatttgatggatctttttgagagtttttactcggatttttatcatatgtgttgatttatagacctttagagtgttttctcactcgggcctctttatatctccttttttgtgtattaaagctaaagcagtcggctggatgttttactaaacgtcgcatatgcttagctatatgatacattgggagactaggttgtaaaaccactcggatggagcccttcacagtctttgattttggtactagggagaccaagacaaaagaagttggagcactcggattattgcttgaattacgagagaagactatcttcgtcgactgtaaaggtctcaggggctactgtggagattgtggataccccatacctacatggcatgtatatccgactgggtatggggtgccatgtatagatagaatatctttaaagggactcgggttaaattccaaacttgtatgtcaaggaaatacccgggatcctagtctgttacgattgtattttatctgtaactacctattccattagggatatggactgtactttgtaatacgaaccccttcccctatataaggaggggttcgggtgcctcttggggcatgattttgctcccagatcatacgatcaataatacactcggcggatcaatccctggacaggagtagggtattacttcttgttaagaaagcctaaacctgtataaaattccttgtctctcaacccatccacttttctagtttgatagccacctccttttagtattgccgaaatcttgtttcgacaccgattgcgaggatatttaacatattcttttcacttgtgacagggctagaaaggtttcgacgaagatgggtatttggaatagaattgagaatatattgaatatggatcgatctggctacgtggtactaccagaaataattatgaggggaggcagttaccacgacttaatgatttgggcttaatttgttaaaattgttttcacatggggtggtatacttggtgagaaaggacacggatggttaatggtgaaagggtccaaaccactgtctgtcctaactctaaagtataattgcaagtaaacacatccaaaatgcaaaaccatgagaaggatggcacaaacccccaagggtttctcaagattaatgttggatgtttcatttgacattgattcaggaatcaggaggaactggggcaattgttcaagacgcaccaggaggtttcatagcaagcgtgtgtatgtataatatttgtatgtatatttgtatacaattaatattcttcgggaaggaccttttctagctaagcaactgaggtgtcatgttgattgtaggatttctatccctgtatggagcaagaaaacggatgcgcaagtttattattagggatgcaagcggaacgggcaagcggacatttttgtcccgcttatcccacttcgtttattttttcttttaaattttgtactaccatgcgaaaaatacacttgcaagtgggtttttacgtgggtagcggaattacccatccctatttattatccaaacttactgcttgtaggtagtggagacgatgcaagatggaggattctcgactacaaaattggctgcaatttttcacgaatgtggtatgttgagatttggtttagagaatatctatatagagcactgtaataagaggcaaactgcacgtaaatccgcctgtgtatctacaatgtagatacggtgctcaaggatcggaaccacgtgtgtgtgtgtatacgatgatgtgtttagcgtcggcgacttccttctcgactccgctcggttgggccagacgttggatcacccggcccatgggccattagccccgtccatttctgggcttcaccgagaaggcgccgtgtggcccatctcttctccacggcccatctcctctacgggtaggaataagttcatctgaggccccttaactcgtcaacgaattcgattttcgtcgctcaaccagaaaaccagacataacaggtccctcaactatcaaaaccggtgcagattagatccctcggcagttctgagggtgttgttgactgatgtggcgcctacgtggctaatttgactcggtctttatttgacgtggcattgacatggcgcttacgtggcaattcgatccggaaaaataataaaacccatgggacccgcatatcaatctcacacagtaaataattaaaaaaaggtaggacccacgtgggccccacttatcagtccaactcacccctcctcttcttcctcctctcttcccatctcccctcttcatctctcttgcgctgggggatgggcagttgggcaccagatgcggccgacgacgacgacggcggcggaaatggagaagagcggccgccggccatctctcttgcgcgcgctcaccggtagaccagggaaaccaccctcaaaaccgctgcgcgacgccgccctttcccgccaccaacccctcgcctccggaggacggaaacctcgcccgcgcacatccccagatccatggccgtctgcccgccgtgcgctacccagttctcccgcgcccgctgtcagaccacctgcgccgccatctgccgagtccgcgggtgaacggcgacagcaacagcatcaagcccgccctcgccgaccacaccgcgcagttgctcgacctagatctgctccccggcgcccatgcacggaagcccccgggtgcctacagtgaagcggcggcggccaaggcctacccgtcatgcgacgccatcccctgcgaccagttcgaggtggccttccaggccgtggagctctggatcgccgaccacgccgtcctgctcgtcaagaactcatcacacgcacatatgcactataatcaaacctacaggctataagtagtgatatgcatacaggatccattttgaggcaaccatagttgagagagctacattggtaaatttatgacaaaaaccgtagcaagaaactattcgattcaggacaaaaaaagaacaagccaatccagggttcgtgctcgccgccggcatccaggacgacgccgggaacgtgacgcggatcgtgatgctggcgcgggagcccatcatcccgcgaacggaccggctcttccgaagagaggggagatggggggagaggaggaagaagaggaagaggaagagaaagaagaggggtgagggtgacatgtggggcccacgtggccccaccattttttattaatttgtatgtgaaactgacctgtgggtcccacgggttttattatttttccagataggattactatgtaagcgccacgtcaatgccacgtcagatgaagaccgagtcaaattaaccacgtaggcgtcacgtcagccaaaaccaccctcaaaaccgccgagggacctaatctgcaccagttttaatagttgagggacctgttgtatctggtttttgggttgaaggacgaaaatcggattcgttgataagttaagggaccttaaatgtacttattccgtacgggtacggtgctgctgcttgcaacccgtgcggtgggctactctccaaggtgggccgcggtgattgagaaacatttttttttcttttcttttggagcacttggtaaattggcaagtgatctatatataccaaatgaaaaaaaaaaatgcaagcattccggtaagaaatttcgtccgccgtcacctaaatttttttcatccaccactctcgcgtcatgcgctcgtcatcccaagtccgggtcgaatcgaatctgatcgagatttacgtgcatgggattaaatttaaaccagttcgtattacaccaggagaatttacatatacgacaaacaaaaattggttacaaaattttctcaagttacaacccaaatataagaattaacggtagacgaagaaaataaaacccaaatcaagcaaaaatccagccactggaatcacggtttcaccggttctaatcttgggctgcacataacatgactcatcgcatacgctcccaataggcttcgcgctgtcatcggaccttgctggagacacgagcggcatgagtttgccgccaccaccacctcccaatgctagatccagtgaggagggtacgtgcggagtggccgccgggagtagctcaattgagttgtcgctgccgccagccaccgcatcacaagaccagatccggtgaggaaggggcgtggagtggccgttgggggtagcttagttgagttgtcgccgctgccggccaccacatcccaagaccagatccggtgaggaggaggcgtggagtggccactggcggtcgctcggtcaagctgtgcgccaccactagtggcgggatccaacgagcctgaagccggatatagcgaggagccgaggagcagggcagcgacgacgtcccgacgaggaggaaagaggtcgacaatgggggggagggagagtgctagagctggggagggagaccgatacatgcaagcatgccacatccacacattaagcatataaagctcaatatgcaagcatatactctcaccatctttgaatatttgacgccgttgacttttttaaacatgtttgaccgttcgtcttatttaaaaaatttaagtaattattaattcttttcctataatttgattcattattacatatcattttatgtatatatatagttttacatattttacaaaaaattttgaactgtcaaacatgtacaaaaatttcaacggcgtcaaacatttagggaaggagggagtagtaattatatctataatttatttcattctaaaactaaacatacccatactaaatcatcattctcaaatcatttttataatatttcaatccaaatcatctcaccatttttctaatatgtaatataattaccacatcaaattaagcgcggacatcatctagtatatattaaattcccagtacatgcgttgtgcaaaagcgtagtgagtgcctagtatagtagtacacatatgtggccacacttgtcttttccaaaactaaaggcccaaatacgtcagtacatacgtacgtcagactacacagtgatcgatcactgagatgtacactagctacatactagtatatactatactactactagtactatagtataggagtcacgcacatgcaggcaacgtcggaggcgcaacacccggccgcccggttggccggccgccgccgccgagattgctttctaattctaccaaatgcagccgatggagcgagagacgaagctagcagagagcagataaacatccaacgatcgatcgatcagctatttagtcgtcctagctagccttggatcatgacgatgcatgagcatgacgacacaccactagaggcgcacgagctcgcgagaccattcgatcctagctcactactggagaaactatcttttccggtcagccaaaaaccacaatagtcccggttgcaataaaaatcaggactaaagatggtttttaatcccggtttataagcaaaacgggactatatgaactttagtcccggttattaccaccaaccgttcacacgctgtcaagggctgtcagggctctcgggatctttagtcccggttagtaactccaactgggactaaagttcggatatttaatcccggtttatattatcaaccgggactaaagatcccggtgatctttagacccggtgagtaataccaaccgggactaaagtcaggtaccgggactaaagatcaaaacgcactatataatctctagtacttttcctcttctccaatccacacacaaactcctccctcttctcccctctaatccttatctctttccttgctcttaccttatctctttccttgtctttccttccttctcaggaggagtgagcgcaggaggctggaccggctgggtggtggcctgcgcggcggcgtggcggtggccagagaggaggggaggtggcagcggttgcaccggccgtgggcacgagaggacggcgggccggtggatgggagggcggcggcggcggccagcggccgacagtgcccactcgtggatttttgtcctttcttttttttcttttaagaatttgtgattcgattgagataaagaatttgtaattcgttgtatggattgagatatataatttctttttttttgagaatctgtgatctgagatgtataatatgtgatatatttgatttgtgatatttgggatgttactttgatttggggtttgatttggggatatgcatcccacttgattttggggaaaatagttagggagtaagtagtaagtatcaacagaaacaatgaaaaaaaaataaaaaggaaactaaccgggactgtcgacagtcccctctttagagataacgatctgccggattcgaaggcccggttgaaaaaccgggactacaaagggttacgaaccgggagtaaaaatgatctctccaccagtggcttaattaagtttaatttttgtttttaaatttaacttgccacacgcacgctggctcgctccattgctgaatgtccgtgttttgctatggataaaagaaaatgtattaatgtgttcttcattctttttactgtagggaatattcatcttaatctaattttttacatggctatccatttagatttgatcccttttaatattaataagttcaagggggtaacttgtaaaatttacaatggaactagtgaagtggcagattcactaccaccatcactattttcttttataggagcatagatattaattcctgaagtttacataataaaatcgttcaccattgctgtagttttctcaaatacgtacccaaagtgtagtaaaatgtaaaatgatagtttacaataattggttgtagttttttaatataatcatttactattaattgttgcaattttgtgaaacacccagttaaagttgtagtgaagttacagattgtaacaaatggttgcagttttctcataaaaccatttgttgttgttgtaattttgtgaaaagtacctaattaaaattgtagcatatcgatagtattgaatacatggttacagttttgtggaatacacagttaattaaagttgtcacaaaatgattggtttgaataaacggttgaagtttgggggaatctacttttttacaaaaattaagataactattcacatttttctaattttatgtgaagctattttttttaagatcggatttgatatatcactgttcgcttttgattccaatgatatatatagtatacaataggttctataataaaagtcaagttgtataactcttagctagcttgtattagaagatcatatacttgttgtgttgaaccaaatccgtattctcgaaaacagaaagccggaagaacagcaatcgctctaataagttaatttttgaaagaagttaaaattagcttccctaaatataattatattttgcatacagctatatcaattaacctataataatttggatatacgatgatttggactatactttttaaggtaacgtggtgtcctttttcaagctatatatatagtgctcgatcgtgtacttctagtttgatgataattaattatataacctgggtatagaatcatactggtcgtacgtaagtaccacatacgtacgtacgtctatgctagttgaattctatccggcagggcagaggatcatatcatatcgctgactcaatggagtcttgcttggctgccactatagtgtgtgtgtgcgcacatgccgtgcgctcgatattgcactttactgtaccacatgcatgctagcctatcagagagagattaaataaagatgctggggtacatttgcgattgagccaagcccacgtgacgtgagctagctagctaagtaggggtggcaacgggacaaggcggggccaggttgaacatgaacgcccctgccgccccgtgcccagccttgcattgctaaccgggtggaaagcctcacccgtcatcgtccccgcaggggacctcgtgggtgagtgaggccccacaattccgtatagagtcaatacacatcctctaatcaatgcaataaaatgcataacaatattctcaaaccaatacaaacaacaccataaatcaacaaacacatagagtcaactcgttagatctgaactctgaagctgcccgagaacaacctcgtggctccagcgatgaatcgtgttgtggtacaccggtgagatgaccgatggccatgagagacaaggcagagaggcgaggcaacgatcatcggcggtgagaggcgaggcaacaaccatcggtgatgagagacgagccggcttggtgacgcggcgacaaccgacgagatgataaggtggcacagcgaagacagacggcgatgggagaacaaggaggctcagcgacgatcgccactcggcactgtggcgagaggcgcagcaatgaacagcgctgtggcgagaggaggcgatgagcggcgttgttgcgagaggcacgcgcagtggtgagaggcgccacggcgtggaggtgagggtcacgcggtgagcgacgtgtcgagcggcgactgtgcgttgagtgggagttggggaattatggttttagtttaggggctgtctatataggaatcgaatgatttctgaagctccaatcatgcagattttatctaccataggatgcacatccagcaactcagaaaaagtgatacaaatagatattacacttaaaaacagatatattatttgattatttgaacgccatttttttaaagcccaaatccagatccagatccataaaagcccaaatccatatccagatccataaaagcccattagtaaaaagaaggcccaaaatacaaaatttgaatcaaacacaaataaacaaagcccatgattttttcgcccatgcgaattatttgaaggcccaagtccatatccagatccataaaagcccattagtaaaaagcaggcccaagatacaaaattagaagcaaaacataaggaaataaagcccaaatcataatccaacagcctatccaaaaaagtagtagggaccaaacttggaagccaagtagatgaaaaacatgtcacgtgaatcaaccatgtatgggaccacacttttcaatcccctacttttcaacagcactactagttcacaaacagatctagcacgaatcaaacatggagctaggagaagagaaagaagagagaaaaagaggatccaaatcgcagatggaaggagagagtacaatgtcagaatcaaagagtagttctagaggaaagaagaaatcaaagacaacttttgaacagaaagttgagatccatacaaaggaaacacagaatctggagaacacaaagaaaaaacaagaggaaggcaaaatcaagagaaacaagaaggctccagttcaaggttagttcaaggttccaattcttatcccctatatacaattcctgaaaaagatcaaagagagagtttaggtcaaatatacaattcaaaagaatacatgaaattgctgaatatgtcaaatgaaacaaggttaacaatccactttgctggataaatacaacaactcagaactgaaaatttcatatgtttgctctgtagatctgaactatgtaatgttaaaagtaaaactacactgcattcagtactacaaaactgcattctggatgattgtattactgtgtactattgatgaataccaaactaactttataaaaaaaacatgacagattgattagtcttccaaccttactgaatttcactctgaagatatcacagttatacagttatacagaaatatacactaggccatatagcatatcctgaattgtcatacattcaattttatcagcataatcaccatattaaactaatgacaaattcaaatctcaatgtcaaccacttgtctcatccaactcaatattacataaaagttcaatatctcatacagcacaaacaaaagagccaattcatatgaactcacaaatttcttaacatgttacagtaaaaaagtaataaaattacatacaagaatcacagtaattctagtattaactcattgtaaaaagattagttcagtaaacaaaatagtttagctcacacaatcatgcacaaattcaggaacacattcaagatatgttttaaactcaagactatctcagttcaatgtttctctcatcatcagacaacaaaatgaagatttcagataatagatcattgttgatttgttcaatgtctcaaaatagaatataatgaaactagttacagtgaacttgtattacaaatatatagagtgaacactacaatttcaattgaaaatacatgtaactacaaagaaactatgtaaaattcatatgaaatcatgatctaatgcagtttaatctcaatttcaagatgatttcagatttttcgagcaaaaaacagggtatcaaatacttcaaaagtagtacatatgtaaaaaccaaaacaaatcatatctaattgaaatagaaagaaatagaaaagaaaaagtgccatcagatagtttgttccataagtaaattttaactggaattacagtagcattacactctaattgaaatacttatttactgtaatactacttatggaacatactcatacaggtttgaaaaacatttaaagactatcttgaatatttctttacaggtgtcatacaaaaggacaaagaatgcaaaagttctaaggaaatagaaggaaaaaatataggtaaacaagagttacagtaaattttaactggaattatagtagcattacactgtaattgaaatacatacttagtgtaatattaaaattattttgaaagaattatacaaactaattcatttgttcacttcactgtctataatcaagtatcaaattgattgtagttggatttttaagtagttacagtttctgtttactggaattatagtataatttctctgtaatacaaatatatgttcactgtaaatggacttatgaaaaagattgggaaatacactctatgtttcagaacttgctggtttagaaattcaaaagttctttgcaatattaatttattctttctatgcaggtggcatacaaaaggagaaacaaagcaagagttctatggaaatagaagaaaaagaatcaggtgaacaagataatttcaaattttattcacaaataagaagattaaaatgagtctgaaattttttaaaaaaatgccatcagatataaaaaagcacttcaaagctctgacagaaatggatacagagattataagtcaatcaaatctgacagaaattaacacagctatgttgagctcaggtaagaaacaaaaaattatgtagttcaatgtattttttaaaaaatgacaaacatctagatgatctgaactatatactttcaagtgggtactttttaaaatctaaaaacattaaaactagttacagagaagaagtaataaaaatacatgtaacaataactgaaaatacagtatctatcttgacttccttcataatgatttttattttgcaggtatcacaattgaattgtcagaaggagaaagaagtattcagtcaaaacaaattcagaatatgaaacaaagtattttgacagagtataaaacaacttttgtaaactcaggtaagatcttacacaggtattcttattctgtttcagaacaattctttcattacagttaatttgtataaaaattacataaaaaactgtaattccaatactaaaaatttcaaactggaatacaaatttactctaatttttaatgttgaatcaatcaatctattgcaggcataataggtaatgaggtaggaagaagcaatgctctggatgaaccaaacacaggtaacaattcaaaatggaattgaacaaatgcataattcctttagtaaaaaaacacaaaatgcaaaaattacagtcaatttgaaacagaataagaataattttaaacttcaacttgattgttatacagtttgactggaacctatatataatttgatcacaattactttaattgcaaatataacagatcatattggattaggagcagaagatgcaacagtagaaaagcaaagtatggataattcagcaagtatgacagaagcatttgttgattacagcaacaaatattcatatgatgaattatctcttttcggatcaatgaattcagtaagttcatattacaaagtttttgctattaaaggaaaaatttgaaggtggtagtcaaaatactatatgaaaatttatttgcaggttgcaaatatgtcatacacaagcttaatggaacaaatcatatcatcacagcctacgatttctgatatgcaggtaagaaaaacaatatttgaatattatatataatttagttgtaatatttatgtttttattggaatttacaggaacaaaattcagcacactctatttttgttgcgagtccaagtgcatttcaggtatgaaatattaattatttaattgaatctaataattcaaattcaaaagcaaataagtattgatataaaaattttggtttgcagaattcaatgatattaacaacaaatcgtactgatgct

SEQ ID NO: 6899 - DNA, 2990 bp, Oryza sativa
ttcttgttgtagtattaaaaattatgataattttagtaaattttaactttgtaatgtaattcaaattccaggaagatgagagtaatgaagaggatgcaatggataattggaatcttgatatattcaatttgttagatggtgaaaaggtaatttttgttgtttgtacctttttctctagataacaatgattgatgattgaagtttcatagtctgcaaaaaaaagagtacaaacattaatatttcttaaaaaattaaattgaataattcagattagcaatgaataggctagaaaattaatttcagaaactaatggaactgcttttttttttgcaggaaccaagttcaatggataatcatcgatgtacttcagttcaaggaacaagagatgatgacaataatccaaatgataactctgaaacaaatcaacaagagctgatagaagaagacataaatattttcgtagagaatgaacaggaagaagctacaaagggcaataatgcagcaattgatagcagatatataccaagagttggaacacaatttaagaatattacagaagcacatgaattctttaacttctatgctctgttggctggattttctattgtcagggctcacaactaccacacaacaagcaagaaaaggaatggagaagtgactagagtaacgttcagatgtaatagacaaggcaaaccaacttctcaatccaaatcagtaagcgcagaggaaacagtggtttcggaaagaaatacaaatgaaaatgatgcaacagattgcaagtgtgctctggttatttcagagaggaatgagatttggaatatttcaagggtgcaattagaccacaatcatcaactaagtccaagagatgaagtgagatttctcaaatcacacaaacacatgactacagaagaaaaaatgctcataaggaccttgaaggaatgtaatataccaacaaggcacatgattgtgattttatctgttctaagaggaggattgacttctttgccttatacgaagaaagatataagcaatgtgagaaccacaattaacaaggagacaagcagcaatgatataatgaaaactttagaatttttcagaaggaaaaaagaaaaagatccacatttcttttatgagtttgatttggatgagagcaagaaagtgaaaaatctgttttggacagatgggagatcgagggagtggtatgagaaatatggtgatgttgtgagttttgacacaacatatttcaccaacaaatacaacctcccgtttgctccctttgttggaatttatggacatggaaacacaattgtttttggttgtgcatttttgcatgatgagacttcagaaacatttaaatggctgttcagaacttttttgaaagctatgtcacaaaaagaaccaaaaacaatcattactgatcaggatggagcaatgagatcagcaattgctcaagtatttcaaaatgcaaagcacagaaattgcttctttcatattgtaaagaaagctttcaatctatctggaaatttgctcaaagcaaaagaagggttgtatgatgagtatgaagacattataaataactcagttacagaagaagaatttgagtatttatggcaagaaatgattgacagctttgaagttcagcatatcaattttctaaagcacatgtggtcaattagaaaaagatttattccagtgtatttcaagggtgatttctgtccatttataaaaagcacagctctcagtgaagggactaactcaaggtttaagaataatgttggtccacagtacagcattacaaacttcatgatagagtatgaaagagtaatggatacaattcaaaacttggaacagtttgatgatcacatttcaaggacaaagaaaccaagcaaactttggtcccattactacattgagtaccaagcaatgagaatgtacaatcgcaaaatcttcatcaagtttcaagttgagttgaaaagaacaactagatttcaaataaatgaagtagagaagttcaaaacttatgaagtttttttggcattgaatcaaaatattcaagtaatcagaagaaggaagtaccttgttattgtggacttggaaaaggaggatttcaactgcatttgctcaaagtttgagaaagatggacttctatgctgccatgtattgaaagtaatgctccacctcaatgcaatgaagataccagaaaaatatattattgaaagatggacaaaaaaagagtacaaaggtcttgagggaaaaggcaatggaaatatacctttagcacagagctcaatcctgagattcaacattttgtcaaggaaaagtgcagaaatagcatcaaatggatcgaaaagctatgaaactttccagtttgtagtggaagagatggacaaaattgctaaacaattggaattattgtgttcaaataaagatgctgagcaggagatcaatgattcagatccaaatgcagaagacaatttgaactcacatgaaaaaggcaatcaacaatctgaggaaaatatagatgaaatattgttggatctagatattgcaaaatccaaaggcaggccaactcaaagatacaagacaatcagggaagaaatacagcaaaaagaactatatcattgcagtcattgtcagaggacagatcacacatttccaacgtgccctctgaaacacgttgagtttgacttgccaaggaagaagagaagaaaggttaaaaatacaagagaacaggtaacaaaaattacaaatccatatgaattgaatttttttaaaaaagtaataaagaaagatattatttgttgcaggatggtgtagagcagaaaaagaaagatgtttcaaacaaaagaaaagatttgcaacaagatatatcacaggagaagcataattctggggctgaattagaaggcaaaaagaagagaaattcatcttcatcaaaaaggggtggcacaaaagaatagaaatggaatgactgaaaatagagagaggtt

SEQ ID NO: 6900 - DNA, 30529 bp, Oryza sativa
tctttctggactagcaaaggttttgaagttttgtttctgagaatccaacataattctattcattttattgtacatcatgttggttttgtttccaatatcagcacatttcttagagaatttcttttcaccaataaaaacaacatcaggtgaatcctgaaatttaacaaataaattaaatagtacagttagaaacatattaaaaaaagaagatcaaaataactagaaataaaaaataataattattagcttataaccagaacagaaaaatgataaataaaagtaaggtatagggcatggaatatttgaaatatcaatatgaaataacagttaagcaaataaactagtgatgttcaacagcaaacttacaaacttgagattataaattgaataaaaagaaatgaataagcagtgagaagaaaaaccttttggaataaaaaaagaaagaatgtatgttattactagaactgaaatacattgtaacctacaagaattacagcaaaactatggagaacaataatgcaaaaatggaattagaaaaatttttaaacaccatttaatttcaaaaagggaacatcaatgaaaataactatgagattattcatacctttatgatgtgacaacctttttcattttctttgttttcattgagagaagcattaggagaagttgaattttcaagtgtcaccatgtacatcttatcctaaaattttaaaatttaacaaatgaaagtttagtttgtatatccagaagaaataaagaaagaaattaatgtcagaattaccggactgtctgaacagattattaggctttcaacagcagcagcaaaagtttgagacaactttcttggagtgatctgcaagatttgtataaatcaatataatgttctaaaaaagtattccttatgaaatttgaagttacttcacaagtaccttatttcttaaaacatgatttggggagtatgaatcaggaataacttgatatgaatctgcaagatgagcagttgtaatttcttttttgaaatcatcattttcatgatggaggtcatcatcagaaccccagattttaaaagacggttgatcatgaaaaacttgattgtttcgagctacagcaataacataagaattagaaacaaaaaatatggcaacaaaaagtaagaggaccatagtacagtgcactaaaatcacatgacaaaagaaatgaaatattacaataactcaatttttttgatgctagaacaattaaagatatacaagtaaaaacaaatgagattccattaaaaaaaatttaccagtcaaggcagaatttttctctgtttcatctggtggattaataggaacatgaccttcaatgttaaataggcacaaacatcaataattcatatttaattttttaaaaaacagattaacaaatttagaaaaaaaaataacctgttttgttcaactttgtcattatttcatcaatgttgatatgtttaatctgcacagataaaaaatgacagttaaaaactatcaacaattacagttctatatattcagattataatgattgaaataaaaatgaaagaaaaacctcttctgaagaattcaaaatggtagacttattcacaggattaaattcttcatttggaattggcaacttatcatcatctagtactgttttactgtttccctacaaaaaaaaataaaaggacaaaaaaatgcttaatgattcacatgactattagaataaaaaaaattgaaatgagaacagaaaacaatgtacctttggagatgaggtgaaattgttatttttttgcacagcttgattaacatcatcattattttcttcaactggttcatgatctggttcaattccttaatttaaaatttataaaaaaaatcaagacatatgaatggaaaaaaattaaaaataaaataaacaacaaaattcgtaaattaaaagtaataacctgaattttcatgtgtagtaggttgagtaggataattggaactgcaatcagctaacaacaacagaacatctataagaagtttcttagccttgtcttcaaagatttcatcttcttttccaaaatgattacagagcaaatgacaaattttgtcttgaacatcacttggcaacagatcaccaacagaacttttgagcatatcagcaaatgaagatgagctattattcacctaaaaaattaaaacagaattttcaatttcaatctaagaaaatttattagaacttgaaaagataaaaaatttgaaaaaaaaactaaacatttaccatttggtaacaagttgaagcaatatcattgactggtctttttccatacactccttcagatattttatcaaatttggaatagtccttaatcatagatcttttccaaactttaattcttggtgtatcaagtaatactttttgtgaaccaaagttgagaaaatccaggtaattaacctatgaaacattgaatatagaaattaaatgaatagtcatttagtacaaaatataaattagcataaatggagggaaaaaaatttaccgctaaatggaataaacaaccaccaaaagttttcgatttctcaatcttgctaatgtgttccatcaaccagtcaaaacctaacttgcaccagtccaaactttcaattaagtccatgtcttcaaaggcacttaggtattttgtacctggaatcaaagaagagtttggacaaaggaagcaattcaaggaaacaatcataaagcagatgagaatttgatcatcaggaaattcttcatttttaattaacttttctccaatgaacttgacagaaggaatagaagttttcccaaaaatctgaagaatcttttgtttgccagaatcaaattttgaatggattgtactaccaccaacagggaggcctagcacaacatggacagattgcttgttcaatggaataagtttttggcccaaaactatatcagaacagttcacatctacttgttttgcaatccagagagcaaaagaattgggaacaaaacacttgtcaaatagcagcatgctttgaaaacaagaattttcaatgactgttttgtgatgtggacttaaagaatcaagaacttttgagaaatatttgactgagaatctagagaatgcatcagacttcaaatcagtgtcaacatttttgtcctgacaaaaagaaaataaaacaatttaatcaataaataaaaaccaaacatagatataaaagggcattgcaaaaaactaaccttaaaattttgatcacctatgttgtgatgaatattaagcttttttttcaaactgttgataatttgatccctttgtatgatatcacgtagaacctgatttatcattacatcattgtccaattcaatagattcagaccatttcatctaaaaaaaattcaaaattaaaaacaagaatgatggaaaaatataaaatgaaaaataacaaacaaaataattaccttaatgttatcatcttcacttcttttagacttactgagtttccttttcaaagttttcagaagttcatttgtagaaatttcatttacatgtggttgtgaaacatccatatcctaaaaaaacatattaaacaattaaaacattgcaaatgtgctatgaaacatggctacaacagagctacaactgcatactaatgaaaaaaataatgaaagaataatggatactattctgaccttggaacaacatgacaattcaagaacaaataaaacaagaaaatattggtcctactattacattggctaccaagcaatgagaatgtataattgcaaactcttcatgaatttacaaatggaaatgaaaagaacaactatattacaaatcaatgaaattgaaatgtaaaataaacttacatgactggctgagttatcatcagaatcacaattgtaatcatcatctttagcaggcaaagactcagaattaatatcatcagattcacttatgggctggctacaattatccaattttgaacgcttttggtgaaccatctattaaaaatagcaataaaaaatcaataaagtttggcagactataaattataaaataagtgaaggtatgcattaaaaaaaagatatatataattcctcagaaattgaccactttattcaggaaaaaaatgaacattacttaaacatggcaaacgaacaaaattaactcccagtacaatatatacgttggttagtactttcaacttgtaagtcaaatgttatagtatatctccatgtcctcacaaatatatgcaaagaggtccacactatgataaaaagtcaaacaatctcacaaacttaagccctgtacacctgattcacactagggaacatgaccattccacagttggtctatgcagaggcacgcaatccaatgaatccagtctactacaaacattagcagtagaaccgacacaaatggcgtctaaatccctaaaggggaagaaatgttagacctaagtacataaacacgagtccaataacaaaaatggggtttgcactagagtgtaatccagtctactacaaacattatgaacagctacaaaaagacatccaaatcccacaaggctaacaaatttgcatagatcataaagttctcaataaactagcgtaacaaaatcaattaacctgcctgcctgccctaacttaacataaattaaattaaggggctgtctatataggaatcgaatgatctatataagttaaaacctatattgatctacacttcagatcaatatctcaggcttcatatttctagcttacatttgagtacacacaaagaactagaaaacaaaatacaacgtggatatagtacttatgtagcaatagtaatacaacacacaactaaatcacacacatcatcatgatgcaaagtttctgaatctgtacaacagttcttttgatgacccatctaataattaaaacaaagggagagagacaaaaaaaaagcacaaggagttattataaggatgcacatattagaagcaatggaaaaaatgaaatgagaaatagaacattgcatagcacacagggaaaatagaaacataatcaatacataaatcacagcaataattcactatcagatctacagctaacaataattcatcagctagcaagctaaacaaatagttgaagactacaaataaagtacaaatagtcagagatacaaaataatgcaacacaaacttctataaatccaaacatgagcaaacttcttcacaaacatcattcaaaacaaatcacacgcatctactaaaatagcaactcgcagattcaacaaatcacaacctaacatccggagaacaagggagcaactatagaatcaactcaaattcccatgggaaaaactagatctaactttacacatcacagatcacatagcacaattcgtaaatcacatatcacatatcacagatcacacatcacacatcacataaacgaaactttctagaacatcgcatagcacaaatttatgaacaaatatatcacagaaacctaaaaaaaatcacaaaagcaaaatcgaacacgaatcatggggattcaatgaaacaaacaccgaaacaaaaggtgctcagatctacgaaaactagaatgactagtactacagaatcaacgaaacacaacatgtagcatgctaaataggagatggaaatgaacaaaaaagaaaaaaaaaacaaaaaggaaagccactggaataatcttgcgcaatcgacggcgcgacacctccgcaacagcagcagacgccgagtcgactcgccgaagagcagcctcgtcgcctcgctaaatcgccaccgcgtcgccggagacgatgagaacgagacgacgaaatcgtcaacctctccttctataactctctctctctctccatcggcaaaagcacaactagcggagcaaaacaacaacgaatcgagcagcaagctaacaaatgaagctagagaagaatcaaaacatactcaccggagaaaaagaggagaaggagctcgaggacaagatggagaagcccacaccgcaaactccagtggaatcaccgccgcgacgtagcctgcatgaatccacaccgcggcgtagcttacgccgcgtcgtcgcttcccggagtcgccgacgaaatctccgccgaaatcgccggacgagacgacgaggaaaaaggcaaaaagcaaaatgaatctctcactctctctctctagtctgattcagacaatctctctctccggtgcggatttcaaaatttgaatagtgtatgtgggtcccaccattaacactctctcacaaaaaaatctctctctgtcggcaacacaaagtgggtcccacaaaaatgtaaaaaaaaaaagaagcccatttagcccacgtatggaagcccgaacttacaataatcaaaagcccacatacaaaagaaaacaaaagtttagatagcacgaatctcaaacaaaatccaagggaccaaaaaacgaatgatacagcccaacaaaaacatgcgacagccatatagcctttccgtttagtttatatatgggctatttaattgggccaagtaagcctacattgttgaaatgggctacttttacaaggaaattcacattgcagggtcccgccagatcacccatggccaggttggttacaacccgttccttccccggaaaattgccacccctactagctatagctagcgatctgctggctgccgtcactacaacgtttgttccctgtgctctaatatatagctattagttacatttttacggtctcttcgattaatctcttaagaaaatgggtgtgatattatgtctttttttctaagaactttattatgtcccttcaaaccctctctcggagactaatcgaacacggctttaaagagactgtaaagtcactccttaatttaagagaagacagccgtgtttatctagtgaaggagctataaactttgcctttcttaagaaaatgactagtcaagaactctattaattatactacatttcagtggccggtcattctgatccaaatgtgtcgtggtcgttaattaattaccactcaaaatcactgtccatagttcggcaggcgactcctaccagataagaataaatacattaaattgccactgtatacgtagtgctgatctatcagttaggaatatttgtacaatcatataggaagccacatggaactcaagtatgtccagctagccactcttaattaggtggattagtacatatatattagctttcctcctcaaaaataaaatgtggataattgtcagctacaattttccttttcattccactttcggaagttaagggaaagaaactgatagtgaaatattaatatataatatgcttgtaagaatacttgccaattgagattcggaaagtaacttttgcgtgtttttgaaaaggaggacaaagggaaccattttgactcgatggttgcatataaattaacaaccaaaactaacaaacggataataataatccataatcgattcctctttcaaggccatcgtgttcctcttacagttggttacataatccatgctttgcccttgatcatatagttaaattgctccgatcatttaatctatggctgataagcctagcaacaatgaactaagcaagcaaaattaatttttgggtaagacatttaaatatatgttttaaagtactttaaaagtctatactagaaaaaaaaaactactaaaaatcaatattattttacgagaacccctataaattgcaggcgggccataagtgtcctttcatgcaaaaatcacttccacaagaggtgattcaggggtcacatgtgacaatttatttttgcatgcgtccccttaagaggtccacctacgagaataggtgcattatcacaggcggaccttttgaggggccgcatgtgaaaatacatttttgcacgtggccaacgtgtgacccacgcaacccactccttctttgccttttcctcggtgcgcatacttcctttttatcttctccttctcctcctctccacctcttccctttccatcccatcactcatctaccactccctctccccttctcttctccatcaccggtctcacgagcaggtggcgtggagacggtggccacaggggcgggcgggcgctggcgtgcggatccactgctcccaacctaaggaacagtgacggcaggagcgagcggccacagcgaccggctggtagatccgccgtgcacagatcgaggcgccacccccatcctcgggagcgagcggccacgacagctggcgggcggatccgttgcccttgtccatcggagcaacgccggtgggcggatccgccactcccgccctcaggagctacggtggaagcaaacggtcacggtgaccagcaggagaattcgccgcccccgccatcaggagcgactgcggtgcagggatatgctgcccttgtcctcgggagcagcgggctcaggcagtgggacgggagcaggggcgacgatgatggcagtgatggaggctgcgatgatgacaatgacggtaacagctgcacgatgacgatggcagtgatggctgctccaacaacactggtggtggtggctgctccgacgacgacggcagcagtgactagtgtcgacgggagatacccgtagaccggatatagagggtattggggtacgctggtacgaggatctatgtaatacgacatcaagcaaataaaagacaaggattatactggttcaggccccttgataggtaatagccctaatccagttgatatgggattatatggtggaaaccacaaattacaaaggaaatagcagaactcgatgataccgacgagactgtagtcgagttggttcgactagatcatccggcgacttggctcctgtaggctccgactttgtaggctgtggtggttgtgttggcgatgagattcgatgccttaggtcctcccggggggtcccttttataccgcgggtcagttgatctccaagtagaacttggagatatcagaccccacatgatacagtaaagacccagttcagtccgagtaggactccttccgtccgtggattccgtttttgttacacgatgaatttccttaatgcgtacaggaaacatccgtgtacgcacaggtataccgtatcgatatacaacatacatcgaagggtagagggtataccttatccataaccctgacaactagagtttcggtagaatcggggacgctagggttttaggcgactttgttttttgggattttttttaccgaaactattttcacggacgatcagcataggtgacagtgtacgtcaatccctttttcacatgcggttgcgctacccgcatgaaaaaatgttagatttccgcagatacctggatataggcgagccgcttggtcatatacaaaaatcagttttggccatatggaaaaatgatttttgtacttaaaaaaatctcaaaataaactactttctaaatcaagttttagaatttaaattttggtcacgcgcgcagttgataagacaacaagtatacaatgagacgcttaaactagatatctggcgaagaccgaccgttaaaccaggaaagctagagcaatacatgaagtggtttaatccgagtaaaagaccggagatgcatatatgaacccacaaactcaacgattcaaccatttgtccgagtttaacaactgccgctaatttatatggtccaattacctcaaaacttgatgtaagcaaaagagacctaacaggatatgtacatatgcaaattaggtcaggtttgtttggtttgtgaactgtgccaagtgaaattttggcaacattttgctacacttggcgtttaactgttcgctagaggccaaaagtaggattaagtcgcattagttctccttatctatttataaagtagaatttcaccaaattaattatgctgggagctagaaaacgattttggcacatccatatcttggtaaatccaaaactttggctttggctcacacataggacgtatcctagctcctaacctagtccaatataattaattcacttggcatgcagtttactcaaatctagtaaaaaaaatatagcggccgttacccaatgtttcttctccacaatcatttcctaggggcaattgatcaataaagtaggtgcaagcaatccaagcatgcagccagtggaagttagaatcgatcgacaagagaaaaatcactcagagaaaaggatggttgaattgatcaggatgtatcaggccgcgtgagtgtaatgccaatatggcattgcaatctgtatattatattcatgtttactaataattaatggaaaaattaagtcctctgtgagctagagaattttctttagttttgctaactaataggctaattcatattaaaattaatgagtaaagacggataattcactgaatacaacatcacacaatgtcatgccaagcttgtttgtaccatacaagagccaattgccttattgcgagacgagatttaagagcctattaattaatggtgcattcttttcagcgtatgtttcacctaagctctacaggcgcatgaaaaaaatcattaacacgtaattaattaaatattaagtactataaatctaaaaagtagattttttatcaggaaatgtgctaactgaaaacgaagttgccctttataactcaccctaaatcataacctccttgtctcatatacttcccatgcgtattagatttccaagattctcgagcggtcttcaaaactaataaaattaacggacggcacaaataaaaaaaaaagttaaaatggaaaaatatactaccatgtcttacatgggcatgtaaggttccaaacgtcatcaatcaagtaagtaatgaacacctataaaaaagatatgctcccttcattctaaaatacaatcacttctaacatttagaacttattctacaaaataaacactgttaccactattcaaagtacttacttatctcatcaattatttcttatttaaattttttcctgttttaccctaacccttctcacttctaagcagactcaaccattcaccatttatgaagggacgctaaaaattttctttctcaaccttagttaagcaacctatagttcttacatattgacgtgcaattcttttacgcattcggaaataaaaaagttaagcaacctatagctagctatacttacgttttaaaatggactgtggtatacgtccatatgcatgcattatttcatgcaggttttgcacgtatatgtgcacgtatatctgctccagtcttttgtgcaatatgtgcgctggacaacattatattacaaccgaaattcagtggtcggagacagctttgggatggatgtacttgcgtatgctttccactactcatgcatgtccatctgcaaaagatttgtcggagccagctaagaagaaaatattctcacactgttgccggattgcaattggctagctagctacctatatatccgcatatgcctgcacatggattatattcagctagtttcttgtcgattgagaggtagatgcaaattacaaaatatactattataaactcaccaagcgatcgatatttatacgaggagctttgatgtagtgatgtaattatgtatagctgtaaattttatccaccagcaggattcaatttatgttttttttttaattatatggaagacgcacaggtgtacatatttatacacaagtgaatataccctataagaatatactttcaaagaaacagaagccaatggtaaatctatggccttactaaatttttattgatggcacctgagtgtgcataatgtttgtgggcattagaatttgaaatctacacccatgatgtgcgtgtgcacacatatgttaacattagaaattctgggactcgtatactattttagttgaaatctatgtatatgttaaatatgtgtagaagatatacgtatataggagtaattggtaagataactttttaccgttcctaagtaatacctataggtacaaatatttagtgtaaaatttggtaaattctatgtacctaattaattaggtattccttgtactattttttacctaaaatttagtgctcatgtttatgatataaaaacataattataagtaataaatttaaaatacaaatggaatagtatatttcataaaaaaatcatcataaagtaattggtgttcaaagttttattctaatcaaacaaaatatatcttatttttaattggagtaagtatgtatttatgtgataaaaagcataatcataagtaaactttttttcaatattaattaattataccaatctatctatctattatatactaaaagtccattaaacttcctacaaacgctctcgtactgccacatggtactcctagaaacgctcttaaaccgctatgtggcattctaatggattaagaaaatctagccctcgatttttatttaaattggcaggcccattatttcaaaccattagattggattggattagattgaatttagtgccttcttgtcctctctctctcatgtacgtacgtgtccctccccacacacgtatgtacgtaccgtcgtaccctcaccaatttttctttccgtttaccccctttatttttctcacttgagataccttataatatgtgtatattaccttcattttttatgctgttgatttttgcgtatatatttgattttaaagattaaacaaaaatatgtcattataatttattttattgtgattttacattaatgacttatgttggttatgttttagtgcaaaatacattacaactgatgacgttgacatgaaataaataattccataacaaatttttaaaaatatttcacatcagatttatagtttcaaatattgcttaacaaatataaatcgctaattggaatctacatgcaaattaacaatgtatttagtcgtgtgttttttcaagtatatatggtataaattttaactcgggtgagattaagattcacaaatagttttggaattttcctttcttccttgcactcctaccaacgcttctaggctgccacatgtcctactaataaattagaaaaaaatcatacaaatcttaagaaaaaaggaaatcatatatctatatattttcatttaaatcggtggacccattatttttaaccgttagatcaaacttaaaaaagaaccaatactttccacctccacctccctctctgtacatcacagattggatcaaacaataaaaaaaacatatgtaccatgtctcctcaggtacttatatacgtactctccatccattgcatgcgtacaattatatattctactgccataatttttaagcaatatatccgtttttttaatttattggaactattattaaatttattaatgaaccaagaatatgggatatatattgctcatattatcatatataacatttggacatactacctccgttttttaatatatggcactgttaactttttgataaatgtttgaccattcgtcttattcaaaaaattttataaatatataaaaaaattgaagctattcttaaataaattttgacgataaattaagtcataaaaaataaatgataattacataatatttctaataagataaattatcaaacgtataaaaaaacaacagcatgatatattaaaaaaaggaaggagtagaaccctatgctttgcatgccaactaaatatcaatggaacattgtaagaaattggaaataaatttatcattgtaaacatttacatgtataaattagatagatggtgtggaaggaaataaaaattataaattcaatgacagaaaattattgctacacacacaattcaaataccacaagttggtgaccatctataggactcagccaagcacaacaaaaacttgtagaaatggacgccgcgtgccgccgacttgcccaacagcagcaggtagttgccgaggtgtcataggtttgctaatgaagattgaagataataacatcattgctgtccagggagcattgagatgtaaagctcttggagcatggcttagaatcgtgattatcaaagaaaatcttaaaaattgaactcatttaaaccgattgtcctatactttctactttataaccattagattagattgatctaaacaaataaataggatcataagtgatcaagtccgacctctgctcctcctttacaaaccgactctgaatattgttcgatatggctactagcaaaagggtctattgatgtgctggttggtgggaaatgctaagctggactttggtcccatgagaatagtccagcaatggaaagatgttttttctgtgtatgtgctttgcctaaaaaaatataaatatgctttttgtcgactcgcccggggaaatatagatgactcgccctgggagaacgggagataccatgctggcgcactgtcgtcgccacgaggagaggtgagaccaagctgtggggcacgcgccttgacgtggtctgcctaagggcacacgacaccagcatggtgtcaccgacctgccaagcgtccactcactgtttaacctgtcatatctctctatacacgaataatcgtctcactctaattaaaaataaatagattgctatgtctaatacattagatgaaacacctcaaaatttattactgtcctaaaatacgtaaagacatctacagtatagaagaaaaagttttactaagtttgaaaactaaaaaaagatatactaaatattttttaaaaaataaacacatggtagaaaatagataggaatcaacttctttattgtaatatactacctccgtcccaaaatataacaacttttagctatgaatctggacacacagttgtccagattcataactaaaaatacttgtattttaggatggatggagtaatattttttagtttaaaattttatacgatgtaagggtaattagcataaaatcgtagccaatgcccaaacaaatacatattaaaaaaggaatcaaagaatgtttagaaaaaaaatattacctgcaaataaaccatcgtaataaaaatacaagcaatattaaataaggtgtccgtgtatatgcgcgggctacttttctagttttacataaaaggtgtgttcgatagtgtaggtttggagctagtaagtacttaaaaaacgattttttgtgtttgaggacccatatagattgtagccggaccgtaattaatcgcgtctacaaaaatcgaccttcatttttttatacgggtgtcccaaccgcatagaaaattaggtttcgttcgtatggaaaaatgttattcgtgagtagttggagttaataacgtgcgtcactgtaaatggggtcaatctacgataatatttgtgcgtgcatcttctctatgatcgatgataatctgaaaattgttttgtgcatgtaccgtcatcaccgaagctaatactgtgtgctactaattctcttagcttagctagggatgctgcactatcgtgcatgcaagcacacgtcgtttcatggatgcttgctgcaggcctggattaggagaaacaggatagattagtggtttgattattccgaaagctgtcaatctgcaggtgattgatcgattgaaacacggggcactgctgtctgtatgtaggctatagcttaattaagatcgagtacgtacgtagctcattaactccacgttatttcagcttattcatcataaaaaatatttacaccacatttataaaatatgttcttaaaagctttctttcgattacattactcaaattgattattttatactatttgttatatttattccttaatatatttaatttatcattataaccacgggtagataatccgctcaactatataagcctattgctgctagttattactccctccatcttatcacaaaataaaattacttctttatttactctcttatttcaactacttataacaatctctcatttaatcacaaccattttctatttagttttgaataattttacccatcgggagataccacattttctgatataaaatttgttaactctgagtactagataaattgaggaactaaaatttttatacctctgaatactttttacggatcataaaatttatctttagttttatttctctttaatcttcataaaaattctaatccttacatacattttaagacggaaaaattactactgctaggtagtggaagcctacaagtaggggtgaaaacgatacggaaacggacgaaaaccatctttatcattttcattttcatatcttttttgaatcggaatcggaaacctcggatacgaaaacggaatcgaatattatcgaaaccgaaaatggagcgaaaacgaaccagcgcgaatatagtaacgaaaatttatcggaataaaaaaaagcactcaaactgatatatccaattgaataaattatctatatttaagagagtaatttgttgataaatcccaatgcaggaaaaaaatattcttatgtaattttagatttgcataataaatatttttttaaacaataatagccaaacaccatgatattcactattcagtgcttaaaaaaagaattcagggtatttctatcacaaaatttctggtaattctgagaaaatttccggaaagtttccgaccgattccgagttccgacggaaactacccttatcatttccgattccgtttccgagaaaatatttccgaattcatttccgtttccgaaaaaatccgaaaaaaatccgaccgacagattccattttcgaaaatagatccggaatccggaaagttttcgtaccgttttcaccactacctacaaggcaagggaggagactggtctagcaggttgggcttgagcctagacctacctccaaaatcttgtttaaattgtgttgaattatcacgaaaattttgtaaaaaaaccatcactccattagttaattagccctaccgtagccttattatttaaaaatttctggctcggtcaccgccggaagatgatgcatgcgtaacactgtattagcaatatatgggtggtggggtcaggtgcctcgctatcaatcggtaattcgttatccagtggccgcccactcgtgcactccaaaagcaagctatccggtagcttagcaaaagctatatatatatatatatatatatatatatatatatatatatatatatgcgctgcacgagtatgagatcagcctgtccggacaaatgctgaaaagattaaggtactgttcactttgataccatttttaaccttatcaaattttgataaagttatcaaaaaaaaaagtggctatatttagtttgctactaaatttttgtaactatataaaaaatcctgctaaaattttaacaagttaccaaaattttgacaaatttactaaaattttgacaataccaaaatttaataaggttttttttggcatcaaagtgaacatgccttaaaggagcttaggcggagctatagttagcggcgctaacatgtttttttaattatcacatactccgtactcttctcgaagctactaattaggctaaactagcgggaggctggacccaggttttctttctttttttttttgtcccggctgtaaaattggagctttttttttattaaactcaaaacacgacagaaagaaattgtagacggcagaaaaaaatgagtacaaatcgttcatctcggatacaacactactacatggaacgctactacaaaacagcacgtaaaaactggtcttatagatgttggtttgtttgaaacgcacctataaagttttttttccaattttttcaatgtaaaattaagagtcggtatctataaccactcattgataccagtttataacaaaaatcgataccaatagtccattaatgtcatatgtcgtcgtttgatgtcacgattaaggtatttggatagtatggggatcgttggtactatgatatatgcaagtttgaggtaaaagagaagagaacggggatttttatataggttcgggccctgaattgtcaggtaataatcatactcctgttagccgaagccggtcattgctcttattcaccataatcacaccaatacaatatttggggtagcctatctaactattgtcgacttagcggactgaagtatcatcacgtagtcaacaacagggtagtcttcctcctcgaatttgtgcccggcgagatcagagacagcgctagatccctacagccggcctctataggtaccggatagggccagtccaggcatatctctgatgtcgatatccggcggcgtgtcttggcgtatattggcttgtatgttgatcttgtatcttgatctattgttccgtgccccctctcctcctagggggccttgtattctaattgtaaaccggcacatatgagctcataattgttttacagttaagaatagtcacatatgtaatgcccatatgtgctggctcatgataaaaaatggtacatatgatattatccttatgggtaccgatttattaacaactggcacttgtgatgttcatatataggtaccgatttattataagaatcaacatatatgatgtcaggttatggataccccatacctaatagaagttgactaaatctcagtaggacccaccacataccatgtcttatacggaaacaaccttcggatataggagaagttccgcataaggaaggatgaatagagttctacatggaaacgacaaagactattcggattgtatccatattgatttccctagttctatttggacaaggggacactgatgacataactcatatatgtgtgtgtgtttttatctaacttatttatataaagtcgaatgaagatacaatttatataaaatttttagagctcgacgagatcaacaaactttgtagttgatgacttttcgatttaaggctgtttggatgtccgaaaatgtgttacaagctctcatatatatttgcataagtgaatatttaaaatttaatgatatcggatggaaacaaaacctatatgaaagttgtagatctagatgtgatctacatttctgtagttgataaacttttcatttgagctcatcaatagtattaaatatggattataagtttggatgacattagtctcaaaagaatagcatttgttttcaagataactgtagttgtaggtaagatggtaaggagactttgtgtaaagagagaggttttgagttcgaatcttgcttgacctatgtcaatcaatatgggtctaaaaaatcatgttccttgtcaaaagggaagtgtgggtataggtgcttaataaaaaataccaaatattttttcggttttttcagcacctgcaaaaaaaaaagtgtgctggttctaaattagaacaaaacctatagtaccacataggtgtcggttcttgaaccgacaccaatgacttgtgttatgggtatcaataataggtgcgggtacctataagttcttaagaaccggcacctataactttttttatagtgaaaattaggagatactaagaaaaatataattgaagtatgaatgtatcgattatctttgaaaaggttggagccataccattatcaaacttgcagcgcaatctatgtactatttttttcgattacatgaaagattcacgtacatactatctatcacacacacattcgtaagtgtgcccccataacacaagctcaaaaagacggggattatagttacatccttggttttactaaattcctattgaaaacacactcacgcatgtgtagtatttgtagtcaccaaaattttaatcctaataagtagattcatacacccatgactttaccccacacaactaatactatcgcaaaaaggcaactattcaccatgtgcgtgtgtgtatatgcgcgcgcgcgcgcgcacacacacacacacacacacacacacacacatatatatatatatatatatatatatatatatatatatatatatatatatatatgctcccaaaacaatagaacgaattataataaatatttggctaacatatcggtcctttatgtcgatattaaaagtcattctattgtgataatttgatagtcccatgttacatatgtccaagactatcatatcagtcttgtgcagagtggagacaacttagttttgttattaaattttataacatgactatgtaactttagaatttcatattttgcatgattgcaaacataagaatcctagcatgcaatctgattaattatagcctagaagtctagaaaaaagttgctagattacctattcttgaaccacttgtcatttctatatccttccaggcaaaagaactttttcctttgctagtatcatgcctccttctttacatttgtgcctctattttttctgcacctttttgctaactaccttttggaattcgaagtacatgatgcaatattttcatgagacaaaagacgacaagataaccagcttagctagctatctatctctcaatctaaacaaagattcactttaatctttgcaacgcagaacacgccttatttccccccccccccccccacatccaaattaatgattgcaattgaagatccatgcgacttaatctaagagaaaaacagaaattaaggtatactcaattgtaaactgattcaaaggaaattcccaaaaattatattgcctagtacgcattatcatggaaagcatatatatgaatgttaggtactaactagaattgcagagaaacgaaaatgaacttccaggcttaattaagtgatcaacttaggctccatttggcacttagcggattgcgaagttgctatgatcttggtacaattagacattgtattgtttaggtatcaatttctctttaatttaaattacaaacaacactattatggcattcgaaaaatatgaaaaaattatgatgtacacaaacactgttggataaattatttcatctaaagataatttgattcatacggtagactaataagggtgtgttcgctattttcagttcccaactagaatagtaaacacggaaaacggagcggtccattagcgcgtgattaattaagtattagctatttttttaaaaaaaggattaatttgatttttttaaaagcaactttcatatataaactttttgcaaaaaacgcaccgtttagcagtttgaaaagcgtgcgcacgaaaaacgagggagaggggttaggaaagagggtgccaaacacaccctaatgatgtatatttgcatatgcttttagagtattgtattttaaaaataagtatagcacaaagcaacacagcaacaacaaattaagcattatatgaacccacccagtgaatcttctaatagtgaatggcagtgctctcgtttcttcccttagaaaaaaaacccaccaaaataaatatttacgcttataactcatgtgctcccttcgtaaaaaaaaatcaaattctaactatatactctttatgtactcgtaaagaaaatcgtttagtaaaatgtttaagtcaaatcttgaaaatataaattataaataattctgtttaaaaatgtaaaaattatatgaataaatttgccttagaaaaatactttcataaaagtatacatatcacttttcaataaatatttttatagaaacaagtcaaagttatattttagagactgtatcgctatctaaaacgactttctttacgagtacggataaagcatttggaaacatactgtgtacaaatatatagctataagtttttttttcggacaaaaggtgtagaagagtcctcgcttgcctgtcgaaaaccgtggtcgagacatgccctattgccgaatccgttgatggattgaacatgccacaccctcataggcacatgacaaacagtgggcttctttctttcttctcaccaaaaacagaggcttcattccgatcgatcgccaggccaaaaggtgtggtcacaacatgagtcagtaccaagtgacaaattgcaacgacctatcctaacaccctatttagatggcactaaaacttttaagtccatgtcacatcgaatgtttgaacactaattataaatattaaacgtagactattaataaaactcatccataatcttggactaattcgcgagacgaatctattgagcctaattaatctatgattagcctatgttatgctacagtaaatattctctaattatagattaattaggcttaaaatttttgtctcgcaaattagctttcatttatgtaataagttttgtaagtagtctatatttaaaattagtgtctaaatatagaaactaaagttaagtctctggatccaaataccacttaagctttaatttgttctactactaatattctactagtgcccatcactcagtcccctctgccatagctagctttatgatgcatatgcacactcgattattttaacaagaagaaacaaagctttggtcgttgatgtaaaaataaaaaaagaagtgcattattttatcacatagagattatgatattctataggttaatcatgaaaatactaaacaatttagtgtgttcatagctttaagagaccattggcatatagttggaaatagtactatggcatatagttggaaatagtactaattaaaaggagcacatagaagggtgaatcagatcaaagttgtaacaaaaccgcggctgcatcaggcaacgatcaaaaacacctacctggaggccttgggagcacatagaaattaatggttggttttgcccaaaaacaaggcacaccgttatgctgattaattatgcccactattaattaggcactaactgagagcaatgctcgttcgctatcagaccataggaatggaaattatgtttgttatttagcgttctgatgattatgtgctgtgagctcatagataagagtaaataatgtaaatcaaatatatggctatgtcatgcaatattggatttcttgcaaaatgttttcaaattttctggtatgttcctacatggtttaaattcaatgtcttgcattagaggctatgtataaaaaatatggttcatacatggttatccatggagctaaatgatctctaaacttctgcatatccctgtaaaacacaaatatacaatattccgtttatattcgtataataaccaattggaccaccctggttccgttgttttcattgataaacaataaggtaatatggtcatctgtacttgatatgatttttttagtgagctaagatcagatcccagcaggtgcatggcagcaaacagacaaagagcactagagggctttttaaaacaatgagttaggtttcgggtgcggtttttcttttatagtgattgctagtagtacttatatttgtaggtcatatagggttttaagccgctaataacggtgttggatgtagaggtaaaatgccatattggaagaaaagaagcagccatagaggtctatactaaatatgctattatgtgcggcattatcggactgctagtatagtatatcacaccagaagaattaaaatatgtgcaagatgggagtcgtgtatgatttcaagccactaacaatggtgttatctatgacagcaacaatcaagtgccatattggaagtaaagaaagagccacaaaggtctaaaatatatatatttattgtgggaaaagtctatacgtactaactttttcttactaaatttttactaacactgacatgtcatgctatgagtctatctagattttttataactttcatctgcttaaattaaacggttgagatgattgttagtacaaatttagtaagaaaaaattagtacgtgtagcagtgctctttattgtgcgtgttactattagtcagttgtatcttggttgactatgggtcctttatcttaatcctagatagttaaatccgcttttattcaatagaaataacaggagaaacaatcaagatcatgaaccatctactcgtaaaaaggaactcattgagatggttacatgcatactccctcaacttctttttaaaagtgtcaaaggggttcaaagaatcggtggtaaccggttagtgagtttgtatcaggattaaaatttatgtttttgcatgtatttgttattatagcctcatttattgttgataccaataattttaattagattattattttcaaaaaactttatctagtaaattccgataatcattttgacccaaaagacatatttttatggatactaatttgaaaccttggtttcccaaaagactttaacctaagaatgaaagagtgaaaacatatagtttcctatatagcattcggggatagttctgttcacccatttcggaaggaggccggaattttattttattccattttctaaaatataaataggactcgagccaagtggttggatacatctcgaataaatttcattatcgaaaaaacaaatactccaatatcctccgtttccatgctcaacattttacatatatgtccatttgaggacactaagattatttactcgttacaaaaacattaattgccgataaaatttacgtactcttccaaagcattgggtaacccgaattaatagaactacaaaattttctctcaactcaaaaaaatgaaaaaaaaagtttccaaaattgtagtccaagaagaacacgccatgcccgcctatgggcgcggcggcggcagcggcaggaggcggacgggcacgccgtggcgtggccggagcgtgagcacgttcaccggcgcgtgccggtactcgtcggagatggcgaagcggaagctggagaggagcatggcgagcgcgaccttggcctccaccatggcgtacgcctgcccgacgcagttgcgcggcccggcggcgaacggcaggaacgcccccgccggcggccgcggccgtcccggcgcgaacctgtccggcctgaactcgtgcgcgtcgcggccccacgcgccctcgtcgtggtggatggcgagcaccgggatccacaccgacgcgccactcggcacccggagcgcgcccccgccgagctcgatgtcctcgaacgccatccgcggcagcagcgtcgccggcgggtacagccgcagcgtctcgttgatcaccatctggagcacggcgagcttcgggaggctgtccggcgacggcgcgccgccgccgcagacggcggcgacctcggcgcgcgccttgtcctgccacgccgggtgcgtggcgagcagcatgatggcccaggtgaggagcagcgccgacgtctcgtggccggcgaagaagaaggtcttgcactcgtcgatcatcatctgggcgtcgtacccgacctcgccgccgccattgccgccggcctccttcttctccatctcggccagcagcatgccgaggaggccacggccgcacggcgacgccgacggcgtccggccctcgtcggcgatctcccggctccggtcgatggactccttgagcagccgctccagctcgccgttcagccgctttatctctctcctgtacttgctcggaaaatacctggagaaaaaaaaaaccatggtattagaactattaaccacgtaaataaaataaaaatgtataccgtagtaaattatttttcacatttctctcgtgaaatacgtcgtcgatcgttgtgcaaaagtttactcctatatatacggacattcaattaaaaaatatatatgtatatgtgcaaagcgtccgcttttaaatagagctggtgacaaaaaagtgtaaccgtcagctctgcttaacgacgaacattctaagaattaaaaaaatattgggttgctactgctccggttttttttttttacttgttggtaaggatatgggttcagtctttttatcattattttataaaattattaaatatatttaatatgaaagttttttatatcaaatttcactgtttttccatgtactcgtgtttttaagatgctgaggctttttgtccagtgcctcctagcttttgctcgtgaatgggaggagcatttcgtcgaatggttgcggtgcagcctccactccaaggaggagcagaggagagcatcaatggcggtgactcactggctgccggggacccaaaggtagcggctggagcgggcggtgaggcgctggagctcctcgatgaggaggaagatcctcttgccggtctcgtagctcgtgtcgaactcggtgcgcgcgatcacgtcgccggcgagcctcgccatgtgcgcgccgatctccacctcgttcccggacctcgccaccgcatccctcagcgcccgcaccgtctgcctcgtgcactccaccatgtgccccaccctcccctgtgccaagaaacggcggtggggttagctctgctctgccgccgccgccggcaatggcaccgccgtggcgagacggtgcgttaccttgagccggtcggccatgaacgccggcgcgacgacgtggcgctggtgcgaccaggtggcgccgttggccatgaggaggccacggccgatgaagtgcttggcgccctgccgctgcagccacgacttgccggtgacgtgcgcgtgccgcgacgacaggagctcccgcaccatgccggcctccgtcacgcacacccgcggctcgctcccgtaccagtacacgaaccgcctccctgcaagcgcgcacccatgtcgccggtgtcagtgtcgatccgatcgtcgatcgccggcggcgaaccgcggacgaacactcaccgtacgtgttggaccagaggacgtagtgggggaggaggcgggcgacgatgtcgtggctgagggaggccatgtcggcggcggtggactcggcgacgagcgccgacacgtcgcggaggttgccgacgagcggccgcggcggcgggccgcgcacgccctggctcgccaggacccgccggatcctcgccggcgtgaggtagtagcatgagacggtgacccagacggccttggccaccagcagcagcgccagcgagaccggcaatgcgatggcgacgaggacggcggcggccattgccatcgacctcggacgaacaggaggaggacagagtagaggagaggtgttcttggccttgttccttgcttgcagctgcaatggcggcttgtgtgcactaggcactgccatacatgtgtgtatatatatagggcttgggagtctttgacattgcccagtgaccatgcaactaacacaatggcgcctaccttgttcagccttttcttatttagctttttcttccttcccctggcataagccggtctggctaattgcgtcgtatcactataactcttttcttttaatatattgacgtgcaattcttttgcgtgttcggaaaaaaccttatccagacttttttttaaaaaaaatttctagtattatttttttactttgattggttgtttggttgtgttggcggcaatgccagagccaaaaaaaaaagtttagaggctagctaaatcaaactacgtttgtacttcctccattcagtaataaattcatttttagctcatcctatttacccaaaataagttcacttttagaataatcgtcacatcggagtttgtaaaagcaagaataattatatttaaagtagataaagtgagaaataattgtattgcgatgtgataaagcagagatattctaatctttttttgtttttatatatcagtatgagatggatgaaaaataaacttattttgagacaaatatagtatttgctaaagaaatatatttttaatccttgcaaaagtattaagattctattgagtgatcgatgacgagcctgggcagctgcctagggtcgccgggcaatgactccgccactagttggcgggctagatagtattgaaacttgtctctattgtctattggcaatactgttatcaaacgtaattgaggagcaagaaattaaactcaaaacctatttctgtatcagcgtacatgctctaattaacaattttcggagtatatgccagtgctctctctctctctctctctctctctaccctcgttgtggttatctctacaaaatgtgaggataaacaaggctggagaaaggtgtttgacttgattttgacctaaaggtgaggccatgttggtgaaaacaagattagtttttggggtgttagtgggggagagagagtgaatgatgtggctttggcataaagttgcaaaaccggtacggttgagaattgagataattaactgcaatagttaagtacaattgtgtggcaatcagtatttccactaagtgaaaaggaggtagcatatcttcatacctgacgagattgtttaaggcaaaggtattttagttgggcttatggtttcattgcatttgcaaagtaaggataggcagagagtaagtggagatcatagctcttggatgcaagagaaggtcagaaatattgccatgaagtagcagcggagccagctcccaggcttgtcgggcaatcttctaggcttcgccgttgatatctccactgctaaatgtcattgacgtccttaaaagatggtaagatggttgatcgtcataaaacactattagttggcttggtactatatacccaaccggaccactttgatctagttgtttttctaaaaaaaaaaagaaaaagggaagtattgtgcaaaaatatgatatacgaattctgtgcctggccctactttcgattggaactgtaagctattttgaattttagtgtttaggctttaagaataatattaggtagattttgtaattgccttcttagaaatcataaaagaatatattcgtgcaacggcaatgatgaagagaatcctaaaattaaattcaaaaaattaaaatcagcttcgaattaaatccgaaactcacccaagcatggtctaaatcttaaggtctttttaagggaatagtgggaccaagatggtccaactatttattacattacattatacataaaaatgaattgtgaggttatatgttcaatcctggaaacatgtaaagattattctcagtgtatgtgctagtcaatcccataaagaaaaccttctttctaagtgtctttattctattctcttcactttcagtctttcacaactgatggttaccagaaccagagccttttctgaggaacattactgcaaggagcatgttatttcacaaggtacttgtcttcacttactcaacttgcagaaaaaatgtattggctcattccttcaaaagatagataggctgaatagcatgcatcacagtgctccatataggtcaaaagctaaaagtgtttgtttagtttgctgaatggcatgttgcaaacttgcaatgcacctgaaactaactgtatatggctcggatttcaaggtccattggaccatgaacacatctttggtttcagctggactttaatcttaagctaaacagatgaatttgcatcctcatttagtcatcattctcatttctgtggaatgttcagtgaaccttgtcacctcccattggcattcagtgcctcgtttgccaggcttactaatttcttgtggtttcttgagtttgttcgtctcgtagacaggaaattcaggataccatagtttatacttccatgatgagaacatttataacatgtcaggcgtctcagggctcctttcgaaccaaaaaaaatatgggttaattagattaggtccagttggtgatgacgatgacatcgttgggaggctatggcgaagatattggatggtatgtgtgttgagagtttgtgtaacatcctgaaaattcaagacaaaaatcacaaaaatttcgaactttttaaaacttttgcatcatgctggttgttatgattgctattgcttgccaaaccgtaaatgatcaccaagaaagtaaagaaaagaactacatttaagcaatagatatgatttacgggaatatatttaatcctacaaataattatgcacaagatattaaaatcaaataaaagaaaagttattattaacctattttatcaaatattaaaatatttgaataatgtaggtgggtgccataatatgtgtacacatgaaatgatgatcattcaaataaactgagctctctatatatataatagaattatgggagtatttaattcgatatgtagatcgattttgcaccaagttcctaattgcattcagggattgaaatttgatatattaaacccctccatataaaataaactaacatatagataaattgagctaatgtgctattgtgttaataacggtctcattagaaaattatagaatctttaataaaccttaaatattggacaatattaaattttgggcaaattcacatttgaacacttaatacggtcacctaaatgcttgggagtaaatacaaatttaatttgcaacttttctcaatttataaatctaccaaaaccctaaaagaagaaaaataggaaaactttgaaaaatatataataataataagaattaaccctgattaaaaattcaaataaattatataaataaaatatgagtaatattaatctagaataaatccattggttggaatgacacaaatattgggtaacttcatttatacaaaatctaggatttatagaatcaaatttacacaaaaaataggctaaaatagggattaaataggaaaagaca

SEQ ID NO: 6901 - DNA, 682 bp, Oryza sativa
gttctatcgtgccgccgcattcgtgaccgccgcgccgccgcctcagtgtgccgcgccgtgcgccgtcgtcgccgccgccgtcgtcgccaccgccgccgtcggtgagccgctgccccccccccccccttgtttgtcgccgtgccgccgggtagagagggagccaagaaagagagaggaagggagaagccgagggagagaaagaagagggaaggaggagagaaaccggaaagaagagagagagaaaggaaaagaaaagagagagggagaaaggagaagaaaagaaaagagagagaaaggaaaagaaaagaaaagagagagagagaaaggagaggagagattagagtgggccccacgtgtttagtgaatagtaatccccttcttaatctttattagttgagtctattacatgtgggtccgggtggttaaaaatctaattatagaagttttatggtctcgagtttatgacatgtgggccccacttgtcattagctcttcctatttccctttagaaaataattcggtaggaaaaaggaataaacccggggtcctacttgtcaatggatatgtcttggattaaaaataaatcgtttatgaacagtagcttttcgcaatttctcggattaattcgaatttgaatctttacactagcataacttattcattttaactcggatttgagtga

SEQ ID NO: 6902 - DNA, 1395 bp, Oryza sativa
aattcactgttctggataagggaggagataaggaggccggcagccgaaattggggaggttgggcccagcccatggttcagccaaaccatgggtttggccgaacccccacctgcaccattggatgcagggtttggcgtggacgttcaggattgcatcccaatgacagttggagggcatttctgaccattccaaccatcacaaccgtcattgggaggctataaagggagctctcatcctccactccatcacacactcaagcaagagcttctcatattctctcaagtttagtttagtgctctagagctagtggagtaggaatagaatagtttcttcaatcctcggagtcttcagaagagttcattcttttgtaagacttgtactatttatagaatattactttacttcattctgatcccttgagtaccgacttttcgatatattatttgagatataattgtctagctagcttacctgggggatgcattggtgtgggcataatgttcatttatatgattgctctaagtcatgatgatgattgtagagtagtatttagtagcataagcgaggtgcttaggctattgaatattattatttggggttatatgctacaggacagtagaggtgggccattgatggtgacagctcagtacgggtattcctctacgttagtatataatcctaagttactttcctggagagggtatttgtcacactctgaagttcttcccaagcctaaattcaatttggaatttgtctcaagaaattagttgtttaaagtcaagagagaaaccctaaagtagtgaatgcaaataataattggaaatagcatgtggaatttttcttgggttattcatgtcaaaatatgctaacaggatttttagtggaattttcagagctctagaaataattttaatcaattaaaaatgagcacaagcaattatttcatccctggaaattgttttcttttcttttttccctttttccttcctttttcctttgattgggccatcagcccgttctcttctcctccccgcgcgctagctgggccggctcgaggccgaggcccagtaggccggccgtgcgcccctcctccctcccgagtcaccgacaggtggggcccacctatcgggcccgtccccaacctccggccgccgccgccgcccacgctgcaaccgccgcctccccgcctctcccgcgcctcccgtgcacgtcgcccgcctttcgtgccctctcccgcatgtccgcgaccgccgccccactttccccgcacgcccgtaccgagaaacggccgggattcgaatttcgaatcccaccggcctctctctctccacctcccccacttcgccagccacttcccacctctcggccatgtccgacctccccggccctatataa

SEQ ID NO: 6903 - DNA, 69461 bp, Oryza sativa
  unsure (1)..(69461): unsure at all n locations
ggccctatataaactacccctgcatcctcctccacctttttcccgttctcgtcgagccctcccgtgcactccactgccctagcgccgtcaccctcctctccgccgtcgccgccaccgctccagccgccgctagccgccgtgccgatccgcgccgtcgacgcccgtcgcgttcgccgtcccaagcgccatcccgtccgccgtccgcccggccgattccgccgccggagcacgccttcctcctcgcgctggtgagcaccaccatggccaccgccttcggccggcgcctccaccctctctgctctccctctccctctctaatttcccccattgcattccctaggtttccccgaagctcggctgctcgtcgccatcgtcattccatcgcccgtcgtcgtcgttcgccgtcgccttcctccgtgccggctgaacccttcgatgacgaccgacatcccctatccctctccctctccctctagtagcgccgccgctctccgctgctggccgctcgccgccgatcgccgccttgcgccgctgccgcgccgcaccgcgccgccgagcgccatggccgctgggccggcttaagccgcccatgcgtgccaggccgcgagccgccctcgccatccgatctaccctcgagtagatcggggccgttcgctgctgcccgcgtggcagcccacgtcgccgccacgtggtgcacccctcaccgatcccgtggaccggcgcaccccgagcctatgacatgtggggcccacatgtcggcgctgccactctctctgatgatgtcgccaggggtattatttacgcaataaatcaattaaggattttctgttatagtaataaacacatataatcttctaaaaatcataactaattcgtccatgctccgtttaagcccattcaagtctcagtaaatcaagaaaaatgcaaacaatccattacaaaaggttttgttctctgttcagtagtcttatagcttgtttgcattgtttgccttgtatgtcgcatagattccggctctcccgacgctccggtgtactttgagatagttgccgaggtccctccagccacagagcaaggcaagtcatgcttgtcacttgaacatattgatcccatattgcaaatgctctattgtttcctttaaattatgcatngnttttataatgttattatgggatgtttacctactgcctcagatatactatttgttcatcttaatccattgttagcttgggttgtaacataactagatgtcggattaggaattgcttagccatgcttagttcaactagtacacgaaggggaaatcacattaacgcataaactttggattatagtataactttggattagtgccaccgcaatagtgttagttaattagaacacattaattggtgggctgtgggtgtatggttttgatggtcgtgcccatggcaattaaggaccggttcgtgggatgccctggaagaacttatcgtacttaccataagccagcgtgggcaatagctgggcttgtaatgtagcttttctctagccgacgcatctaggcaagggtgggtgtgatggagcaggatgggccctgcaacggcctttgtcgcttccggattcacctaggcacgagaggggactgcccgctaccttttgaggagtgggggtgaaacctgaggtgtggtgtgcttggttagagggggctatgcgaagggtcctatcacggtctctttccagtatattgtagtggcatgccggcgcacgggaacgtgtcgtggggctgtgtcttgtgggtacagttgtacacctctgatcaaagtaaaactattcgaatagccgtgcccgcggttatgggcggtcaaccagattcactgtgattagtctcacccctagcttagcttaatggaactgattagttcaggtggtggttttgggcctgtcttaacatggtgtagcgttaagcagtgattgggttaaatgatggataattatttaactattttaccgctttcaactactgttcataaatgctagctttatgcaaataaactcctttagctctctttggttgtatcctgcatcatacccttcgttccggtatgacttgcttagtacagtgggtagtacttagtcttgctctatctcccaacccaagagttcgagtatgcgtccgatggtggcttctcagaggagtaggcttcgtccatgccgtcaaggatgccagtggaatggtgtctcccgctgctatccaagtcaaggcttagctactgttatccttttaatttccgctgcatttgtgtaagacttttataatatttgtaagacgtggatctgtatgtcaacattgtcgtttagagttataatgtttcaatccgctcattttagagttattttttagaaaagttgagcagaatggattaatcctatcaaagaaaaaaatggaaatatgcaaagaaaaaaaattaactttcttggtcatgaaataggagaaggcaaaattcatttgcaggaacatattgctaagaaaattttacaatttcctgatgttatgaatgataaaaataaattacaacaattcttaggaattgtaaattatgctagaaatcacattgataatttggcaacgctagcaggacccttgtatgctaaattaaggaaaaatggtcagaaatactttaactctaaagacattaaattagtacatataataaaagaaagggtaaaagagctaaaacctctagaactaccattagaagagaattactttattattgaaacagatgcatcacaataaggttggggtgcaatactaaagcaaagacctactaaatactctaccaaatgagaagaaaatatatgtaggtatgcttctggaagttataaagtaaaaattgtaaacaatacagatcgagaaatcttagcaataatcaatgcgataaatgcttttaggttatatctgggattcaaagaatttacggtcaggacagattgtgaatgtaacatcctgatttttcgtttcttttaaaaacctattttaaatacaaaactattttcaaaatttggttctcatttgaatttttacctatgccattaaaaatctcaaatctctcattccatgtccacaaataaactcctagaattatcaaagtccacggtcccttttacagtccatttacaacctttgcatcaaattccaaatttccaattaccagaaaaaggaaagaagttcctattcctttgggtttcccttgttactgtctccctccctcactttcggctggcccaaggtggcccagcttggcccatctatctcccctcttcttcctccctacccagcagccacaccgcgcaccacctgctcgacaaaatgctgagctaggcaagtgatgcaccgagccattccgcaccgcttgcacagcgccgtgcgccaccccgcgtcgagccgctcgcacagcgccgtgtgtgccgcgccgcgtgtgccgcttcccggacgcgccttccttgccctggaagccccagccacagtgccgatgtcgacattgtgcatgaatttttcactgttgtgcaagtagtagccttagttgtatgaatttttcactgttgtgcaagtagtagccttagttgtatgttggtttatgtcaaatatacattgtaaaatgtttgatgttatttgagatatgaagatttctgaattatggtagggatgtggacagtggttatgtacagtacgttatttgttgggtgagtagacattttcatgtttattgatgtaaatgtacttttaacgataatgggtcatttgttgttaatgtgtaatttggttaattcttttagtgatataatttttccatatgattcagggtggagatggctgataatagggaccctgtgtgggagcacggggagagcataggaaatggatttcattgtaaatattgccatcagcaaaagagcggtggtagggcaactagacttaaaattcatttggctggaaagggaaaggggacaacatattgcaattcagtgcctccagatgtccgtgacttgttcaagcgcgagttggacaggataaaagctgccggtgctaggcgtaagagtgaaaagtcaaccagggttgaagcggcaagggtcatctatcatgacctcacaggtgatgccgacgaggaggaacaaatggaacaggccatggaagcatcacggcgagagcaagactttagaagggatgtggaggagcgaggtggcacatatgagcatggcgatggaagtggatccgctcagcctgaggcaaggagaggtaaaagtaacccaattgccaatttgctacgaagggctacatctcagagggagtcaccttttttgagagattacaatctagcagttgccaaggcccctgtgcagacacgcattgagacagggttcttcacaaagaagggaaagcaggctagggaggccattggtgagtcacgggcaaggtttttcttcacctccggaattgctgcaagaaatgccgataatccttactttgtcagcgtcgtgagagagacacagaagtggggtacgtatgcaactaatatcaacttatattttcataaacattttagacactaatatttcttatgtgaattgtaggtgaaaacatacctccggaattgctgcaagaaatgtcgataatccttactttgtcagcgtcgtgagagagacacagaagtggggtacgtatgcaactaatatcaacttatattttcataaacattttagacactaatatttcttatgtgaattgtaggtgaaaacataccttctccatcaagtagggagatagatggtaaataccttgattctacggagaaggacgtgaagaaacaatttgagaggttcaagcacgactgggatgattatggtgttactttgatgtgtgattcgtggactagaccgaccggtatggccatcatcaactttttgatatactgtaatggaataatgttctttcataagtccattgatgcgacaggccaaagccaggatgctcaatttgtacttaaggtaacacactggatccaacaaattagcctcacatgttatcatgaagtataggtgatggacttacgtgtattctgtgatttattaatgcaggagatcaggaaggtggtatgcaaagtaggccatcaacatgtcatgcaaattatcactaataatgggtccaactataagaaggcctgcaaactgcttatgcaagagtaccgagctattatgtggcaaccttgcgtagctcacacaattaacttgatgcttaaggaggttggaaagatggcagaccatgatatggtgattgctagtggtagaaaaatttgcagatggctatacaatcattcgaagctgcattctatgatggtctcagcgataggtggtgaattggttaagtggaatgctacgcggtttggcaccaattgcatgttccttcagagtttcctaaaggaagcgatatcagttcatgcagtggatggcttcctctacattcatgcaaagtaagttcaatggcacaacagagggtagatatgcacatgcctgcctatctagcatgagttggtgggaaaacttgaaggcggtagtgaattcagtgcaaccgatgtactcctttctttggtttgccgacgaggacaagaaccccaatttgagtgaggttcttttgagatatcaactgttgagaatggagtatgatagtctgttcgcttgtgaaagggataagtacaacgcttatatggatattgtggacagaaggatgcacgacctcaccactaaaacactcatcaatgcaagtaaagttgcggctttacataatgttcaattcctaaacccataactcttgaactaatttaggctatgttttgtagctgcggtattgaacccgaggacgcactacgcttacacttgtagttccaccgtcttccaagaccttcgttaagctttcgagtggatgacggacattgacacggcagctgccgctttgctggaggttgagatgtatcagtgtaagagtggcgaatttgggaagccactagcaagaaagatggccatggatgggaaaacttcccttggtattttttttgctaatgtagcaaaaaaatttcataatgcaatgctctatgtgttcataatagtgaaatgacatattgtttggcatttgcagcacaatggtggtctatgttcgcctcagacacaccgaacttgaagaagcttgcgttacatttggttggacaatgttgctcctcaaatggatgtgaacgtaattggagcacgtttgcattcatacatacaaagctccgtaataaacttacacacaagaaactcaacaagcttgtgtatgtcaactacaaccttcagcttcgcatacaacaagcaaatgcacaaattaggaaggaagatgacgatccccttcagaggctagcggatctttcattttatgacatgaacaatcaaattaaagactggatggacaatgcttggtctaatgcttgccctgaacttgatgaagactcgaccgagagtgacgcccctgtgcctagtccactagtagccgacctagtggacttgacagacatctgcagggccactggggcttctagtgttgctgagtgggctgaaaagaacgtaggcgacaatcatattgggaagaggaagactcgacagcggccaaaagcacctgcagccaaaaaaacaaagggcaaagctacaactacacggttgaggagtgtcgatagtgatgccgacgctgaaggaagcccggaataccaagagtccgatgacagtagctccagatggatacagatgatggagatgacggtggtcaaggaggccaaggaggccaaggcaccactgatgtgccttctaggggtcacacacctcagtcagaacaccacagccttattcaattcactggtacgatatactttacttgctactacaactatcaccttgcaattcatgactcattaatgttcttgctaatatttcacttgcaggtgaggccgactttactcacgctactcaagaccaggatgatggtgctccaacctcacaaagaactactattaatccgataggccgccaacaacaacaacagtttgacacgccccaggatagctacagctctttcagtgcctctagcattgaaagtggctatcaaacctatgtgtaaaaccgtccccaagcatctgattatcctgctcagacatgggtgtatgaatgacaagagccccagtggtatgctcaattgtacgctcaatggcaatcaacagcatcatggacagaacaaacttggcaggaatacaaggtgggattgctacactctcatggcttgatgctcatgtcaacagaagagtacaacatggcttacaatcagtggaacacctagctatgtccttctttatatccttcgttccaaactacaactttctatgtttgtgttgcttgtcatatgaactaccatatttgtaatcgtggactctattgtttctactttgtgtggacttcattaggctttgaaatgtgaggttgttcaattgttgttgttgatttattatgctattaaatgttgaattgcttcgatgtccataatatagaataggtcatgccgaattttcgaattttacactcaaatgttagattttctatgtatcctacatattcttataattatatccaagatagacatacatttaactgtattttctatgtttttttcaatttgaatttcatttccaactttccctcttcactgtccgcgataatcagacaaatatcgcgattatcgccataaaccacgagataatcacgtcaaagctgcgaaaccgccgaggatttgaattcaaatgtttggatatgatttttgttcgatttttcacgattatcgcacgattatcgcggtaatcgtcctaccgtgggggtgcggtaacctctgtcaaaacgatatggggaaccctgagcagtagaggggaacgagaggagataacgagaagaggagaagagagaagaaaagggaaggatgtgagacactgtcatgtgggacccgtgtaccccactattcctaattaatccttgcaccgtaattacctccttaatcctcctcttttgtctcaatgacatgtgggcccactgtgcttaatctttgttttaatcccttcttaatccttgtgctaatgacatgcgggtcccaccctatccattcccttgcggtgtgcccgtgtgtacaccaggtccatgtgcgccgagcctatgatggctgggccccacacgcaccgaccggtggaccacgagcccggtccaccacctctctgtgtggcgccctccgtggacgtggtctaccttgcgccggctcctcccgtgccactaacagcgggccccgcaaggggtttatcccgaaatattcctttttcccataaagaaactctttctcctttgaatagaaattccttcaatcttcgaaaattcatatctcctaaaccgtgactccaattgacttcgttccacttccataatttttctaaaaatgagatctatctaatggcagtataatatcttactgtttgagctactttattagctcttgtgttgattttgctctttttgtgtatagttgccgatcccgcggatgaaccggaagctgttctcgtcaaggaagaacctccgcaggaccaaggaaagccacctttgaccatattgcttcctatatgtgcaaaattatgttgtttgcaaatgtgcatgcttaggttacacgttaaactgttttgcctcgtgttgcgaacgcatccgatggatctacctattagtcgcacttatattctgtaggatattggacgacctgtcctttatagctccacatattatgcaccgacatctttccctacgggtatgaacatcgaggtagttttgcttggacctgccacgattgtattgtcgtgtgggaaacctggatttccaatcaactattcaaaacccgatgctccctatcggtgtgtttgcgaagtaaaactagtttgcgaaccctgatggtatgtaggctgagcctgtgtagctagctatgtattgtcgttaaggaccgattcctttgggaattccatccaagcatcttatagtgcgaccacacgggtattatggcataccccttgaaaagtactttgttagtccatgactatcttgtatgccagtagtagtgggacactggggatgaggagacgaagttgcgtgtatttgatgagatctttggccaagagtggccccgcctctattgtggcgatacggtaccgataaggtggaggagcatccctagtgtaccctgagtagacgagggctgagactgcctgatgcttgtcgtgagactcggcctactacgtggtatgggatttttatggactagctttggaaaggccttgcaacaaacttctggtgccgacgggcaaccggtgtcagttttgtgtcatgtgggtaaagcgtatgacctctgcagagtttaattaaactgtttgaacagtcgtgcccacggttaagggcgaatgtgaggtgattctcttagcgtagtgttgtttgtatatgtttgtgaaattggtttgtgggatgggaatcatttccagagttagcctgtgtggcagacgacaaacctgagtggtttggaacaggtctgtgtgatctgggatgtcgattggcatcatagtgtgactaggagttggattgtttggtcgagaggtgttctgagctgagatggttcgtggtgttctgagctgagatggctcgttgtgctctgagatgagacagctcgtggagaagtgaagtggaaacaagtgcaagagttggagaagcaagagaagatctaaggtgttggtagaagaacatatattcactaattacttgtgacaagttgttgcaaagcaacttgtggaatggattgaggtgtgagcctctttccaataactaaaacttgacacactagagctttgcaaaaagacaccttttgagcaacagctagttttcacaaataaaaccctttgcctcatttggtagccgcacatgtcatctttcctatggcttgctaagtacaaaagtactcacccttgctctacatataattatattaggctttgaagataaagaaggaggatataatccaaccgccgaagagtatcttcaggagcacgccaactatgaagacttttagagtttcgggcctagttcccaaaccatgcctgtggaataagttagtcccttaggtgcctagcctagaacttagtcgttaagtcgtcttccgctgttcgcttccgctctgttgttgtcattgttgttattgtttgttgtgtcgtatcgttgtccatctggggtctgtccacgatggcaacttatgtaaggactatccgactaatgtaatattattagactgctttggatcaccgatgttctttgtgtactagcttgtgtatcctgggactggtacatgttacacaggtattgtactgtggcctccggaccagcgaggatttcggggtcaccacagtgaagcaatatgtggatattataatcaacttaataggaaaaagagttctactaggaaatggattttatttgaagatatcattactggaaatggatacaaagatatattcgaacatattaagggaaaagacaatcatttacctgacctgctctcttgtttaccctgttgcaggcatgaagaaatccatgaattacaatggagttgaattcttcacttttggagaagataacaagctcaaagtatttccaccaaatacctataaattcaagccaaaatcccacataatattagacgaagtccaggaatgcatattaggcaatttttggtaccaatataataataagagggaagaaaagggtacatgctgtctatacaaaacagtcttgctgaatatttccatttactaaattacctaatgccagcctcaaaaaataatgaaataatacaacaaaagcctatatatgtagtctttgatggaaagctcctcggagtttatatatcctttgaagaaataatagcccaaaaaatatatgcaaaaataatgggcggcctattgtggaaaaaaaaatatagatgttgatgaagctttaagtcaagccaggaaaattttgggaataaactattatatggagccagctgcaaaggaatatatacaaaaatgcaaaagagccaaaaataagaaagctctagaaaccccatattatatgaatacaaaagttgaaggatcttctaaaaaacctacatataaagaatgcttaactaaagggatggatcccttagatggtgaatacattgactggaaaataattgaaaattttgaagatgcctcccctcaattgaaaaaagagttaaaagaagaaatacttaaagaattaaagaaagaaatgaatgacaaatttgaagaaataaaaaaggcttatgatgaggaatttgatgtattttttctgatgttgataccgtggatatgggcagccagaccaataagcaatatagccaaatataagaaattgataataaattatcaaatttttgggcatggtaagcctaataataatatataattttaaatcaatataattttgaatcaatccaaaaatgcttttcggtgaatgacagtgaatgacgtttcactgctaaaaatactgtggagaatataacttttgaaaaaggaagagacacaggtgcaaggtatctccactccagccaaacaaaggacgaactgaagcaaaaggaagtgccactacatggtgcgagccatcccgtgaaaccacagtgataaacatagagcactgacgagcttccttctccagcccctataaaaggaggagcctggcagctgaagagaaacaacaaagacaccactccagagcaaagctaccagctattaacgaccaaatttggtaatccaaggatcggatgtgaaggaagaatcgagacggtatcttagagtttgttagagataagagtcgtgtccgatatggacatattttgtaattctcgggtataaataggccccgagccccatgtaataaaactaacacacgttcaatacaatctcggtgcatcggcaccctttttactttcgttttgtttcgacaagttcttgctttcgagttgactgcatcgatttcaatcttcaacaagaggtaaaacttgttatggcggcttgcgttctcgggattagtgcttccatcttcatgacactctaatcttgtttatgtaattcgtcgagttatcatatatcttgcatgatctccggcaatatcgttatctaacctacaattcgctaacatctgtcagtagaaggcagccgattaggttaaataccgatgttgatttagattatataggatatccaccactctatgacacatccaacgacttgattatctagatattgttcttcttttcatacttatagctgcattagttgagtttgatcttatgagtcatgattagaatctcaatctctagcctgcctttggttgccgattagggtagcatcggggtttcagccgatctttcctgatttagcttttatcttatatgctttattgacatgctaaatctgtcatttatattaagatcttgttgcatttaagtatattaggctttctgtttggtatattctatttgctttaatatcttaatatagagtggtatcggagtattagccgatacatgctagatctatctgatcggctatgctatcaacatatatagtcttattattagtatatatttcgatctaagtgatttatactgtctcggcatggcgaccgatctatcccaatcacttgattttagtatatatcgatataaggattatatattgttaatatctacagccgatcaagtagatttagttctttcttacttattaatgactgccgattgatgcatatataacatcggctcgaagataaatgatatgtcatcagcaattagccgatcggctatcgtttatggatttaaccgcggtttctttgtatttgtttcttgttgattgcaggatcaaatcaactggcacgcacacacacccaaaggtaagttttggacctgcactagagttaagcagatctctcaagcctcgtgttttcacgtcaacaccagcgcactctcatcctccactatacccctccttgtagtaatctctctagtcttccttgcaaagtatattgaagcaaggtgtgtaatataagtgtaaggtaagaagaaagcttgtatgtaagtttatctgttcagtatgaagtaacttttcttaagtaaccatgtctgtccgttctagtcaagtgtttatgctagggaccctataggagaaacctcttcgcttgttctcatttctagcctgcatcttgcataggcgtctggagaatctgtatccatagagaagtgttcccttcgggtggaagggcctggggagatgataaactcttacctagatcgttcatgactagggttatctaatttaagttgcttctaaaaagacagataggtgaggcgtatggtgagtaccgagtaggattttaaaacttctgtttgaaagcgccggctgtgttggattcgccaacctgcaaagatcatattagacttacctcgataatcttgaaacacccaatttggagtctgaagaaagaattaatgaatatgagctcagtgaaaatatagacaactattatatatcaaattccaatatagaatgcataggactacaagcattcgcgccagaagtgaaaatatcaacgggatactttgagggcaataagacctcaacaagtttataacatgggattcttcgagaataagaatgggttatatagaatatctagagaaatagaattaagtgtattaaccaaaccagtagaattaaaaatagtagctaaagtgtttgaaaatgggttaaaatattcaggctataagtatattcaccaaggaatgtatataataggaatcaaaggaatgacaagtaagaaattaggagctaaagttttaataaccttattagataaaagaatattacaaattccaatatagaatgagagcgcgcgctggtatgtttgctctggagtgcaatatagttcctttgttgtaatatagttccacagtgtaaagagtctgaagaaagaattaatgaatatgagctcagtgaaaatatagacaactattatacatcaaattgcaatatagaatgcataggactacaagcattcacgccaaattggtatagggatattaaatctaaaaaggatatagaaaagatcgtccaaagattagaggatatccaaattataggagaaattcctatgaaatattgggagaaaaatgcaatcgagtgtaaaattaatataataaatacagagtatattattaagactagcccaattgaagcaaatccaaagcatatagaagaatttaagatgcatatagaagaactattgccacttgaactaaaaggcaaatttagtacacttatagaattaaaatttactggcttaaataaaaaaggtaaatttgcttacacaattcaactggtaacactattcctagtgctttaattactatttaccactatattcctagtgctggaaacactgttcacaggggtgaaaacactgttcactcgaaaaattcaacctaaatattcaggatctttgcatggtagcgaatccaacacagctagcgctttgaaacagaagttttaaaaacctactcggtactcaccatatgcctcacctatcgtctttttagaagcaacttaaattagataaccctagtcatgaacgatctagctaagagtttatcatctcctcaggcagttccacccgaagggaacacttctctgcagatacagattctccagacgcctatgcaagatgcaggctagaaatgagaacaaccgaagaggtttctcctatcgggtccctagcataaacacttgactagaacgaacaaacagggttacttaagaaaagttacttcatactgaacagataaacttgcatacaagctttcttcttaccttacacttatacacaccttgcttcaatatagtttgcaaggaagactagagagattactacaaggaggggtatagtggaggatgagagtgcgctggtagctttgctctggagtggtgtctttgttgttccccttcagctgccaggctcctccttttataggggctggagaaggaagctcgtcagtgctctatgcttatcactgtggtttcacgggatggctcgcaccatgtagtggcacttccttttgcttcacttcgtcctttgtttggctggagtggagataccttgcacctgtgtctcttcctttttcaaaagttatattctccacagtgtttttagcagtgaaacgtcattcattgtcattcaccgaaaagcatttttggattgattcaaaattatatattattattaggcttaccatgcccaaaaatttgataatttattatcaatttcttatatttggctatattgcttattggtctggctgcccatggccgcccatatctacggtatcaacatcagaaaaagatacatcgaattcctcatcataaaacttttttatttcttcaaatttgtcaatcatttttaattctttaagtatttcttcttttaactcttttttcaattgaggaggcttcttcaaatttttcaattatttttcagtcaatgtattcaccatctaagggatacatccctttagttaagcattctttatatgaaggttttttagaagatccttcaacttttatattcgtatagtatggggtttctggagctttcttatttttggctcttttgcatttttgtatatattcctttgcagctggctccatataatagtttattcccaaaattttcatggcttgacttaaagcttcatcaacatctatatatttttttccacgatatatttttttccacgataggccgcccattatttttgcatctattttttaggctattatttcttcaaaggatatataaactccggggagctttccatcaaagactacatatataggcttttgctgtattatttcattattttctgaggctggcattaggtcatttagtaaatggaaatattcagcaagactgtttagtatagacagcatgtaacgtttttcttccctcttactattttattggtaccgaaaattgcctaatatgcattcctggagttcgtctaatattatgtgagtttttttgcttgaatttataggtatttggtggaaatactttgagcttgttatcttctccaaaagtgaagaattctactccattgtaattcatggatttcttcatgcctgcaacaagggtaaacgagagagcaggccaggtaaatgattgtcttttcccttaactaggaaggtagcccgcgcagatgcgcgggcaatttattttatgtttatataaaaaaaatctgaaaaaaagtcatatatcatcatattaactataagaacagtagattacctcgtaacctttccataaaagaaggaaatatttataccgtgaatttgataaggtaaatgatagtgtctatcatattcaaacaaaaaatcactttgttttggttatatgtaaacttacctatcatcatcctttgcaaacataatatgagttttgatgttttttttcttttattatacatctaattcacttacgcatgttcatgggtaatgtacaaagaaatactctatattgtcaaaattatttgtactaattgttaacacaatttatatgagaacggcataattaaaagggataaaatatgattccatatgacattttttattgtacgtatgtacgtaagtttttttttcccgaatggtagtctctcgtatgttcgttctttttcatgttttttttgacaaatatttctctctcataggaggtagggtgtgcgtatgtatattcatagggtggctgtgcacatgtttaaacaactgcctatgattgcgttttatatcgttagtcaaaaaaatattttcaagaaaattggcgagggtgacatgaagcggcgccatggcagcgtggcttcttcgacaacctcgcaaagagtggtcgctacatatatgtataatttgaggagaaccttagggctacaaagaaagaaattgaaaactaccagacgtggtggaccatatacacacacttcttttttatttttgacatctcgtatatgtacgtgcatatatacacgcacttcttttttttatttttgtcatctcttgtatatgtacgtgcatagagagggattagctagtttatagaagtaagggcttacctgaataaatctaatttaatggttgaaaataatggattcatcggtttaagtgcaaatcgatgggtagatgttttgttttctccttatattttttcttaaatttcctcctatttattagagcatcacatgacatctcacaagtgtttgtagaagtataggaacactattgcttaaactcatagtctacttgtagtcaactattgtttgttgtgattttgtgtcatcctctacttatctatcatttttttatgggttcccactaagtatcatcatatatcttcggtgcttgatgacgcacgtgcatattggatgtcaactaattattaattgcattgtgcatggatgtatcataaacaatataacttgacgattgttgacactggtttgtatatagaacttattacatagaatttatcggggacatacgattgatatattatactattctagattcacaaagtatattatacactacatatttagttttagtgcataagtaataaatttatggttaagttctaaagtgcttatcggagtggctacttcattatttatcatgaccatgtttaccgaattattaaacggtgcatattttacaaaatattttttattatagaagttttctaaaaatacaaataaatccattttcaagattttaatatttaatacttgattaatcttgtgctaatgacttgtgacttttcatgtgccctggatacgctaagtcaatgagctagatcgaacaaaggctaagtaggagaaaaaacatattgacgtggtgtcaaatgaatatatttgatcttcaattttctaataatatatgaatagagtaaacacataatacataaaaaaatatttctgataaatttataacatcatttttccatatcagtattttttacaagagagagagagagagtgagtaatttttgaaattctacacacacttgaagttgtttttattttggaaaatgtaagtctaatttaactatcacataatctatactttcaatttatttatattttttatgggtgtttcgatgacatacgcctaatttgaatacaactcgaaatagcatatatttttacaactcaaagcatagttgatattagtttaaattattagtttggttttctatctaatccaaatgatgagaagaaaaaaaaataaggatgtgggacgcggtgtgtatacgcactgttcataggaatagctgtgtacatactctacgtaggtacgtacttttcttaagaaggaatacctacatacctacatgcatgtatttttgccggtcgtgccaatacgacatgggcctttttacaaataaatttattttgtagttttaagatagatctaatagttgaaaataatgggtccaccaaattaaatgaaaaccgattggtcgggattttttcttattttataaaatttctatgatttattagagtgccacatgctggtctatgagcatttatagggtactatgtccggattagaagtgtttgtaggaagtttatcctcttgattacattttctccctttctctttatgaaaatatttgcaacaataatttttaaataaccacaaccttcttaattatatatttatttgtaacaatatattttaactcattataatttttaacttttaaatcataccttcatttttttatctatttggaccattgtgttatttatgataaaaatcacaattagaattcatacgtaagtatctacttcattcataaaatgtatattcttccatgttctatttactatcctatgtatgtatattcttccatgttccatttactatcctatgcacgtcattcaaacatatatgaaaaattataaaagaaaagtgactatatattatttctttcagtaccacttcacttgcatgtataaataaagtcagtcactgtatatattgctagatcaactttttaaagaatgcccgcgtagctgaaaacatatattttcaaatcatatattttttattgtacgtttttttaccatatttgtgaagtaataagttttgtttttctactatagaaaatactattttaaaaaaccatctgtttttttgtctacgcatacgtacattttttttcttggttttgtctacgcgtatgtacgttcgtttatttttaaataaacagtacctaaagtttctgttttttttaattgtgcgtacatacgtagatttttcggtataagcggtttcactcgtatggacatgattttccggtatatacggcttcaatgtacaatgtagtactttttttggctttatagctgcacgtatgtttgtttgattttttttaagcgagcagtagtatgggtttatatccgatcggaatatactttaatttttctcgtaaaactttctcatgtataaagcttatacggtatgggtgtagcaatgacttttcaagtagatctaatctaatggtgtaaaataatgggtccaccaatttaagtgaaactcaacggttagattgaaaattgccatgtggcaatttaggagcgtttataggaacaccacatggcggcttaggagcgtttgtagggagattaatagacttttagtatataatagatatgttcgaatatatatttgtatccatttccagtaatgatatcttcaaataaaatccatctcacgcaatttacggattccactgggtccttttcctcaaagacatggactcatacagagtccatgtctatgattcaatggataaagaggagtctacttttgacaaaatttttgaagtgatagacaagtaatgtcatctattccactgtcattatgaattttgctattgctactatgtggatctcggataataattaatcttagcttgtaactgtacgtagggcttaggctcggttccgtgctttggacaaagggtcttggaaagaaaaacttggccggaggtttaatattccagtgagtacatgctccaaaattatattaaatcattaatttgctctaaaatagaattgtatattaaatatcttgtcgtttctcctttagtgtgcaaagtaggaccaggggaataacttgtgcggctacaacgtttgcgagtatacactactggagaatccttttatagtcccgtttgggaatcctttttagtcctagttttccaaccgagacaacgaatctgggactaaagatgaaataaccgggactaaaattagatctttagtcccggttggtgttaccaaccgggactaaagaggggcagcggcaatcccggttagtttctattttttttcattgtttttttgctagtgattttctcccaaatccagtggaatgcatatccccaaatcaaaccccaaatcgccaaatcaaactaaattcccaagtaccacaaatcaaatacatctcaaataaaatatatcacagattatacatcttagatccatgcaatggattatagattctccaaaaagaaattatacatctcaatccatcgaatgaattacaaattcttcatctcaatcaatacaatgaatcacaaagtctaaataaaaagaaggacaaatctccggcagaggggatgcccggccgtcctccatgcatgcatatgcgcgcaccggcaggagagggcgctgttggccaccggccgccacagccgccatcccctccgctccaccgccgccgccggatctagcgaaggggatcgcgaggccgccgcacgcgcctccccagcccggcggccgccacgccctcccggccaccgccgctcccgcccggctgccaccgccgacccagagagcaagagtagaggacttggtggggaggggaaggagagaggaaaggggaggaagaggagaggagaggggaagtgcatgtgcctggttgttggatcgagatgagaaggataaggccgatattaaagagggagagaggaaggggaggggatcgataagtctcagacttggcgggcatgcggctcgggaggatttttagtcccggttagggtaaagaaccgggactaaagatatctttagtcccggttgtttataccaaccgagactaaagttaattggggcctaactagatctggtaacttttttgaccagggactttggacgaccgacgaaagatgatttctctagtagtgatacccactgcctaacaacccaaatctccgccatctttattcctagttggtgatctttagtctcgggtttttaactaaagataacgatatttaattagtcctggatttgaagtcctgtttgctaccggggactattacaaaccggggctataaatgggttgtgcagcatgcacgcgtcgtaactctcctttgctcccactggttggcggcgtcgccaaccatgcacagcacagtacgctctcgccgtcatcgttctagctcggtgtacacgtcctcgaacggtatcttcaactcggtgttccctaggccacacattgaactcgggcaacgacgaggagcgtgagatggagagagagagagagtgagtgagtgaaaagttcggaggaagaagaaatagtcaggacatgcatgactcgtcacattagctagaccctagcagcaccatattgtctggaatctccagttttacaagttacaggagacacgttatatttgaatactgcggttcgagcacgtaattcaaactccacctcaacataagggacctcaagtaaacttatcccatgccaaaacttgctttttcgatggccttatgtcctgaggccggaacggcccggattgtttggatgggccctttatcctggtccatctactagtagtacttttgtagcctcttgatggaataagttcagtttgactcccttaaaagtgacacgaatctaatccatgaccctaaaccgtaaaaccggatatctcgacccccgaactattgaaaccagggcaatttaactctctaggcggttttgaagggcggttttgctgacgtggctcctacgtggtggtattgatcgagtcttctttacacgtggcgttgacgtggcgcttaagtggctttagaattaaaatatatatatgtgggacccattagtcattcacacaaaaagaaatgtgggcccactgacatgtggggccatgggccctccctgtctccttccttcttcctcctcgctctctcgcttctctctctttctctccccttcttcttccccttcggccggtggcgcgcgtggcggcaggcaagctagggcggcgaaggcgagctagggcgccaccgaagttcttgctgcttccgctggcggcggcatcatcattggtcaccttaccagcttgcacggtggccccgcgggcaccctcgtcttggtgtctgtccaccagctgcaggcaggcttaagtacatgcgaaaaacgagagagagggattggaaacaaggggttgcaaacacaggcttaagcgtgacccaacataacacacaaacaaaaagaagaaaatggaaaacaaaatgtagtactccacttgtagtagatgagattgagaaagatgagcagaacaaactgcatcggcattgtatatagtggagaagaaataaagaagtggaaattgaggtgaaagtaaagaaaaggatgaaaaccttgcaagttgcaaccgagggagcagaagcggaatgggtcgaggaggtcgagggcgcagtcacgcagatctgacagttatatggggaggcggcggcgccggcgccgtgtggctggtttggacgccggagatgtcgaggacgtcctccacctccgtcgcccgcaccacgtcgtggtaggaagaacgccgtatctgcaccaaaaaccaaatcgataataatcttccttgaagtcgtttgcaattgcaatagaatgaaataagagaaagatgagacctggataatgcggtgggattggtgtcggtgggagtggcagtagtagcaaaagggcggggaaggggaagggcagtcgaggcatgtgagccccacaagtcagtgggtccacatttcttttcgtgtgaatgactaatgagtcctatgcatattttttaattctaatgccacacaagtgccatgtgaacgccacgtggaacgaagacttagtcaatatcgccacataggtgccatgtcagtaaaaccgttctccaaaaccgccgagggagttaaattacaccggttttaaccgtttaggagttaagatatctggttttgcggttcagggtcatcaattagatttgggtcacttctaagggagtcaaagtgaacttattcccctcttgattcggtttcaaaacggtgtgggccgctgtaccgtatcggatgttgtgttttccgatattattccgcgtctgattgagtcgactgtttctggttcgggattgagccctttccttcctcctttttatatgcagcaccggtcgaggccaactggccaaaccctgttctttcgaacggatcggattacttcgatcgtccactagctgagatggccgccgcgcgtgtcctgtgcaagagattgacgcccctgttccttgccgctcatgcgtcttcttcctctgtcacctgcgcaggcgctgctgctgtatgcccacactaaactcttatctctcttgatcccctctcttccaccatcctgaggttatgagcagcaattaattaatccatgtttccgacagcagctgaattttctatttgtttccaagcaattttttatcttcttaatttcatacctgctgcctttcaggaatttggcattagagcactccatcatgtttccactagagctatccatcctagctagtacggctattcccaataaccaggggcttattgtcttctaacttgtgatattgtctaacgcaagcagcaagaactggcatggccttaatgaaaaacaatcccatgaagccgccattttcggattctattaatggagccaagagacctttttcatccacatccaccaagaacactgatcctttgtaagaatcgtacacctctttttttgtggatctgggtacctgcattgcatatttgcatatcaaagattagctgcatgtaaatttacatctttaaaaagtttatgatctcatcattttttttttgtcttcgcagcgtctcttcagaaagaggtttatgttcctatatctttttattcgtgaacatgacatttatctcgtcagtgctcacggtgcgtgaatgctaaggagacatttaggaggtcccaagtattccgaggcatatccctctttttttgtctatctaaaaaaaagtaatgtataatgtgttatcaaccagagttggtatgttttgttattgtatgacagagagggatgcttgtaatcaaaatatggaaatgttaattctaaacgggatgcattgcacttgctattgtgttatgtcttatgctgataatactacctatgtggtttttcttcttttgtagtagtatatatgcagtttgtttatgtaaattatgtggagactgtaagagtttattcctgttgggtctgaatattcagagagctcactcaggtctgcatcagcgtggtgtttgatggttatcactgggttcacatcctctgccgttggcccatgctatggcacccgttgggcaatcttggcctttttttcttcccaatcatcgttgtagataaataacagttttttttttatttcgttcttccagttgaatttcgtttctatcatttcctccccaacgattctcatccgcggtgcaattcatggctgggagcggcaactacatcgtcgggagctctggcgcgggctcgggatgcggtggttgtggtggctacaggtgagcgccacttgcccggtgtgccgcgactcgccgctgccgtcgttgatggcaacgccgctcgcggaggccgtgcgtgcccctcgcggaggccctgccgccgccgctagggccgaaggggaaagaaaagatagagataagggagagagaggaggaagaagggttagacagagaaaagaatgacatgcgggtcctacatggtagtgggtcccatattatacttgtgtaaattccaaataggtctcacatataatatttttttattctaacgccacctaaacatcacatgagacgaataccaggtaacactgtcacgttagtagcacttcagcaaaaccacacttcaaaatcgctgaggaaatcaaattacactggtttcaatacttgggggagtcgtcttatctggttttctggttgagaggtactaattagattcggcctattttttaagggagtcaaagtggactttatccgcctgcgggaactcagcatacagctgggctaaggccagcacagggcacacacttgcatggtccatgggtcaatgtggagctggacgggagtgtttggcccacagaccgcatgagacgcgagacatcccagaagccactgttgttttcgttgctccggcataaagacagcagtacaagatgcttaagggacacgtagcagtaagttaatgggtaaaaaatggaccaatcagcttgcggcggagccgccggcttgagattaagtgctttatttttctttcatttctatagaactctgaatgaactggctcgattaacaaatattttattaaactggtctatttttttactggtcattttcctgggaaaattagttaccacttaccaccatgtccactctaacgcacaatatgaaacatatataatatatataaggtttcataaaaaaatatataatgttaattagctaagatcatgaagattaaaagcgtaatcatctaatgtttatatacaaaagttccaagttcccaacatctctacctcgttttccgtgtcacgcttttcaaactgctaaacggtgtattttttataaaagtctctatacaaaagttgcttaaaaaattaaattaatccatttttgaaaaaaattagctaatactccttccatctacttttgatagtcatatttcatcttgatacatagaccaaggataagtaattctacttatcatccatttaaacatgctactagtcattcatcgtaaacaaacgattcattaatatttacatttctcgatgcccaaccaatcttgtgtggaagaatggagagtcatgcattaaatccgagaaaatcattaaagggataggttgttgcattgaaatatgtctatcaaaaataaatttttcagatttggaaatatgactatcaaaaatagatggagagagtacttaactaatcacgcgctaatggactattccattttctgtgcggggagatgggttcccaacccacaactaacgaacaagccatagtaattttttttcattgcaacgaacgggcattatactagtatataatatagctagcaacataaatatatatctcacattaaaaaaaatgagattactttaatgcttcatacaatttggaggcaatatatataatttttctagaaatacattacaaatttgtacactcacaatacgtgcgcactcaacccgataaacccacacacgcacaccttatttctatgattctcttcgaaaaactaggccagtatatctggagaatgatgaaatcatcacgggtgtatcggtatcgatcgatgggtacatcgcttaaatctaggacttaccggttaccgctgaaagcatatttaccataagtacaagcacccgtatcaaatctaagacttaccgaggtggacttacacactctcgtttcgcatggaggtagtatagtgtacttagtataagtataatttgtttcttttttggggaaaagctgtgctcggttgtggtacaacgaaatagttaagaggactattgagtatacttttttcttatttttttaatatattgtctatacctcctatctacacttagataagctgttcgtgtgggtatacagtacctataatcttaacatgtatggagttcaaaactgcatttacttccaaatatatattagctgggttatatctataaaattcggacagagaattaacctaattataacattttcgctttctttaaacctatcaacgtgtacagatgcttcatgtcgcaatacgcaaagggagggaagttcccaactgctagttccacaagagttgcccttagggaaccagtctcccgaatggcttttgtgtattccctggaggttttttttggtgctcgggagcttccactaccatagtaccatagaaacctggaggtgccggttggaaatccggcataggtgctggatttttcaaccgtcacctagaaagcggtacagatgagagaaattaaatgtatcggttttagaactggcacctttgaggttccaggaatcttaaaaaaaaggcgactcaatgtatcgcctcggtttgagctgatgcatcgatcagctccccttcacctcgcctagaacaaaaaaaaatccaagaacatatgaacctgaacatcaagaacatcagcttcccagccaccggggtactatcgaagctaataatctccatgaaaaacaaaatcacaaaatacacatcaagaacagatagataagacatagagccgccgctgctgctgctcgacccaccaccgccgcttgacaccaccgctgctgtaaaaatgcccataaaaatcgaagaacctaaagcagcagtacgtggaggggagcatagcaaaggaagggggcggggagcgcgtcgtagtcatctcccttcctgctggatctggcgaaggggagggcaccgctgcctgctgcctcctccccttggggagggcaccaccgatgcccgccgcttcccctcgggtgcaaccgcctaccaccgcctcctctccctccagatctggtggaggggagaacgccgccgctgtggccaccgggacgagagagagaggagtgctggttttttagtgtatataggtgttggttttctaattaaccaacacttaggccctgtttggtagggctccaaacttcaactcccagctcccaactccaactctagcgagagctaactcctacagcaattgaagtgggtacgaaagtgtttgcctagattagttagctccactccaccacgtcccttgtaggcatttcgtcgaacacctggttgacgtcgccctgccacggccgtcaccgctcagcccgtgcatcgtcgccgccgccgccggtcagcccgcgggccactgccaccaccgccgaacacgcatcaccctgccgtggctgcggctgccaccgctcgcccgttgccgcccgtgcgccgccggagggacgccagcaggccactgcctcccgtgccccaccgtggtaggcggcgcatggcccgcgtgcctcccgtgcgccgcctgccgccaccggcgggccactgccgcccgtgtgccaacaccaccagtgcacctgccgatgccgccgccgctcgtggctctcgcacgccgcgccgtgccaccaccgctcgctgccgcccgtcgctgctgtagggaggaatatggggaggggagagaatgggaggagatggggtacgaaggggtagttcagtggcatattttgtgtaaatatattaaaaattaaagggtagtgagtcttttagggtggagtggagctgtggagcagcaaaaacccaaccccacccccgtagttcatttttaaggagtagctctgttaactccactcccaaaaacagaggatctgaactgtatggcacagctttggctccaggtaagttggagttaggagttgaagctgtgccaaacagggccttataataaattaaagttgttgtttttttataataaaaaccaacatctatattataagtaccggtttttctatagaatcgacacctataattttttaaatgtgtctttcttgtgttttcagctcatggaggagggaaaagttatataggtgccacttttaacactttcggcacctataacgctgacctctgtgagccttttgtgctagtgttcacaggttgcatcaatgttgaaagcaattcagtgataaacatctgtctactaatggcttaattaatacatatataggctcccatcggatggcccattaagctaacgaaaaagccaaattttaaatttttaaattttgagattgattgtgagatattttcaacgtagtttcttttcagcattggcttttaagtcatcaagaacacatgtaaaaaagttttacctacaatttttttttgaaacgtacctacaaatttatttgtatttcctaataagccgttttggcttattagaaaaaaagcgaaacgatggggccaatatatcttacaaaataagtctccgtacacagttgttcaaacaagtacatacagcgagacatatgtagccctctcaagatattttagataagttgacttcaattaacatatattcatcataacgttggaggatggagtcatcgatcacttagttacactgatgaagtgttcttgaagagtcctaaaataattatgttcttcaatttatataaatgatcggacaagcatgatctgtgctgcatgccctataattgaaaacagttaatgaacctccatttgtaataagcgaaagagacagtgatgaagtcacccatgacttacagagttacaatactagccatgcatgttggaattctttgtccttgtttacataaaaaaattttggctaaaaacgtcacatcaaatggttggacatatacatagaatattaaatatagggataaaaaaccaattgcacagtttgcatgtaaattgctagataaatcttttgagcctaatgatttgataatgtaatgctatagtaaacatttgctaatgatagattaattaggcttaataaattcgtctcgcagtttacatgtgaaatctgtaatttgttttattattagtctacgtttaatacttcagatgtgtgtccatatgctttaaaagacccagagaactgaacgcacatttgttcaatttagacataacataatttcactgtaataaaatatcacaaattcacaatgattcttttgtgtgcgctccgagaggggacgaaaacaatgattgtatcacgttgtaaaaccatttatctgccggcaaaaacttaaatgcctggccaactatctgtcagaaattagttgtactacgttgcatatgaattattcgcgaacaataatggtacatatatatatatatttggggtgattgtgcatttgaccctgttataatgtccaattagatcctgctattttaagttttctcgagaaacacccagcggtcttctggctaggtacaaagatggtgggatagacgatctgaattgaaagtctcatcctttttaattatttgatattaggtccttccctaatattaacgcccccgttttatgttttcttatttaaaccttttttttaaacgaagatcatggttgaccctatttcataagggttaattgaattcataccacttcaaattggcaaattcgaaaaaagtaccactattatttgcgatatccgctaagtgccactgaaaatttgcaaatttgaaaacataccatcgccataacattttctattttcttctttcttttcttccatcctctcgctgcgaggaggctagttggcaagcccctctccatcaataaaaaagaggtaggcgacgagcatcctcccccatcaaaggccatcgccggagccaagaacgccatcccccagtgcttcctgcctaccccatcaccccacccctggcatggagctcctaccgacggcggccattgaaaaaagacagtagacgaagcccagagcttcattggccacaccagcctccgatccgtaccgtactaccgtcctggacctcccctgtcctggacatatatcgttgccccaaccaatgtcaaagaaggtagaagcccgtcgccgtactgcactgcctcgatccgcttgaggtccgaacgtcaaccatgctcgacgtgctccagtccgccccaatcaggacaccgacattactgttgcgccgcccgcacgctgccacgtccccagagcatgctgacagggagaagaagaaaagaaaagaaaaagaaagaacatggaaaatgtgatggtgatagcatgctaatatcataaatatcattggtcattgtgcaaatatgaatatcatggcacaatgaccgaggatatataagtaaatctacttatcatatatttaaacatgctattagttactccctccatcccaaaaaaaactcaatcctagatttgaatctggacattcaaatccagggttgggtttttttactgagggagtatttctcgtaaacaagcgattcattaatatttatatttcccatgcccatgtagccaatcttatgtggaagaatgaagagtcacgcattaaatccgagaaagtcattaagaagaaagatggttggattgaaatatgccaatctaaagtagatggatggagtagcatttttctaaatcagaaaatgtataatggcacagatccaattaacccatttcacaaagcaacctaacgatgttaactcaaggatttatacccttactcatttgacatgctttctcgtttttttttcaaccaaatctgtactgttgggactttatttctttttctgaattattttcttacgaaaaattacttgcatcactaacagatggatggacccacatgtcagactttcattctttcctcttcctctttctcattcccctcggtttctctctcgttcaagcagcgcgcagccgccgagcaaagcaacgtgggaacgacggtggtcggcgacgaggctatggatggctcgacgaggttgggggcggctcaactcattgtctagagtctcatgaaagctggcatggagggggaagcggctactgaatgtgggcgggcagccatggcgacagcgtgctctcttgggccttccttgacacttgtccccggtgagctcccgcaccctccccctcatccaactccgtgcgcatgccagtgagcccctgggtggcacgcctcccctgcgtgcagtgggtctcttgctccacgcagctgctctcccttcacccgcgcatgcctccatgcatggcagtagtgaccttaccctcttcatcccctcacccacctccgcgccacatgccagcaaccgtgcgccggacctagctccttgacctcgctccgggtctcgctccacgccgctgctctccctctaccggcctatacctccctctgtgcccggttgtggcaaccgcgccaccgctccctctatcccagccctccgtatcagtgaaaacctagtgctaggccagctgcgtcgccaaattgacttgggtcaggccgggggtcatggatttgttaaggttgggggatacggttatgcggaatcaaggacattttggttagttcgggctagtatttttttttctttttcataaatgtaacacaaatggtggagtgaaaacaaggtcagaaggtagctacaattttgaaaagcggggtcaatagcaaactttaaaaagtaggattatgttagtagttaagcatcaaaatacggttaaacgagcaattgtccgtatatatttatggatgctaattaagtatttgtatgagcaatataatatgataaacatatttaaaacagttaatataatctaataggatcccaccatgtatgtttaatttgtgctatttttcccttttctacggtaccctaggataataggccatcagttgctttctatcgaatggattatatcctataataaaaaaataaactgatagtataggcggtagaaattttcatgtggcacttatttcttttcagtaaatcactggattattgaaatgtattactctctccatcccaatttaattatcacataagatttttgagatttttccgaaatgatcattatctaacaaagtgtctctttatttatttgtgcaaagagtaaatgtgtatcgtgaaatgtactgcatgcatgcaaccaataaagattaatttttatcagttcatttaacctatatatgcaacatttaatgtgtgaattaattttgttaagacgaagcgacggagcttgatcgataaggattatttttacaatgatggatgttttaatgttgttggttttgatgtcatttactttagagagttatcaaattaagatggagggagtatttcctatttgatattctttggaaacaacactttttttataaaaaaaactattgcattgcttataccacttgtttaagttatttgttaagtttatttattaaaatatttgatttatacctatgatcaaatcgataatctgtagcaataatttacccaataatttaaaacaatcatggccttagctaggacgcagttatattttcaaaggaaccggatcctctaatgtgaactgctccctgacgtggtcactgacaggtggcccgtgagtggtggggcccacatgtcagtcaccacgtccctctaacttcacgttagaggatcccaatccattttcaccaggaagatttttttttagataatggaatataacatcccggtctttgctcaagagagttacagccaattattacagagtagcactcaatcaagagtgtagttcaacaaaacattgaaaacacccaatgaacaaaataagtaacgaaactaaaataaggaaaacacattattgaagtctatttgtgaatctccaaccataattgacaaaaagttgcataactgtcgtctcaagcttacgatatgcaacttttataaactctccgtcttcttcatacttttgtagttacgcccaatatcaaagccaatatgttgcgctgaaaattacctgcatatatgagatggatgatgatttatcaaaaatcaaatcattcctgctcaaccacagagcccaacatatatcgtagaagctcctacaagtacaaacttgctccttttcttgtccacccctaaaagccaaccataaaaaatatgtgttatgctagtaggaatgtataaactaaaagagaactggactgctctccatataaactttgcataatggcaatctataaaaggatgttggatagattcatttttcatgcagaacatctcaaactaccattctaattccgtcttgccaaattgtctttagttaacacgacacctttaagcaaataccacataaagatcttaatattaagcggcatcttgagcttccaaattatcttatttctcttaatatagccactattaattaaagcaagatacattgaccttaccatgaactgaccattccgattaaagttccatttaaaacaatcagatgagcgattcaactggatatgtacaatagaagcacacaaatcatgccaagaaataaaattctgatgtggaacagaactctcctaaaagacacattaagaggaacagaactcataacactaacaattgaagaacatttccttcggataatggtatataaggaaggaaacttagctttaaaagccaagttacctaactatttatcttcccaaaatctatataagtttagtggtataagtcaagttgccaggaagatttatatgcattttaatttatttcaccttgttcacagtaattgttttaggacttctgcacagggagtacttagatcgcatcgtcccaataacaattctccccccccccccccctcctccttttgttgtttcctttattttgaggcgaacatgactgcttaccagtcagcactgtacacttaaattccatcgagattcacgcttggcacatgcatcatctcccgttcatatgggtcagtttaatttcattctggcaagttgcttcatgaaaatgatgaatttgtaagctacttgctttgtctctacaattttatacgtacggatatacacgtagactacagaacacatgatgttgcggccatcaagctgggatgcaaatgcttttttgacttttggcagtaattaatttgtactccttaggagtaactcatagctcatgtcagccaaatttaatgaatacacaattatattctagtactagagaagcttagatctgaaatgatgagaacagataatattcatgcatgtattcttggagctttcatatgtgcttgacaattcctagaaattatttttaatctcttaaaccagtattggcatgtgggcctaaccaaattaattaattaaactctagatacatatagtagttactacttgcccatttatcagcctcagtacttattaaaacccatcaaatgctggtaactcgagtcaatgtgcacatgtaagtatggaacatgtgtgaagctagaaaatattaaacaacaatttgaagtgggataaattaacaggtatatgtacttgcaactattaattaagttaagtaccatgtttgaaatttgtgcattgacttgtttaagttatggacttaactttttctctgtgtgagtaaagatgcatatgtactccctctattctagtatagactaattgattctctgtgcgttgctgcgtgacttcatatctataccgtaaacttgaagaaataccaatataatagatagttgatacttggacagacaaatagagagatagcatcgaaatgacatgtgcacacttacaatgaagctaaccgatctgactaataacgtttgctcttaactatagactgttgcattacctgatgcagatattagatagatattggctaatggctagtggctagtgaaatgtctgcaaagggagataataaaaacatgcaagttacttgacgtgattgaccatagcgtgaatcaataatcctccttgcaaaacaatctgctatacagtaggaaatatatgaaaaagaaggtttgcaacctaggaatttctaaatttgctttctattaaagaaaataaattaaatttatcatatggaaaaagatagaaacttagaggtaccaaattaggaaggtgtacctaaaatacacatatggagtatgtaggagtaacgtgcaagaataacgtggaataattaactatctgtcactcttacaagtggcaactaagaatttgccactgggtccacatgtcataaacacatgaggacccacatatcatagactgtgagtgacaaattcttaattgccacatcttaaaaagtgacaaaatattaaattaatactccgaataacgtactatctgataattatctgtgaagatggaggaaagaataagcgctgagatgaccaaagcaaagttgagctgatcccataccccaactggccagtggcagtagaaaaagaaaaacttgggcaatcaccaaattagttatctagcgcacagatccagtcatgcaggcaagaaaatagtagcaaggcatgtagctaggagacctccaagatgtcaacaaccattggacatgggcgttatcgaggaggagaacaataaaataagaggggaagaggaaaaggtggctgctattacttccgatgaattttgatggcggtttctaaggaaacaaagaagagacataaactgaggcacgacatggtggagcggcatccaatcgggctaacgagagggaaagtgagagaggtgatagggcaacagccgcgcacgtgtcaccactctccatgccgcagtcatcctggttcaccgcgaatttctcccgtgcaggcatcgctgatgcagatgcgctttgggtttttttccctcacagtagaagcgtgcgtgatctaggcggggctaaaaaatttgatggcagccaacccaactttgcgatattgttgatttggagacatgcagaacaattcaacgatggctcggaataaataatgatatgctaaaatgtggtgcacgctttatacgctttatagcaataattgttgtagtgggtttctactgtataggaagaaagggatagagagggggtggagggacgaaggggaaatgatgggttgggctgcgctaggaggtaaggggagaggagatgtagaatagagttatcaaatatatatatatggtgattgaggagtggttgtgaactgcaaacaaatcaaactatagctcttaagttataattagttcaaaatctcaatacagaaagcatttgccctcgatgagcaggagatcgaaagcaccaagcatgtcatttctcccattcgacgacagcatgaagctgttgtacgtgtatctttagaccatatggtataccgtacaccgtgctacgtgacaaatggtaagagtacttagggctgagggccctcgtagcccttagtactacgaacacttggactactctaccatttgtctataggaatatactatggccgtgtttagttttcctcctattcccaactttccatcacatcatatcacataaaaactttcctacacacgtaaacttctaactttttttttctaaacttctatcttttttcgaacttccaatttttttaaggaactaaacacaccctatatgtcaatcccatgacattttacacagcctcatcaagtacatgcctatattaattgttggcaaaaaggctatacaattcatatctttcaaagttcaaggagctagtacaaataaacaaacatgcgtgttgacattaattacattattcatatctctaattaattaacttaggcattcgaagggggcattacaattgtctcatctaacctagcttagctaccaagaacattccattgatcgactactgtccatacagttaattaactcagtgcgtgcatataattaattgaacagatcaattggcctaatttggaagttatcgttgtagcatatatatgcaagcacatcgtcgtcggaattcagaaaacgggaagatggtagaattaacatgtggcatgtgcgcatgctctgcggcaaattaaatgatgcgaaagtcctaaccggcgatcgatcgctgggcacgatcggtcccctccccacatagatcatcccctcttccacgtggttttctattttagcaccgcattacttttctattttagtaaatttatacacctcaagtttacacatctaaagtttatacacataaagtttagagacccaaagtttataagtcaaaagtttatatatccaattcaaatttgaattcgaatttaaatattttttatatatagtatttctatacatctaaattttatacaccaaaagtttagagactcaaagtttacaagtcaaaagtttatatatcctattcaaatttgaatttgaattcaaatagtttttatatatagtatttctatacatctaaagtttatacacctaaagtttatagacccaaagtttataagtcaaaagtttatatatccgatttaaatttgaatttgaatgtgaattcaaatattttttatagatagtatttctatacataaatttttctaacttttgtttttttattttttttaaaatttatggtgtagtaggaagagaagaaggggaggaggaagggggagaggagtgtatttaggggggtgggggtgatcgttgtgggcgatcacccgcccattagcaccaccctaaatcatgagcagaacagctaattagataacatccataatttgtggatacttgttgccgccttcttattcaagttaaaagttagctagcaactaagcatacttatgcatgcatgataaatcatctgtcacgggctattgttgtgtgacctccaaagatcatagataattttattaccgagcatcgtgacttcgtggttttagctttataaaacatcgcatgaattaacttttagaggaaagcactttgtaaacgcgaaaatcagctcgtcaccgttcctattgtatattaatttatggttgaatatgattgagaaaccatatgaaagttttgaaataccctagcttagacccacatgttaggtttctcatctctctatctctatctctcttttgtacatggggcccacatgtaagcctttaagttctgaaatgtcatcatcgagcattgggacactcccgcaccatggcttgtgcatctcctacaacactaggcttctctcgctgctccattgtgccagtagtaccacattgccttggtgaggattcgctctcaacttttccttcctcttctttgccatgcatgaccgccatggccgccttttctctagattcataacatcattgttagcctacctccgctccacatcggtcaataaattctaggaaaaatggaacccccttgtcccgaaacatagattgacgcgctcaccagtttacgatcggagctcactaccgatgtttctctctcctctggggctgtgcctttgcctgccacgttcctgccacgttagtcctcctcgttgctggttggcaccacctacaagtcacaccatgggaccatgctcagccgccatcgtcacggctgtccactcgcctgagtcctgatgccctcaacgacctctccactgctcgttctggattgacttaagcttgttttatgtgccatatataagctcatcatttcagctcgatctcgaatggagcctaaaacatgttggttgttgcacgtggcagccacacgggagagacgctgtcgaggagagatcctctctagcgggaggacgtgagacccctctttgtgagttcggccaggggatagggcgcgatgatcgagagcgtatcttgaccgtgcatcaagctagtgcggtggatgacaatcaagaggtagacgagggattatccagattcgggccgttaggaagcgtaatacccaactcatgtgtggatttctatttatgctgttacaagagacctaaaaccccaaagagacggttggctagtcttctcctaaggttcaaactccccagagtcctccttttgctcggtgggcaaggtcctgcttttatagttcaaggggataccacatacaccgcctctacacatctcggtcctggagaggggcccacatcaacctgggtcgagctgccacccatgccttaggctaaaagcaaagcggccgctcgtcctcaggtgggccctagcgccatccttcgcctgacactggggacatcccttgtcattccctcataaattcctggagacttttgtgggctcaagcgcatgggatgtaccggtcgaacatcgatcccctgccattgatgggacggggcatacccgcccccacgctgtctgacacagggcaagacgtgggtgcgctgccacctatcccatccggtcatagcccggtcaaggcgactgatgcacgtctaactgctgggcggcgcacgaccagccacgccgcattaaacacgacggggggcggttggggcgccgcccataaatgcgcctggtagcgcccctacctccgtccactcggccgccacgtggtagccgaacgagggcctcggagtggaggcccgaggggtgcgacgggataccccgaggcccctaggcatctattgtccattttttgcccgcacgcctgaccccccgacgggggatccgggacgcacggccacatggctgggggaaatgatttttcccttcagcacgggtaccctgggcccatatcaccgacagacgcaatcgagctagcaggccagggctgctagggttgccccagaaatgcaagagatcacaaccattgactatgtacattccactattgaccgcatacatccaagggggtgtagagaggccggtcgtagacattggcatgaccaccgtgcccgtggacgaccggggctgctgcacaatgtcgtggacacaggtccatctcacccgtcatggtcatggtggtcatgctgcacaattgtttgtctttcctagcttattagtcgtgaccgcagaagtaagtgattgttttttgggttgatccgtggttgttggtgcatgtaagatgtaactaagtaaattatatgccacgtgagaatactgttagagaattatcatttctcattacctcttttgaaatgaattagtcggtacatgtaactcaatatacacttggtgagtttgattccgccatatctatgctgtaaagttataaatctaaagttcaacattcaaccatgtcacatcatcacccactaacaacaattatatatttaaccccatgcaaatataaaacatcatctataatttatttaattctacaaatcaatatgcaagcatatccaattatcaccagtcacatcatttgcacaatattttaataaatctatccatcatttttataaaatttaacatatacttattaatatgttccacatttaagcgcatgtatcatttgttgtttcatgataagtactgataatccctgatgttttattattttttttctttttactcctagttgattgttgaaaaatatatatttagaattggttagtaattcccgcagtaaagtgcggggaatcacctaattacttttatagccatcacgaacgcaactcccacaactactgggccgttgtcccaacagtcctctcctcctcctagaaactcttatcatctacttattagtttatcagtggtacataactaaaatttaaattctaaaacttaattttaaagttgtttttaagttttttcatccattttcatgtttcaataatttttccaaggtttatcagccgttgctcaaacgatcagatagcagccgctatagcctccatagccctcaaaacagtggacatattattcacatctccatcggtagagaccctggatatgatactagcacggccggctgctatctatccatcctgttgggctttcctgtgtctgaagtaccactgaaccctcaaagtcagtactccactaagacgttgaaacttcagatactgcagaacatgagccatcgtcccttgcaatgttggatgatggtccatcaccgctagctcttgtgtggcgcgctttgttttccttatatatcctccatatatataatcacatcgctatagcacttctttggttctttgtaatcttggtcatcttcatctcccatctctccctttccttttattaatttctgcctcagccttttctagatgaaagaaaaattcacagctgtttatttacaaaaaacagtataaactcctcttcgtactaaattatatataaggcgcgcatatattttaaaatttaaacttcattagttttgactaacatttagtctaacaatataaggtttagtgatataaatatggtattgttagactagtacctagatgtactttaatatgatgttggtttcattattgataataatacacttcaaagttttgttgttgaagagcactgtctcgagtcaaaccgcagcttgtaatttgggatggagtaaatgcttggtggcaaattgatgaggttaactccactgttttctgcattcttaccacccatcattaagtaatgagcaggcaggattgtcaattacagtgttctaactaacacaatctttgcctgggttcttgttggccttattcattatcggcaagctaacatattatatgaatagggtacccatagaaatggtcaggtctaatgattgattgcaaagttagttatagcatacatatccatgcatgataagtcataactatagtattgacttctaccttagctctttgttgctctctgagtgtacaagtaaactgcatatcttaaaattaattactctgtttgttggatgtaagtttctagtttactagttaattcttgctcttctagaaatgaactaacaatggcaccaagctttttgcacgacatatggctctcattcaattcccctctagaacacaagaggttttgcacacagggcataacacactcattaaagtagtaaatcgtataggaacctagccagctagctagaccaaaatccctattttcccaaccaatgacactgatcttgcacctaattaatattaaaccaccaaattaaatccacaccaaattaatagtggccctggcaccataaccctcctgctttctaatcagtgatgacacacacaaaacacaaaagctaatcatattaattaattaactaaatgcttaaagctagccatgctttgggacaaaacaagctgtggctcccctaggtacagcccagatgaatatttagcgagtgtgacacatttggataataaaagattaagacatgccctcaatgaaaggaagctgtttggtgcccatggagatgccaaatggagctttctcccctctcttaattctgctttctctacgtacgccgtacgtacatggaggcccccacattttttttctcttttaatttcctcctttttttattcatgtcttaaaaaattatatttgacgcatgcatacaccaagttaatttggctgcatacttgcatggtttgtgtataagtaggacaggagggtgtggcttgagagttcgtcactaccaccattctcttcttcgtctacttccagctagcctgagctctagcttagctctagcttagcctgaagaagctaagagaggaagcaacaatggagattgagagagagagcagtgagagagggagcatcagctggagagctagtgcggcacatgatcaagatgccaagaagctcgacgcagatgatcagctgctaatgaaggtcagttgctaccttaattatcacaaagttgtcttcttgtaagcactccactgtcaccatggacagttgttcactgtaactgcagaagcaagagcagagcttaatgtagatagatcttgagagtacttcctggcatggcattcattgctcatgaatgttcatgtgtgtgtgtgtatgtggtaattaaggactgatggaacattggatcctcaattatgtctgtgtttctttttgttagtttctcagttttggtaaattgtgtacaggagcctgcatggaaaaggttccttgcccatgttggtcctggattcatggtgtctttagcctacttggatcctggcaattgtgagaatctctctctctctctctctctctctctctctctctctctctctctctctctctctcaactgaaacttttattttgacaaactctggattgtaactgttaattttgtcacaaaatgaaacagtggaaaccgatctgcaagccggagccaaccacagatatgaggtacgtacagtcgactttattttactgtttacgcactgaatgactgaaagcatgagtaactttcatgctttctaggtgttcgtccctttccttgtccctcgcagactcacactccattaattcatctgctagctccatcaaattctccaaattgacaaacttttcagaaccacttttaatccccagtgcatatgtatctcactctcacatcatctagagaaaagagaaaagtgaataatctgcaccattaattgatttctatgtgcttttctgtccattgtgttgtttcaatttgcagctgctctgggtgattctgattggactcatcttcgcacttatcatacagtcgctagcagctaatcttggagtggttacaggtgactaaatgacacgcaattaaactgtaattaccaacttgataaagtgctaatatatggccggcattaatttacatcctagggaggcatctggctgagatctgcaagagtgagtaccccaagttcgtcaagattttcctatggctgctggcagagttggccgtcatcgctgcagatatcccagaaggtatatacttattagtaacaacttgacacggtccagcctgaataattaatttattaaactacttgtgtttaacagtgtcaccatctttgactttgagctaattaattaattcagtttaagctctctgacagtagaagaaaacaagttgatctggctagcatatgtagctccaaccgtacgggcctacatactggaattcctaatccacaaacataggcaaattaatatctcaccaatcaccatcaagccacgttcttctcagctactcaccagattattctcacatattatttctttcatgtctctagctagtaaatatgtttttctaaaaaaaatatattctgcgatattgcatagaatacaagttctaagccattttttaaaaaaatatttaattcatccatataataaggtagataatatgtaccaataatatatctgttgaataatctgtttcaaacataagcaaatgcgcgttttagctgtttagaggagtgaccacgtccacagtagcttcccataaaagtgtcaatgatgcacatcaagattagattttaaacactgggtgagtacgttcatcatcttacgcagattagtaaacaactattttgtcaccctcttgtcatttcacatttgtcctgtcctgtatacatccatgtgtgtttaaacaataacaacaatatctaaatatctatctatctagcaacatggaagagagatcagtggtgtagcagttgcaaaacggagctgcgcgaagctttgctgatcgggattagttaacctcaaccgttgtaaattgcctttttaattgatcatgcatgcaagttcttttttaaaaaaattaaactagttatggaagatacctcacatgatgatagcaaaggtgatatatagatagatagatagatcgatcaacagatagaaaggtacagatcgatgtgattataattaattaattaattacatgtcgtttgatgttgttaattttggtggatgcagttatagggacggcctttgctttcaacatattgttccatattccggtgtgggtcggcgtcctcatcaccggcaccagcactctactgcttcttggcctccaaaaatacggggtataaattattttttgtaagttgtttttgtttagtatcacaagcattagcgtaggatgcactcaaagaaacgattataaaaatggaatagtatatgaaattagctagttggatcgattgtcaagtactcaaatggcatattatatgtacattattcagttttttttctctgactgtggaactgcatgaaaattgattgatgaattttttttgaaaaaaaacaggtgaggaagctggagtttctgatatcgatgctggtgttcgtgatggcggcgtgcttcttcggggagctgagcatcgtgaagccgccggcgaaggaggtgatgaaggggctcttcatccccaggctcaacggcgacggcgccaccgccgacgccattgccctcctcggagctcttgtcatgccgtacgcttttacatacatacatacatacgcaacaatcaatcaattaattcatacaactaatcagttaattaactactgcatgcatttatatatatgcagccacaatctgttcttgcattctgccttggtgctatcgaggaagacaccggcatcagtcagaggaatcaaggtagctatattcagcctgggcagatcgagataggtatagggtagctaggacatgaactcgatctagtcctgtctcttaaatcttgtttaaattttattaaattaacatgtaaatttcatagaaaaccaatactttattagctaagttttattttagcactaatcttctataatttcgggctccagtaccactggattcagcttagaattttttcatgcatggaaagaaaccgaacaaagatccaggctaataattaatatgtactatatggtgtgtgaattgccacgtaggacgggtgcaggttcttcctgtacgagagcgggttcgcgctgttcgtggcgctgctgataaacatcgccgtcgtctccgtctccggcaccgcctgctcctccgccaacctctcccaagaggacgccgacaagtgcgccaacctcagcctcgacacctcctccttccttctcaaggtcattcattcattattacttcctactccttaatattaaaaatttttaaatggattagacgtatcctagtactacagatagaaatctattcagattcgtagtactagcttgtatgtgttcaatttaatcaatatttaattaaccacaataataccgaattagtctacacgatttctccgtcctaaaatataataactttattagatatgtttatatttttgaataggaggagtaactaatttatggtcaaattgtgacgtcaatttttttatgtggttcagaacgtgctgggcaagtcgagtgcgatcgtgtacggcgtggcactgttggcatctgggcagagctccactattaccggcacatacgctggacagtacatcatgcaggtaattaattaaattaattaacttaactgtacctgtacctgtacatcaccagctagcttagcgcgtaattaaatgattgaactataattaattaaacggctagctgccacataattaatttgttaatccgttcaattatggaggttaactgacgaattgtaggggtgcacacctaatcctgtttacatcacgaatatttagtgatataatattcctttattaattaggtaatctggcgatcctcgtcggatttcaccatatgtttttgttaaagtcagatcgaattaagacgctaccttgctgccactacttaccactttcgtccatatttctccgctcttttggtctagtccatttcacggtgcagtctcatcaataaccagcgattttactgtttacatatacttagaaaaccaattgattaataaaaatatgctaacgaaactctataaattatattaaaaaaaataggatatcccatcgcaccgtaaaattttctttctgaagtgaacgttgagaaagagaacaactagttttcctaatctacctggcgggctaaccgatctagttcgagtctcattcctcttaataatctatttatgatatgaagcgtatttcagttacgggataaatcggacccgaaaatatatatttattttttcactccaaaggactgatcttcaggatatactcactccgtctctaaatatttgacgtcgttgactttttataaatatgtttgaccgttcgtcttatgcaaaaacttttatgaatattatttaaaaaactagagtagtagtagtatatacaacaatgaatcaaatgataagaaaagaattaataactacttaaatttattgaataagatgaatggttaaacatgtttagaaaaatcaacggcgtcaaatatttaatgacggaaggagtatatgataaatcatcatcatgtcgcgttgatatatatgatatgatccatgtatgtgcagggtttcttggacatcaggatgaggaagtggcttcggaacctgatgacaagaaccatcgccatcgcgccgagcctcatcgtctccatcatcggcggctccaggggcgccggccgcctcatcatcatcgcttcggtcagcatttttattattactatttactatagcaaatctttactattattactattttactatagcaaactgcgtgcgccatacggcggcgcccgccggcgagcaaccggccggccgtcgtgtcgccgatcgattaaaatttaatgcgtttaaatttttaattttgcacatgcccaaacagtcacgtgtgtgcagtcgatcgtgcggatttatgtagctagctaggtagtagtggggtatccactaggtacctagtgacatagtactaagagcatatatatatgtcattagagcaaaagcactttttcttctttttttagattattgccaaatcaaagtagtgatctgattagcaaaatgtcactgactagctaggtatcttttctttttttgcaatctgatctaaaatagcaccatgcatatatataatacagtgtaccatctagctagactagcttccaactcaataagtaaggactaattatatataattaaatcaaatcaaagtagtgatctgatcattgctagttcttgtttgcttaattacatatatatgattaattgttcctaatccgtacgtgttgtgtgcatgcagatgatactgtccttcgagctgccgtttgctctcatccctcttctcaagttcagcagcagtaagagcaagatggggccccacaagaactctatctatgtaagatcgtacactatatatatgcattgcttaattatagtttgtttcttaatctcaattggcagcaaatgtacaagtaacataaatatatgcatctatctgtccatgcatgaaattagagtttcaataattgttggtaaagaatataaattaatgatgatagttggctagctagctggtccttcaccctgcatgcatgcaacccctacaggacaccatgttctataggtcagtgtgtgcataatatagatcgagatgtgcagtgaattgaattgaatcattagctacctagctcatgcaatagtattatagcacagcaggggccaatgcaggacaggtatatatatggtccagccatgcatatagaggatcgtcgtacatatgaaaacgacgaccaagatgtacgtcctgcatcatttttctgtcttgcagtagtaccagagattaatcatgtattgcgtcgtcggcatgatgtgtcaaaatcatgcagtaacgtacttgcttgatctttacagacatcgaagagccaagttcttcagtacactatatatattttttcttgcatggaagtaaaatgtaaatataatttaacatagatcattacgtatgtcgttgtatctctacttaaacatttctagacacatacaagtcaacattagaaaatgtaattcttttttaaggaccataaataaactgatctacaacaaaattgaacaaatgtaaatttatttcttattattacacacatggctatatatatatatatatatgtgtgtgtatatatatatatatgtgtatatatatatatgtgtatatatatatatatatatatatgtatatatatatatatatactacctataaaaattgcgcatgctcatcagtcgatacccgttaaaaagatatataagttaccacccgtcaaagatgactggttatttagtgacgctatcaatgaattaattagcgtcatgtatgtcaaaaaataaattgaattgaattgaatgcagataatagtgttctcgtggttcctgggtctgctcatcatcggcatcaacatgtacttcctgagcacgagcttcgtcggctggctcatccacaacgacctccccaagtacgccaacgtgctcgtcggcgccgccgtcttcccgttcatgctcgtctacatcgtcgccgtcgtctacctcaccatcaggaaggactccgtcgtcaccttcgtcgccgactcctccctcgccgccgtcgtcgacgccgagaaggccgacgccggcgacctcgccgtcgacgacgacgagcccttgccgtaccgcgacgacctggccgacatcccgctcccaaggtagagaagaagaagatcgacatgcatacgtatggtatagcgtatgtatacgtacgtatatacgcgtacattgtgaatatacgtacttacgtacgtatatgtgcatcctctatggatgccacgtgcgtgcgtcggagccgttcgtttatatttgtgcggtccagatcgctcgcagatcgatcgatcgacaagggtgtgcaattaatatataagcatttgaggggaggtggctcatgtatccttgtaatttatatgtacgatatgatttatcataattcagggcagagccaacgtccttcaattttctgtgatgaatcaactactattaattaattaattaattaagcaattagattaatatattagtattggaagagtagtactatagctgtacctttttttccagaaactagagacacgtacggtagtgtactgtatagacttcggagcagtagtttgatctctgtcaataattaataattagtgcaagttggtggattggatatgcatattatcaatttccgagtgtattatgcaaatttgcaatcttttagacttttactcatattatcttttcttagcgataatgttcttacgatcatgtggtactgtagacctacgttttgatacacatcgtacgtgacgatatctttcttttcaaacgccgcccttcgctcacgcgttgcacaagttgcacattactgtcagtatgagagtcaccgcaaaagaaaaaataacagtgatgaggtaactccactgataaattaaccctcttttccactactacacaactgttaaatcgtaccgtcctattttttctaaaacactgtataaacacagatgtccacaacacgcgtacagtcacccctatgacacaccctatcattatgagcacctccgcaagactgagccggcatttattgatactgaccaagtcaccacatgtgtctcgttgtcgatcggtacgtcgtctaccactgaatgaataatcagccgtaaatacgagcacccgtatcaaatctagaatttgaacccgggtggactcgttcaaccacaagaaacttaaccagtggagctacgctcgcttcgctcgtaccatctattaattttagttgagaaaagcactgataagggtgttctatccacccatacggctcacaccctctacaaggaagaacaggcaccgatacatgcatcacatcagtgttggttcattaaaaaaatccaactctatacattaaaaacaccgacactgtgagacttctgtcggtttttaaattgatcggtatagatgggtattgcactgagctgagccgattgagctagccggacgatcgattatttgaaggccaacaaaaatcctttcctggttgatctctctgtctatctcactaaatcctctcgttctctctatggaactatcgcgcgtcctcctcactatcgtcaccgctaggctggctccctcttctcttctctcagccctccacatgtgccatttgtctttttttctctctcaatctagaccgagcgaaatgaaggagtggcaggctggcaagggagatcgagcggctttacgggaatggtgagatcgactatattggcttgacaggcaagtgacttggctcccatccccactctcagtgcgagcggatctagccagtgcggcctgctcaagcttacatttaggatctggtgtgtagtgaccgtaggagctataggagaagaaggcgatgactgaggggaggagggaagaggagggggagaaggcggtacgatattgtaaatattgttcttgataatggggaatgatgattagtactgaatcaatgtaatgttatatgtgatgtaatgaacatgtttgtattgatctttgagaccttattcggctaatccctcccactaagggattgaggaggatttttaggggatttattccatatatgttatggtgtggaattatttcccatcaatcccctccaatgatctcttagggattaaacgaacaagccctatataaggattgattagggggtatggatgcgtatgtggatatcggggaggcgcttgaagcattggctcaaatgagccgattctcccgatctgaactcttttataaccgaccacaaatgctacccactcatcaatgccaaagagtagagctctttggggaaccgaaaagtagtgcttgttagaaaaccaacactgattaatcttctcaacaaacattaatgaaggtttatgtggcagtgtttattttttaagagagaacatattgtaacttttttaaatgcgcgcaaacgaaccttgccttttcccatagccttagataaaataaatataattaagtatttggatagacgaacaaattgttatgtagcaacgaagtgagtgtaactcaattcattaggtttcttgtggtggaatcaacacacccgggttcaagttctaatttttagatacaggtgctcacatttacggctaattattttttcagtggtagactgtatccattgataacaaggtgtccatactgactttgtcaatcgcaagatttgtcagcttagttttttcgagatgctcatagaggtagggtgtatgtatgtgtgttcatagaaataagatgagtgcgcgcacactgtgagtacttgtatttgtataatgtctctaaacaaaattgttatatagcaagaacaacacgtactactcgtctcaactaggattcgaggaataggggagtaccagctaatatctctcctaggcagcttatatagtgcacgataaattgagtgcatgttaactattacaaatttctatgttaaatgttttttcgtaaaacatccattcgggaaatatgttcatgaaaaattagttagtagctaaatcgaatagctgattcaaaatcagccagctacaaaatagatggcacatatacatctctgtattttctatatatacatatgcccaatttaattactttctgtatctcaatacgttagatagtgtgcaagatttccttttttaggcagtgtgcaagattgctagtgttaattgattagcaccaattagctagggtttgctaaaacttatatttaggaatattaattcatattccaagtaaaatttttataagcccaattgatcattaccttttgtcaacatcgatgtatgccagagagatctctgtaagttttttgggtttggcacatggagcgcaacaatgcattgccaaaattacaccctaccacgagatactcgtgctgcctgctaaatcccagacattctggagacaacagtttttactactattactcattgtcattggaactgcatatatatgcaatttctcacattattatcactcatctgctgcatcttgctgtttggattgaaggatataaatggaggggagggggaaggaacctagaggaaactacagtaaattttactatagcatacagtttggattataggaatggagcgaagggaaactagctagaacccgtggtctcacttgctggaacttctcctggataaccttacaccaatcttccaaaagcacttgatcttcttcccctagcaggatgctccatttctatgcaaaggatttagatttataaattaaatggcctgcaaaaggataattcacgagtatgttttcaaacaccgaatcatttgtaaccatccacaaccccccagcgaactaaattcatttgttttctctacttctctattttacacgtacattcctttgttttatatttctatttttccctgttttatttttctgctttccaaacatatcaatattggtcctagatagttcccgttggcactgtgaaccggcacaacaagtgccaaaaagaagctacccattagtattagtaatgtactagtatatacttgtacacaagctacccatgtgtttaagaaattacagtacctgtagatatagatcagcaacatccttatcacatatggtattcacaagaaaatacaacttaattagttcgtcaattatatgtttattaagctagtcgtcgttgttttaatttaattaattactccacgtattattattcatcatcttctatcaaccgggtcagagaattataccgctgacacccaccatcagttacaattaattgtgagatgcatggatcacgcaacaccagtgcaaacaagtcagaatgtcgacacactaattgtatatttgctagatccagttgttcatgaacatatccatctaatgtcttcaatcacatgctttgtgtattttatcttcagtactaaacatgagttgtttgattttctaataattaacagggacgacgacatgatgtgaactgcaaaaatttgtagaataacatagtgccataaaaaatatgacagtcaacgtttgcataaagtggacattggcaaatcatatatatataagagtgtcaggttttctgttcactgttgcgtaagctaccgatgcttaattaattttcagatttttgatgcagtggttagcgcctgatctctgccgccattacaacatctgggccccacattaccatatgcattagccttgtctgaaatggttattagcttcagcatctcaccttattgcagaatattcctccaaaagagtatgaagacagtcaaatgatcaattctacgcagcatataccgatcttgcactagctagctagttagtttcctccataaatagttcaaaacgtcatgggtaactgctcaatcaaaaagttaatgtcattccaactgaaaagcaatcaagaagttaatgtcattatattccaactgaaaagcactctatgagtctaaaaggtacgcatcttagagcaagtttaatagtatagccaactactagctccaattcatctatgagtaaatttactgtgtacccctgaaagttcactcaatccctttcatacccctgaaatttacccgatcccttctatactcctgaaatttcaatttgattccttgtatgcccccaccgttacattttccatcatttcactgttacgtttggttgcaaatgtcatttttacccttgatgctttaggtttaaatataagctccaaaaacaattgaaaattttatttgagtgcacagtatgtgtattttataaaactaatgagactaaataattagtgcagaaaattttgacataaattttaaaaataaaataaatgtaataaattaaatttttatttgaaattttaataagacaatggatttttttatcgggagcattcataaaaaaaatgttgtgaacatgggtagtcctatctttatatgaatgctcctcatttttatgacttcttttaaaaaaataaatacgtatttttttatttcattatctaaaaatattttttggaataaataatacatcgcacaacaaactcataactataatagtctcatgcgagaagcttttatatttttaataatgtaattcatgaatttctttgttcatccaagggtaaaatggtcatttttatagaaaatacacagtcaactaacagtcaactgacgggaggggtatgcaagggatcaaaatcaaattttgggggtacacaaggaagtaagcaaaattcaagggtatagaagggattaggtaaaatttcaggggtatataagggattttctctttatctatagtcaatctaatagctcattcatacaatagttacatagtacactattaatacctggtcccacttatcatacacacattgtgtcttggagtccgtactacagctggctacaaatctgtagcccgctgctcttctctctccttatttatctccttaaaatatgtttgcagctggtttatagcctgctattgtacctgctcttatgcacacaaatatatattgataggagagatgtttattttcaaaaaaaaataatttagtaatatatatatatatatatatatatatatatatatatataatctatagtactatatggtacttcaagcaaattcccacattaataagaagcaataaataaatcaagccatccatataggtgagagctcaaatcaaaataagatcttatatcatatacgacttgcaattatcaattttgaatttccaaaatcactaaattaatactttaagtcaaatacaacttgatatttccccatcccaaaatatagcaagttttagccttgggtatgggtatatattaagtagcaggataaaaagaattggttgcctactcgggatgggtgaggaataggctcagagtagttgagggtataataaagctaaatgatagtggggggtagtatacgtagtttagtagtaaaagtaaacttttacaagtatttgattgctatatttggaataaaatttgagttttagaagttggttatatttttgaaaggagggagtccttattattcaaatttcagagttattgaataataaaaacaacataattaagaccccaaatcaagttaagaccaggacttgattaattatttatcaacatactataaggaattaaatcaaacacgattttgtatttgttattttcaatggagctatttaatctagaaaagactaaaactaagactacatacatggcaacaattacaacttatttatatttattaactgtaaattctagaattattaagttaaaattgaaaagtattaaggcaaataatatattcataactataatttaaaaatttaaaattataatacaattaagttaattatattgtccttgagtagaacttccagtaaaaagcacttgcaaagtatgcaccaactttttgtcaaaatataagcatttctaaaatttttttgtagaagtatctttatctactaacaattgagatgacagtgtaaatagatatggtctattgaattagaaaagatgaacggtttatattgatttctactaccgttttgaactatttcttttcatattgattaagataaaaaggagggtgagaaaatggttgtgattgattaaggcgagtgagcataggaagaagttgttatatggtgagtgagcaaagtgaagaagttgttatattcttaaaaaaaattaaatattaaatattagaagttgctatattttagaatgtatggagtaatttaaatagccgatttagagtaattaatagaaaaaaattgccagcacagccttgctagctgccagcttctacctgcggctccacatctccctcctgcccccaaacatgcatggttggcagcttcgttgtcatcgctgcaccacatacctaacttgttcatcaccatcaaggtacacaagaagacaatggcgatgtgactctgcattggcttaaattttgtatgaatctggtgaaaagcatgtaggccatgcagcaaatgcatatgcagaaacaaatcattcatggagagatgcaagattattttttttgcccagctactagtcgctgatgagttgcatctgcctgtcctggagtgtctctccctcctgccaaagtttttaattaggcacccaatgcacttatcaatggcactgaccactgataacaggaagcaacaaaagtgtgtagggacaggccggcagatccatgctgaagaatctttactcaaaagcgacctgcaaaatggcaaggaaggattggaatggggtgatgcaggcaaatgcaattgtgcaactcttttttttgtcaggataggattagagaaagggccaaatgagatgataggtcaggtagatagccatgcaggatatatgtacagtactagaaggatagtacagtgatgggtcgtagagatacgtacattgtcagagatctgggcttgtgcttgcatttggcactgtgtgagatggcaaggaggcatttttgtgattccgacgtgtggccagctttgcactttcatagtttcatgcatgttcttatccagctttgttctttccaatccatcacatccctgcaagtgtgcatcaacaagagaacgtctggtaattaaagagtaaatttgtttatttggtgaataagtactttgttataaagagtgctctcacatgtgtcgaagtgtgcagtaagggcaaccagttccccatttttcttgagaagtaatgccaaccagagaattttggctacctgcagtgaaaaaaaaaataccagaagtcatcagaagagatctgtattttattttagaaagaattacaatgttatttttaaaaaaattacaaagtaagaaaggactttcccatcttcctgtttattttccatgtgcagtaattgaagacctgaaaattatcactcaataaccaggtacactacctattggaaatttggaagcaaactgagaagcctgtagtttacttgttggcatctttcatgaacctgacttgataccttgactacaaagcctagtagtactttgtttcttgtattcatgtgaagattggactgcacagtctgtagatgcctttcaaaaagttcagaacatacgaggtggatcaccaagaatcagatgcaattttagtgcaatgctacaaccatcaaaacaacctacggataattaaaggatgaagtaaatcctacctctggcacccatccatcttgatgataatttagattattacaaattaagataatagttttggaaaatatttcaatatgatcttcaactcagataatctcataaatatgaagaaatgaactgagctgatatacagttgaagtcagtatctatgaatgtttggaggatatgagctgcttttacaacgacgatactaacacagtaggagaggctcctactgttttcttgtaaataaaggacgatactaactgcggaatattagactgcctagtgcctccagctatttggtgctaaacagtaagtgatttcagcctaaattcagataagcgacccctgtcaggaaggaacgacaggccccctgggcaaggaagcaagatttgctgattgttggatttcctgtcattgatgtttccatttcatgaagcttccttcattctcttgacaaactcaaaaaattcagcaacttgtagagcataggttacataaaaaggaatgcatagatattatcatatcttaatatcttaaaacttttacataggttacataagcagatactatcatatcttaatatcttaaaacttttaagatattaagatatgatagtatctgcttaaagtgcataggttacataaaaaggaatgcatagaacaaaaacaaaagtgaacagattctgtcagggaaaaggcattaagggggagtttggttcagagccacacctttgccataagtttagcaagtagatttgaccctagcatttggttcgttgcaacactgagtcactgatcattaaattgttcttcgtgttgagttgtgatccaaattcatttgcacttaataaaggccagcttctgccgtagtggagcggaggcccgtcgccgggaggcttgggccggagcgaaatggatcgtcatcctttttagggttctaccatatatatacctcttgtaagccaccgtgcggcgatgtaaccttaccccagatatagtgaagatattttgctggctggcgcccgtggttttttctctcctgttttgggagggttttcacgttaaatctcgtgtattctgtgattgatctattgttttttatcgtttgttcgcttatcgtttcctaacacttcgcagtggttaatcttcaaaatccttaagttctacaccaacattaacaatgttgaatgacacaacttgcaaccggtgttgtaatataggttcttcattccattttagagtgaaattagagatgatgggcaaggatgtcccctcaatttcagaatgaacaggccacattatcagaccttaagtaaatacgttttgttctgccagacaatgtaattttgctttggaattattcagttcacaaacatatggctataagtggctgcttcagaaattataagaacaaggctactggctgaagaacacatgattggtacattgttcttcagttaccaaccaggaattcaaatcaaatagagtctgagctgaggaatctcgtgaaccatttacgaaataacaacactcatcgtctgtttgttaaaaatatatcgtgagttcatgacactggagaaaatattaatattttttacccacatactttccttgtaaatttactatcgttagaccacgcgacactaggacggttgtacattgtgaaccaaacacaatgaggagatggctggacactgacaggattctttagggaagaaatgggaggaaagatgagaatgaatttgtttactctttatttgctttagcacctagcaacttatctccagctagctagctacttatagcaatgaacagtgaacagtgaggtttgagggcacacagcacaggaagctaatgatcactgtgagagaagaaatcaagacattcgatgcaactacttgagtttagactttagggtgactgaatcacttaacttatgaattttcatttcagccataagacagaatttacaatgcaaaaatgtaatgcaacaattcatgcaaggcagaccatgggatcagacgaatacatctatctccattagttcatgtttgacggtattttgtacatagttatgaaatttaaccacatttattgtatgtactagcaaaatgcccgtacttcgttacgggatcaaaattaaaattattgtacaagcgaaaaccaaaaaaattgatacacaatatataggttaagaaggttgcagttggttatataaggagtgttttagatgattagctcaaaactttcaaagcaaaaatcgattatatgtggtaattgtcagatgccacatgtacatggttctcaattcaaaacttttttttttagcatattacaatggcatagtccgccaccgagtccaggtagtttcccgcctcgatatagctcagctggtaagttcatggtggtgaaccttatccacctgggttcaagtatttagtatggatgtttgtatttatggctaattattatttcagtgtagtgtatttatacaatgtttcaatttattatggcatttacaggttaattaacccaaaccataatgggctcatacggttccaactttcaaggaatcaatcataccttggcccggaatgattaattaatttaggacggaataagttcaccaatcgtccctaatttttgtgtcgaatttgtttcataacccttatctccaataacaaaaatcttcacccctatactatataaaaccgtgcaattttagtcccataggttttactgacgtggcattctagtcagcgaaaaaacatgagacccacatgtaagtgagaagaaaaaatgtgggatccgcatcttctttattatatttttcttcttctcttttcttttctttcttctcttcctttcttctcatttcttcagcgagcaaggagagtgctagcggcagagggggcagaagcgcccggtgagcctgggtaggagggggaggcggctggtgagtccgtccaagctccaccgccaccaccaacaccgcctcgagcgtcttctcttcttttcttctcatttcttcagccagcctaggaggccgacgacaacagagggggtagaggcggccgaagagcctggccgagcaccgccgccgccaccgacgctacctcgagtgtccaccgaagctgcagctaaccccacccacgtattctcggcggaggcggcggcgaacgtccacacggcggccgtcgcaccgcaccacactcgactacctcattccgctgctagcgagcccattcttctgggccggtttggggaaggcggtttctcggcgatgaagttgttgaggccaatcgcgccgccggagaatccgccagcggaggatccggaggcgagctccttgtggatgccgacctcgccgttgcagagtccccaatcaccaacaagacgcgagtgcggggccaggcggaagcgagggaggagctcgtcaagccagtacgccaccgcagccgctggcggtcccgtcatccaccctgccgacactggcatccatgatgagatcccactctagctcgtgaaatacgggcgggaggccatggtgctcgaggcggcatgaggcatcgatggcagggcgaggtttggttgggatgtgcaggccgggtggtggtggagggcgatgagttcgcaagcgaccgagggagccagagctgccactgttaccggtgccgtcctcctcagcggtcactgccagttgcccttccacaccgcccgccactggccgctgcctaatgagatgggcacaaagtggagggggagagagagaggtgaaggggtgactcgtgaagaaaggtaagggtcactgcgaagtggattccgatgccacattagcaaaaatcgagaaaatatggtctatactgccaagggacttattttgaacggtttggaacactttaggggtcgatattttaagtattgggaattagggatgttatatagactcgatgtgaagttgagggattacaagtgaacatactccatttaggacaccctcagctctgaaaaattatagcagcctgttacaaaatatgccaatccagcccgtatgaggagggacagaaacagcccaattactctgaaaaattgtagtagcagcccatttaaaaaaacaggccaatccaggccgtatgaggaaggacaaacagccaaattaatggatgttgatcatgaattcatgattcacacgcccctttttgggaaaaaaaattgtatggcaccccatgccacaaagcatgcgtggcacccctatcaagatcttaccacctggcgtacacaaatcttggagcactgatctaccttcaaaaccatactagggcaaaaactaattaacgggctatcgctaatctcgcgcgcgcggaaggatggcggcggcgatgcgcgtgacggcgacgcacgggcaggaaacggacggcggcggcgacgacacgacgacgtgtgtgccagaaagggcggccgctgccggcaacggcgacgcggaagcatgcagcaacacggcggaaatcgacggagctagcgctgcccagattgatcgcgtggcagaggtgcgcgggttgatcgatcatgactcgaggtcaaacttcgctgacgatgccatgaaagaccaagccactgcacatcatcagttcagttcagttcagatgatgagaatcttgaagattgcatgaatgaagaaaatgattagtgtgtgagataattttgattgatgtactttgaagattgcatgaatgaagaaaatgattcagtttgtgattcaacaattccttttatcacaatatttcattaatactctgctttatgtacaaactatatcaaaaataatatttatgttagttctgctctcatgtgttaattccaaactattaaatttatcgatcgattgagtcgatgtcgctgccgtgtttcaatttgtgtgcactttgctgctgccgccgccgtcggccgtgctgctgtgcaatgccgcttttttgccgtgttggtgcgtgcgtgctagtaatacgttacgtcgatctgccgtcgtcggccgtctgcggctgccgccgtctctatttcctgtgatgtgttcgtctccacctgcgtgtgtgagtcgcggctcgcgactgccggcatccttccgcgtgcgagattagcgatagccagttactacctccgtttcaggttataagattttctagctagcattgcccacattcatataggtgttaatgaatctagacacacatatatatttagattcattaacatatatatgaatatgggcaatgctagaaagtcttataatatgaaacggaggaagtaattagtttcatacggttttgaaggtagatgtgctccaagatttgtgcacgccaggtggcaagatctcgatagaggtgccatgcaagctttgtggcatggggtgccatacaattttttccccttttttcttgctaatagatggaaacataattgatcatgcagactggcgcgaacgaaaaaaattccggaagtcttgcgtattttttaagtagggttaaagatagatatagattagaaaaaatgtccgtgtattgcaacgggaaaaaaattatcgagcaataatttgatcatattaaaatctacttgtttagtgctaacccttaatttgtgggcctcaaacaggagaggaattacttgaactacatatatgaaccaccaatattactccaatcctatcatgatctagatggaggcttttggaataagattctgaaatagctttcagttaatgccttctcaacacagttagcagctaaaatccagcaagcacttggaacacctagcctgcagccaactaatgagaacaaatttgtactttacaaaagctaaacacctcaaatggcttcagccattcattctctcaccgtcttggagcacacccaccgcaccgtcgttcaaccaacgcacgacgcgccaagaacagcggtgtcgccactcgccaccgccaaccggccgagcagcccgccgtgtcggcctcgcgtcccttgcaagcagtggcgtagctaggaaattttcattgggtagtcctacttcacaaatttacatcatatactaaactttttaaacaccgtaaatctaatatacaagttcaaattagcgaaaaggcaatcgaaaattaaaaatatagcaataatctatactactattaaaaagaagacactaatttaagatgaaaggtcttatttcaaccgattaaaatattttgaacaaagacttaattcgttgcaacagactggaattcgactagtgctctcgtaacatcaacaatcacctagattcatgcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttagaatgctgtcagaacctgtcagacccccccggaatctttagtcccggtttggtagcaccaaccgggactaaagatcttaactttagtcccggttggtaataccaaccgggactaatgatcccggtgatctttacccccggttggtgctaccaaccgggactaaagtcccacccctatatatatgtcttcttcctcctccagctgcccgagcaagcttcaaaatttcttcaaaaaagaggggaggtcatgccaaaatttctattgaatttatttttgtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttatgtgcggtttttttgactcatgtagatggatcggcaatggatgtacgctgaccggcggtccaaagagtttattgacggcgtgcactattttttgagagtgcccgaagctaccaggcaaaggggttttatttgttgtccatgcaataagtgtaagaatcagaaggagtattctgcatccaggactattcatttccacttgtttgagtcggggttcatgccaagctataattgttggacatcccacgtagagcaaggtgttgaaatggaagaagatgaagtggaagacgacaatattccggactttgctcagtatgttggatttgaaggaaatcaaacgagcgaggaggaaatagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcacaaaaagttggataccactctagagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcttcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccactgtacgaagcctaaacatcgcagcgggaaaacagtgtttgctatggttaaagatcttaaagtagtgttcggaaaggggcctggaagccagcatattgagagcgaagatggtcatgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggtgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggccctctcaaggttcctctgttcccgcgccaatgggttaggttgactggtggatgcgtaatgattgatgacagtgggatgacaactgttgaccttaacaaggttggatacttcgacaaaccttttg

SEQ ID NO: 6904 - DNA, 9398 bp, Oryza sativa
gccacgccgccgccgccgtcgccacgccgccgcgccaaccgccgccccgatgccgccacaccgccgttaacgaacgagaacgagaacgatcgaacgaacgagagcgagaacgaacacgtcaacgtacgttgccgcgacaacgtgaacgagaacgagaacgatcgaacgaacgtgaacgagctagggaacgtgaacgagcgaacgaacgaggacgaacgttaacgtgaaatgcaatatatatatatacatgtatatatatacatgtatatatatatacatgtatatatatgtatatatatatatacatatatatatatatatatatatgttacttcgcatttatcctaatacatttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccaatactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctaaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagtgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgatctcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttgaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcaaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctcttccggcaccttcaaagtcaagggcccccccagctccaccgcttgcccacataagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgccgaagaaagcatcttctggaaagtccaaaccagtccctcagcttggagagcaaccaaaccaggagatcgagccgttggtgaccggtaaagaaatgacgatagaacaatttattactgacaccggtctaactatggatcaattgctaggagtcgcaccaatcgaaaaggcagaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcaaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgtaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatgtatgcatatatatgtattgaaacatatatatgcatggtttatatatatatatatatatataaaccatgcagcaacaggggcatgcaaaaaaaaaaatgtcagctctatctttagtcccggttggtgttaccaaccgggactaaagatctatctttactcccggttatttcacccgggactaaagatagcgatctttagtcccggattggtactcccggtttggaaaccgggactaaaggggggttacgaaccgggactacaaagggtttctccaccagtgatggttaaggaagagcaagacaatatcacccccctcttcatgttttatcaatcattcaaactacaatggcatattcactaatcattaagcacaaattgcatattcacagatttagtactcacaaattgacaatgatattatgatagtagtctagtagacaatgagaaaactgagaataattaatgaagctatgagctagaggagtagagttgtagagatgtagaggtacctacagctacaggaaaggaaataagattacagtcggtgaccaacggcgacgggcaaccatcacagcgacctcctgagcgacgcagcgacctcctgaggaagctggcactgcggcacgacatggaaccagagctagcaagccgggggcgtcttggcttctcatgtctcgccatcttggctggcctcccgagctcccggcgccagcggctccgcggctagtggtgccgctgcgacggggagcgggagcggagatctgcgcgggtctcgagctgggactgcggacaacgacagtggtgaccagcgaggagccgaggagaggcggatagctagagccggtgacccaccatcgctggctcgctgcgagtcgccgaggagaggtgaggaacgacacccgccttgcgccttcgcagacttgatacgagcgtcagcggcgcacgaggcgaagggagttgcggctgagcggctccactcctcaaccctagcgcctgctctacttgggcctgtctctgttgggcctaggcctgaattttgggtggagggatggggttctgggccaaaaccggggtagtcccgagcccatagggactatcccctagctacgccactgcttgcaagtacgtgtcctgctttactacgaaggcatcgtgcatcagcaaccaaccggctactgcttgaaggacggcagggcacgcaagcaggactgtaggaggcagtaggcttgggttggccgccgaagaagccccaacaacccagcctttaatctcatcgctctactttgtcccaatgcagagcacccctttgcccagccactgtcgatgcccaaccgccaccactcgtgtctcaacgttacccatgtgtgtcacgcgtttgctccccatcttccagcaaacctagcaccaaactaagctcgaacccatccgctcagaagtccaggggcggagctacagtgatgcctatgtattcccaggaatacccaactttttttatcaaaaaacaactatacttcaatatatacacataacacatatacacatattagttgtccccactcctccagagtccctcgctcggctcacgcctcaccctcacgcgcaaatgcgctgctcgcccgctccccaattccccatttgattccaaaccctaggtggcggcgttcggcggcggcgcggtggcgcggcgaccggcggaagcggcaaggcgtccggcgaccggcgacgggagcagggagctagaccagcggtggcgcggcgaggcattcggcagcggcgcgacgccgtggcgaggcattcggcggcggcgcggcgaggccgcgagacggcaaccgacgggcgaccggtgacggcgggagcgaggccacgaggccgaggggcaggggcgcggcggcggccggccaacagctgcagctcagcgggacagcgcccagcggcactgcggcaggcacaatttcaggtgacaaatcaagagttcaagattcaatcagtcctaaatccactcactatgtgtccatgtctgatgtttttttaccttagtctctgagtagtttctttttcctgtacttttgtagttctgtagattgaagaactctcaaaatgaagaagaaatcgattgatttgaagactttgtgggatagacattcaaagtctaggaaggtagggttaggttctggttctggatcaacaacacagccagttagaattgacagtgaagttgctgttccttctgttcagccgattacagatgcaaatgagagtccagttcagattcagattactgcagttgaggttgtgcctgaggtagcagccagtgatgcagcaagagatgtgacagaacctgaaacagaggtagctagcaatgatccagacatagcaacagcagtgacacagcaggagcaaccttccacttggtctcctatcagagattggtctcccatcagagatggtgatgatgaagagacagagtatgactcaagtgatgaagctatttatgacattgatttactttgtcatgatcctggaaggcgaattgcaatcaaaaattatgatgtcaataaacggaattctgtgataaggggatatattgcattagggccatgccaaccacgcagccacagttttcctataaggaaaattggaggtaagcctcggcgcttccttcctagttggtatgacgaatttaaatggcttgaatatagtgtggaacaagatgctgcattctgttttatttgttacttattcaagcataaaattaataattctggtggagatgcatttgtaaataggggatttaggaattggcacatgagaaaaaggattgcaaaacatgttggtggtatgactagctttcacaatgtggcacaagataaatacaatcacttccttgcacctaaaacaaatattgttgagagctttgctgccaccaatgaacaagacaaggctagatatatggctcgtttaacctattcaatgaagtgcttgaagtttcttttaaggcaaggtttggctgcccgtggacattatgaaagtgaaaagtcacttaataaaggaaatttccttgagatgttgagtatgctagcagaaaactttgaagaagttggtaaggtggttttgaataatgctccaaagaattgtaagttgactgctcccgaaatacaaaaacagatagctaattgttgtgccaaagaaactactaagcttatcatggaagaccttggtgatgaatattttgcaatacttgccgatgaatctagtgatgtgtaccaaaaagaacagttggctctttgtttgagatatgttgataaaaaaggaagggtagttgagaggttccttggtgttgttcatgttgaaaatactacttccttgacacttaaagctgcaattgaatcattgcttatggagcattccttgagcttgtctaaggtccgtgggcaaggctatgacggtgctagtaacatgaagggtcatgctaatggactaaagaaattgattatggatgagtgcccttctgcctattatgtccattgctttgcacatcaactccaattaacacttgtggctgttgctaaggaaaacccagattgtgtgtggttctttgagcaacttagatttttgttaaatcttcttgggaattcttgtaagaagacagaaatgcttagagttgcacaagctcaaagaattgtagaagaactagatttgggtgacattgaaactggaaagggtttgaatcaagaaatgggtttgggcaggccaacagatactcgttggggatctcactataaaactgttatgcatgtcctatctttgtatccttcaattcaaaaagttcttataatggttggcaaggatcgctcttttggtgcagaatgtgcaaatgcacaaacagtgttgacaatattccaatcatttgagtttgtttttatggcacacttgatgcaaacagtacttgggttcacatctgacttgaatcatgctttgcagaagagggatcaagacattgttaatgcagtaggactgattttattgacaaagtttcaattgcagcaattacgcgaggatcctggatgggatgattttcttcaagaagtgcaatctttttgtgtgaagcataagatcaagatccctgatatggactctttctatcggccggttggaagagataggaggttctttattaaaatcaagaatatgcatcgcttccatgttgacatgtttctaagtgtcattgatagacaactacaagagcttaatgaacggtttgatgaggtaaacacagatttgctcctttgtatggctgcatttagtcctatagataactttgctagttgggacaaagataagttgattaagcttgcacggttttatcctaatgatttctcaagcacagagatgaaccatcttccatcag

SEQ ID NO: 6905 - DNA, 1064 bp, Oryza sativa
acgattgaccctagcatcctcctatcaaatgaagacaccccttactcacgcagcgatcacaagaagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggtaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatacatgtggcatttacatatgttaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtactttaaataatgacaatgcattaacttctattttataaacacatatgtaagcgaaaatcatatgccctgctataatctttaatccccggtcttaaccctaaccgggtttaaaaagaatttcgaaataaccgggaaaagatatttactcc

SEQ ID NO: 6906 - DNA, 9369 bp, Oryza sativa
tacttaattaatcagtcctatgctaatcacgttaagtgcggctaattaagaacttgacaccgcaacgctgtacgcgggcgttcggcgcggctctttcatcctacttatatatcctagggtgtagggttttggtcggcaccgcctctcctcctcctcctccttcttcctcgcgccgcgtctcgtccccctcaccgccgctccactgccccgccgccccgcactaccgacgatggcggcgccaccgaaatggcccgcccgcgtggtgcgggagacgtttctttcgagtcgaaggcgcacacccggtgttccccgagcaccatcctcgccgcaaaggattcccctctacttttcgccgacgccgagatgaatcagttcatgccggtgctcctcgacaccgctgcacaaggctcgcagctcggatgcccgggacacgcctgcaaatctctccgctgtatccccgtcgccgtcgatgataggcacctcaccttcaccgaggttctggggaactggtcctttggggactacttcaaggaggaggcaattggatttgcgtgggagctcttgactaaggtaacagttcccccccgcccccccacccccctctcttagtctcttgtccatctatcttgcgttcatgtgcggatacgactgggctatgcaaatcgtgggaatcggattagtgatccactagtgtcttgggtggcttgcgattaatttttgggctgcagattaacctgatgtgcaggagaattggggtatctagttcttccgcaactgacaggatttagggacgttgtatacagtggaataatgactagtttttgtttttttagggcgattttttttaattcggttttctacgattgattgaaacataaaaatggtggccaatgccattgttttgggatgaacgtttgattttttttgaagatgaaaaatgtggctatctgcaattaggagaaacgccgtttatatgtcacttaagttgatgtgttgcttctcgggtgaaacagttgaaggtgcaatctattaagttattaaaatgcattcattggactcttgatctggtctgggacctatatgttgcattcatggaatcatgatctggtcagcgacctatatgttgtgtttgctgattcagggcatatgttgtgtttgctgattcagggcttcagactgtaactcctgaatcattctctgatatgcaggtctacgaattggaggttgatagaatttttgtgacatatttcggaggtgatgagaaatcgggcttagcccctgatctggagtcaaaacacatatggcttaaatatctaccatcagataaagttctacctcttgtcaacaaggtattgtgcatgtgctggcttactgatgagagcttttggcaacagggcattttgttgtattagtttcattttatatgttcgtttctctcagattattttgctcatacaattcgattttactattgttgcattacttacaaacgaacaattatataaacctcaacagggtaacttctaccaaaatggtgacactggtccttgtggaccgtgcagtcaaatatattttgatcagattggtcatcatgatgttgcttcattattgaacaatgatgaccctggttgtattgagatatggaatcttgttttttttcaggttagtatacttcttttaatctgttttgtgcagatggctaaagttttttcatatacatataatcagttagtttgttttatttgtacatgatgactatccatatttattccttctacacggtgctgtgctattgctaattgcttttcttcgggtactggttgataagcttttatatgtaatcagtgattttatttttatttgtacatgatgtttttccttatgcatacttacatttgctgtttgcattttaattctagttcaataaggaagcaggtggcatattgatgccatcatcagccaaacatgtaggcactggactgaacttcgaacaattaacttctatacttcagaagaaaaagagcaaatttgacaccgacatattaatgccgacaattgactccatccgccaagtatgatgcccatatgcacacttgatgtttttattctgtataatagttagccatagtttcctattgattttgtatactgtatatgatatattaatatttattaatgaataatttgcacatctaaatgcagtgtactggcaatgaaattcaaccatactctggtaaatttggtcctgatgatattaatgaagttgatttggcataccggatagttgcagatcacataagaacaagtagttttgctattgccgatggttctcagcctggtaagtatatactgtttgatggtgataaatgatatgaaacacatgcaaatgcttagggttttcttgttgtgacacatgcaaatgcgattatgagatgtatttgccttgttaatgaaataaggagctttgtcaccttgcattctatatggtatgatgatcttcaaagtttatctgtcatcagaacatcctctagattcttggtccacctggtttactagggacggtaatgaactgaaaagattatgtggtgcatactgcactaccattacctgttttatttgtcatatgtttgttatcctttcagtcttcattttgtagtgaaaaatggttcttgcctgtctgtaatattatatcctttttaggaattgagatagcaaggaatatgcttaggcgggctatttacttcggtcatcaaaacttgaaggccaagcaacgatttcttacaatgtaagaacgatcacttgtctatgctatttgccacgtcttttggtccatatgcttgcgtaactttattcttgcacagaatgccacaaaacaatgtttcctctggacacaaaagctagtccttttggttttgtggatttaaacattatgaaccttggaaatcaaatatcagtttaaatggtacagttgctaacatggatgtgcatatataagtctctaaaagtactagtacataattttactaagttgaatagcttattccgtgcactactaaatttactgcacgaacacatggaatttttatatactacattgcatggtaatatccatgtcaatctgcatgggtggtttggatgtaaatagaatttttatcatgcaccctgcatcaagcacatagtttccatctttttttgttattgtttgcaccagcagtaacactccacagctcaagttgtaggatgctattatcttgtatgtattgagatggatacttggtactacatacggagttcagcactgatgcatatcatagtcctagaagtattaggttatagtattgcatatatgagatggtaacttgttaccgcatatgctatgtgtctttagtggaactgcaaaaatagcacatgagatggaagtattttaccatgggaggcagaataatatgactacacctgtgattatggaagaagagcattactgcagatatctgttactcctgtcccaaaatataaggtattaggactggatgggacacatcctagtactacgaataacttatattttgggatggagggagtatgataaaaggtttaacatgaaacaaactagttttatagtgaatttaggggctgatgtggtggacgttatcaactattactttgttttagtctgagtctttttccaacaaatatttggtttgtcattggcagatttaacatggaatctgaccgaactgtttgattctattcacattagcaaaggcctatgatatgattgctttaggttcatgtgtgccttttcatttgatagtttaatttattttagctgatacttggctttgatatggaaaatttttttcctcccagaccgttgccaccacccatgtacaagtattgttatttggagtaggctaaattgcttgcaatgtgggtcaataactctgcttagactgtagggaaaaaatacatgtcctatatgatgactgcctgggatttataatacttaaattgatctttttttttccttgaacagccttgtaagtgcatttatcgaatcaatgagtggagactttcctgagcttttacacaatgaaaagaagataaaagatataattgcagaggaagaaatcacttttgcaaaggtaatagtggtttccagatgatttactgagctgaagaatcagtttttccaagtaaagtttcaagtgtttttgttgattaaaatttttcactcaaaaagagtgggcacacttcactgctcttaccatgcattaataacaaatcattttgactacatttggcgaagggccctttgacatttcaatttgctgggtttttagtgccatttgatactgctatatagttatgttatttctagattggtgttttactatactgctagaagagggtgatgtagaataattgtgttgcatcgagcaactgtatcaaaatgggaatatatctagaataatagtcgcaatcttaggtattagattggataaaagtggctttcttatatcaacaagaagcttatctgacccttttatgcctcctgtttttgacaattcaagtttcttttgttttttttactcataattcaaatggcagctatgattccagttcccattctcattatgaggttgttcctactgcatgtattaacattacaatatacacatgcaatattgcagaaaagtacagtagcttgcaatatagttgattgtcaccaaaattcatattctgccttctctttctgtttaactcattcttaaggacaagaagaaatttaaaaagaaagacagcaaaaggcggaagaaggagaagaataacactgaacaaaatgttgtggtgaccagacctccgaaggtgtcctacaagactaggacaattgatttctttggtcgtcccactcacattattcaccagcatgagaatgggccatgcggtcttatcgtgatctgtaagagtatacagcttccctttttttttttgttctatgtttagcttaatttacattagtttcatgtgcctgtgcaggcaatgttcttctcctaaggagtgagattggattgttcctaaacaaaactgaagtgatggaggatgatcttcttagtcgtatcatttctcgccttaaaagatgcagaaagatgcaggtttgcaacttttatataactgtaatttctcacaataaatacaaatgtaactcaggcttccctttttcttttgcagtttgagttgcatgagggttttcagtactcagaattccaacataaagttttatctgtagcaaaaaacctctggagagaagtatgcataaatgtgacttttaaaaggtgataatgatataaaatgtgctgattggttgtgtttgtgcttgcgtgtgttctgatgtttgaaatgttgacattgcagtactgatggctttgtgttctcacctgaatatgcactttttgattatcttgaaatccctgtattccatgggtggcttgtggatcaggtaagagaacctaattgttatgttctttttttgtgcataaatgtaagaccaccgagaacactgaatgtgtagttattgcagttgcacttcaatgcagcatcatgcttaatgtggtgtctttgctttgctgcacggtacctttctcgcattatcagacgcagtaatggaacacctcagcccatttgaagcctgtagatgtaggaggtgttggcccatgtggcccagaagtgttgttgtggtggtgttttagtaccaactcggaagtttaggtgagtgggggcctgcttatatgaagcgagttaacccttttacatgaagtgaggatgaaagtgtaagcagagtattaaaattaaactggctgttttgctggatatgtttgtttccaaacctagccaggcaaatgcaaaagtgtgggccttcgttcctgctctggagaagtggagatacagcttctcatcatatgtgcacatatcagtcacctcgcctccctcagattacctcacttctacctctacatacatacaacaggatgatggatgagcatgagcagtgggcaaggaatgggaggacactgttatagggtttagtttagggctttacctcacttctacctctacatacatacaacaggatgatggatgagcatgagcagtgggcaaggaataggagggcactgctatagggtttagtttagggctttgttcctgggtcattctcatcaggcccgattgctagggtttagtttagggctttgttcctgagtcattctcatcaggcccgattgctatcgctaggctaggtgcaggcaaccaaacacaaccatagcatatacataactatttctcagattttggttttcaattgttacattgattatcaggattcagagttggcgtcagctattgctacaagttcttatgatgaacttaatctagaagttggagagtatatatcgcaaaaagaagccatggggattaaagggcgtggtgatcgtgaagaagatgaacaactgctgagagccattaaactttccatgggggacaacagcgttactgatcaaacacggggacaacagcattagtttcgtttttgaattacatattatttgaacataactttgccaatcttaacataaatattattctttaccctaaacattaatattattctttactcaatgttttcttagtggagcagatctcagattttcttcagggccctcaactgactgcccatgggtataaagtttaatttacatgttttgaaatagaatactttggaactaacagaaaaagaacatgttgaagtacaattttttattgttgcagcttgtcatgcttgcataaagaccttgaagaaaagaaaccttgtgtacttttctggaataatcattggagcacagtaattaaggtgagaaaacaaggttaacagtctttgattattttagtactaattttgtttatctgcctttattatattttgacctttgcagtttgaagaagaattatatattttagcttccgattcaagtttcttatcaagtgaatccggtgctgtttggcaaaagttggaagatgtatgtccttatttactactaatttttgtttgattgaaatgcatgtcttaatgtcaaagtcatggtacattaggtgaatgggggtggttcatttgtggatagctccttcacaccaattaaatatgccggtgaaggagcaagcttctgcagtgatcaggctcgtctaattcaggtataacttctctactttgtacgatgtaatgctgttattcaaacctggtaccttgttttgtttcttgtacttcactccaataatctgtcgtagtcattcacctgtaacttcatagtttatcctaatagttggtcttaaggaattttatttctcttagcctatagcttcttactgctcttgcattatcttcattcttggaactgataagcagataatagttgtggtcaactttaaaaaagctccagaggcatgagagcatggttgagacaatctttgctagtggagagtacaaaaataccacatttagtgatgtgggctttgggcatgttctaattctaaacaatacaatttcttgaacaagattgtcagtcagcggcggacccaggattccgtcatgcctgggctaaacccttaacaaccgaactagcactaccttatatctacaatgtgttatagcagaagcatatcataaatgcatcactaagatggcactttactcaatgtttcaaagctaacatattacaaaaactcatggctaaacagaaaaaaatatgtctgaaaaaatatctatactactataaaagacactagtggggtggttgttctgccaccaccactacttttgtactttctgcaaattagtccttgatattttctgatattatacaatagtctaatatttgtttgaatcaagtgaatattatgtattcaaataagcaaacatgtctaacatattattatatattttcttttacccatagcaaagcatgagtgttttgctagttgatctacaaaagaacgaacaacaaagaaaccaaaacaacttgctgaaatcaatatgctgaagttgtgttcaggaaaagcacaaaaattgcactaacctttctagttcaattgtacagctaccatatactgatatactagaatgacaaatacaagtatatactgaattgctgtaattacattgtgaacagcaattagattgatttgaatagctataatattccatgtagacgttttggtaggatccatggagtgctgcaatacagtagcatgatgtggcaggaggctacataaatatttccacaataagagtgttcaatacaaatgctatccacattgagtttgttctccctctggtcataagatacattctgtattgtttgtaggaagtaaatctgtattcttgttcttaaatgcaatgatagccagtgatcttggttaagcaaaataattgggttgttgcaattacaagaatctttttatattgaaacatgacatataatctgttaagacaattatgtctttgttacagaaatgtctaatgcctgtttttgccatgtctcacagagtaaccaagaatctgctgatccccaatggtggccccagggacttggtggaaagaatgaatggggtaattttttgcctttttcttgtgtcgattcttcttgtatcgaaatatgaatcttttttcttcctattcggcaaagattactatttcttctttatttgggtctgtctcttgaatctcttttgcaattattgttcacatcagttatccaactctagtggtaggctggcatgactttgttctgcaaaacttgaagttttgtagcaagtttatagatgtggcatccaattttttctttatgtacagctcatgtcgttttcttgttttcttcaaagtctagcttgtcttataatttatgttcaaacatatggattgaatgatcactgatgaatttttgtagttaataggaccattcgtaccccaacttgtgtgtgaataataactgcagtagtgtagcatatttgaataggattagatattctcctatcttaattcgttgtgtccacttcaaagtagctctttagtgaaaaaatggtttattcttgtatttcacatactattttctgatgcttcagatcatactggaagaaatgctcctgctggaaaggaaaatacggtcaatccagacattccaattccatggtatctgtactttacattgaaatggatcatcattgtgcggcgttatttttgtttattaaatcttgtttaatttgattcctgtttagtgctagttgtatcaggaagaaattccattgcactgaatcatt

SEQ ID NO: 6907 - DNA, 8836 bp, Oryza sativa
  unsure (1)..(8836): unsure at all n locations
tagttctttcagggacttaccatataattcccagtccatcgccagccccatctccaagaatatttggaactggagcactgccaaacagacctttagttgataatattgtgtttctgcattaccttcctattatgtgttcagttcttgtctgaaaaccatacaactgtgtcaagtgaggatgtgggttcagctacgatgcatttttcttctgcatgtaggacttccaatagattcaataaattgataactgctatgattttaaatatgtttacaccttgttttgtttgaactttgggtggtccgttgtatatatctaactttaataaatttatgctccattttcttccaactcatgtctcaaaggcgttgcatatgtcagacattgacatggttccacttttttggtagcttaatagtggtatgcatctcagcgtatataaataaccattgtgcttctaaaccaccaagctcattaaatcaaagtgttccttgcagttaaactttttcctacattacaactacctattgtcatcaataccacttgcattcagattgttcttaatttctctttggcaactcaactgcagtcatgaggacttgtcagctgttgaagtggtaactgaggagcagttgccacctgctgaaataacagatgttattttacctcaaaaggtacatagctcctcaagcactcctgaagttgcaagatcagatcaactaaaggacgcagcggcttcacaaacccctaaatgttcaattcaagctgtgccatattcaacacctatatcttcaccacaaccactaggccgtcaggtacttgaaatatctgaatctcaggcacaattgcaagatcatcatatacttcagacactagctgatttgcctgtggcttgctacgggattttggaaaataacatttggcattcatttttattttttaaagcctaaaactgttgacctatcaagtcatatttcgccatcagtttttggatgtctactgggctagttaaagcagaggcacacaactctttccatttgaatctcagggagcacaaatgcgtcactaacattattgtggggcccacacaagtgaaaggagtggtggtggtagattcattgccaccaccactaccaacattttaaagtagtatagatctgaatcccagtacattgtagtacttcttaatccattcctactcaaacagtttgatttcattgaaagttgttggcccaaagcaacgaatatcagcccattctaccgtagttgtgacaacacactgaaatgttagcatgcatcattcatgggtagaaagcttttattttcatttaaatgtctgccatgtggatatagctatatattactctaatagcaatggaatttacccctatcttgaaagcttttctttgtttgcatgtgatgtgccatagattgtctgattcttgttggaaaatgcattgtgcaccagactttattgaagttcctaaaataagttttagatactggttttacgtctcgcagaaacattttattagaacttagtgatgaaattatgatatacagttcaaagtttaaattgtttaaacttatcacaaggatttgcaaattaactcaaatgattttctccccttcatttacacccaatcggaaaagatgagtcatgtatttgttagcaatagcatctacttggtaagggcaaacatagaagaacaagaaaaggagaaggtacatcaaaactctagagcaccttatatttaggagagagttaagaaggctcaaatggcctacatgtatatggataggaagtacctcttacaaaggatgaagaccaattgagtaaaaggaatttgttcttttttatttcagataatagcagaagaagaacgggctcaattgttgttcggttcatttggttgctgtgaccttaagtattggccttcttacccgacggtggtctgtaactctgatgtaatggccaagtcagtgcctactgtttccaacaagagggggttttcttcatttgttgacaaacccctctatatttcgaaagcttcatcagagcaccgtgcccaacaaagtgcttttacaaatcgttttctcgaatttctcagagggtcagacttctaactttaattttgtgtagtctatgttaaagactgttgcatttaattcatttttccaacaatgactacaggtttagattggggaataccgaagagccttattacaaaggaacagctgcttctatggtttttcttgatcttccaatgatggacgtaaagtttgatcatatcaagatatttgataatgaacttgcacttatgatatgccatgactttgagaggtatttttctgttctatttcttcttttgtttcaaggatgcttttgccttcttaattggtttgtacattttgttgcagaagtaggctagatctgaactatgcagcaaaatcatttatcatggattttagaagtcagttggaagggatgttcatgaagaagtttgaaagcttcgacaacattatagttcgtatagatggcttaccgaaaattgacaggttcacttaattgatttgtacactattttactttgactttgtgttatacctgtttatgcaactattatgtttgttacatttgcagattaatgtcacttgaggcttttgtgaaattgcctggaaatcattttgttgaaccaagaactttattcgctactgggagttcattaactgttgcaagtggtacaagagttggaagaatcatagcaacaggtgcgcttcaagaaatattgaaggcacatgctagtcgcaacagctggaatggcagttttaaaagaaagaacattttagtaagaaatggttgctattctgaaatctctatgcctttccatgctgagttcagcagggactctatgctcaatgattatatagcatattttgatgaagtgatctccctatttgaattaaaaggagtaggatgtcctgccttttttccttggatgcggaagtccttgttaagattcatgccagctccttctccatccttctgcgatgaattcaggcattttcaatgctttgcaatggcgcaatttgctttgaagcgtcctgtcgttaggattgggttcctttcaaatctttacaggctccggagatgtgcaaatcgacaagttagaaaaactctacttgccattcttaggagcttatcattaagatcagactggagggttattgttctattgcacagccatcccattctggtaaaagtgtacctattcaacaaaaaaaaggataaggaaggaaatggtggtggaaagacaaaggaaggaaatggtgagaattctaaggatcagaaaggtggtgaaaaaacaaatgatgcagattacaagatggcaaagttgacgaagtatgataattcagctaaccatcttgttatttacactcgccacgtgattgaacacgggatggatccagcacaacttgaggtaatacattctatcttttatttgtttttttttcttaacttgaacttgaatcctaacagaacattaaatttcttagagcgatgatgaagtcttggaagatgaaatgtatcaactagacgatgaatcaattgagatgctttcagagctagatttgctgtattcacattacctggagttgaatgacatgttggaagagttgttctacagtggtatgatgacgaaagaactttggcaagtgtaagtattttgttctcctaaaatctatcaatctaatccaaattaaaacataaaggagaactaactgtgagttcttttgtaggttcgaggagatattggatgtacacaacatggtggagcctctgtagtgactagatacacttttaatcactgatgtacgtctttattcatgaatgatgtatgtttttgcttatgaaacaaaatcatgagactcgtgtttatagtgtggtttttcttttgcaacagtggaagatataactgaagatcgacagatgtccgttctggaatccatgccctcagctactagtggcaaagaacctgagtagtcaaacgaacagtaatcggctgaaagtttcctgtagatagtgtttagctggctctggtgtcttgtttagttgtttgtgactggttgtctgtctggttcctggtaagaggcaagaggacatataccaagagcttcgaacttggttcatgatggttttcatctgatttaggcagcttacacattgatggttgtgtccatcagtatattttgtactctctatcccaatttaactatcacctaagcaaagttcttccatcccagtttaatcatcacctaagaaaaatctaaaaagcgtagatactgaagactgttaaccttcatcattttaatccatattggttaaggtgttttgttgtttcgtgtttgtggattgtgtcacgttttaaatatattgcatgatgttgcactaataaaaaatattcttgcttggttgtatgtagcgcatttaacaatgctcatttactcttgcacaaacaaacaaaaacacttgttagatgatagatcattttagatgatcattttaggaagaccataaaagttttaggggatgattaaaagggaatagagggaatattatcaattaacaacaacgagaaccctgatggctgacggtgctgttatccttgtgttgttatccttgtcatggctctaagatgtttagcttttgacttaccctctatatcaatctttacttttctgttgtgaagttcttggattttgagcaaacggtataacatggctgggagcgtatattgcttttgagtagcgtcggttcttgcgctcaatcttctactcctatcccattttaagcacagttgtgaatttatgtgtccaacgtttgaacatccatcttatttaatttttttatgattagtatttttgttgtttttaaattataaaaaataaataatactttatgcttaacttattttttaaattttttaaataaaattttcaaataaaatggatagtaaaatattaaacacggaaaattattactgcactttgaaataggagtatttacttttaggttgcatcggatcgggcacgtgctgaaaaattgggcaccctccccatgcctgctactgttgcgctcaccctaccgttgtgctatgctgttgcactggctttgcatctctggtgttatcttttcagttgataaattgtagtgcagttgataactaaaaaaaaatatagcccttaattgaaagggaacaaaattatagccttaattatagccttaaggcctcaaaattatctacaaatccttctaaccaaaggaagcctcaaaattgtcatgtggtaatgacaaagctggtttggtctcggagcccatatttttttttaccagtagtaaagatgatgcatacaagggagggcgaaataaagcagtggtacgatgttgttgaatacgaatagtaaatatagcgtacatcagaacttaggctgcttcgtccttaaaagaccatggtaactgcttgccaaattatcactactagctccccatttctataaaatggcttcagcttgcagtaaaagttcactagtacacaataaatcgtatcctacaattatctctctaggcgcagataaaccccaagccagtttccatactgcaaacgacaaatgaactcctaaaccgccaccaacaatgttaccagcatcctgaatctcaacaccaactggcttccatctatccatctgtacactgatgctctttcttccaatgtttcttcttctttatatgggcccccacgcctttcacatgcgcctcacttcaactgctgcactttcagtttgtccatgtgccacctctcctgtgcctgaacaacaacaaaagagttcgtcaaaattgcctagaactggaattggttacatttttttttataaagaggaagtacccatactactactatcatctagtagcaggggaaaaaaaacaaaacaaaaatcgatagcaagaactagtcattagctgctagtaggttggttactttgttttgatcaaatatatcttactactctgtcgagcagcagaaccatgctgttttgaacactgacagtctctaaaatatataactttgaccgttaatttcaattcaacgtgtgttaaatcaactatcatggacaagacatatctatacatattatatccaatctaaatattttagaagagattgattataaatttaaatgtttgattagagatggcaccaaaatgacacctttacccctctttttgcactggagggagtgagcaagaccaagctacaaaaaataacctttgtctgaaagggtaactttgagatactgtgttcttcaacggtgcttttggccaggaacaaaggttgaaacgcattttcttgggtgcttatcttcttgcactatgctttgaggcaagcttggcatccaatcaatcaacaagcatttgttctaaatgtgttgttatattcttaatttgtcaaaactcaaccagcatcattaaagaaattgagtgctcaggaattgtgagtatagtcctagacggttttgctgtactttcactcaaagacaaaaaggaatttaaattgagcacagcacaatttgaaattctatttctattggttgccaatcatacagcttagacaatgaaacaagccgtattagtaccccttgtgttcacattgccgtaatcaaatctgagatccagactgcaatatgttcctaactggtggaactagtgaggtatcataaggcccttcttctaaactaaacagcgacaaatacaatgatggcaagcaagtagtgcatttatacatatatcagaagtatataccagcacatagaagttacctgtagtgactttcttcagatatgtggacatctcactggcgatgtaggtgggcataccgaaatagtattttcggacatcaagctcagcaactccttgtatcttcttattccttacatcaacagtaaccacggcctccaatttgtccgtgcttccggctatggaaaagaagtagacatgatcatcatccatgcttatggtggggaataccattgctacgctccgcaatgcagctttgctgtggccacatccactcagcttagacagcagcttcaggtggcttgggtcacggacattgatgctgaggtctttgacattgaggtgacaatcacggcgccagtgctcccatgaagccaccggaattggcatggttcaaatggtggccttccagccacgacggagaacaactgagctggtgtaccttggctttcgccgaacccattcctggtaagattcagttggctggacagtggtgtgggtctctcctgtcccaacgatctccagctctatgtacttgatggagtctctgcaaagactgacggtgacatcacggatgtagttggggtcagtctgcttgaggaggcgatcccagttgccgctcgctggcaggggcaggggcatgtcgcggagcacggggtggtcgtcgagcacgtcgcagaagatgatgccacgccagaggtctacccagccgaccgtaccgcgctcgccgccaatcacgatcgtcttccttgtctcctggtaaaacctgtactccgcagccgctttgggcaaaggcacaagcttgtctctcagctgatcctccagcgtcaagagcttggagacccactcaccctgctgctgcttgccgccatggtagaggtggaggtggaaatccttgtttacggagaggaaagtgccggctaaggcgagggcggcgacggcgtactcgccgtcgccgtggctgacgatggcgacctcggagtcgttaaggcgcatggagcccgccgggggcgggatcaggtggagcaaaggagggtcggccgcgcggtagacgaagtaatcccatgtcccgctgaagaggccggtgaggggatcgaagggnacnacnagaagnaggaggtcggcgtggaagncgatgaccttgggcgtggcgcggagnaagtcgaggcccgggcagtggacgcagaggtgggagaggaacggcgggcgtgcggtgcgnaaggtgaccttgatggggaggcctgtgctggttgtggactcggcggtggtggcgttggggaggtcgccgatgtagcaccatatgtcgatgagaacccagtgcggcggcgggaaggcgccgtcggaatcggcaagtggagggggaatcaacgacgaagacatgaccaaggaggaggggattggatcgcaaatttggggctaagagaagaggaacacactctctctctttttataatatcctttttctttagttgagaggtccagcctaccacagcacgggcccggcccattaaacatcgctccgttcacttcatcttttgtgcaaaattgctaattcgccgagacgagggccgcgcgtgggccttttttttattcggtatttttttttgttttttccttccctttttattggtttttttatgcgtacgggatatatacgtgcaaacacaaacttttcatatgtgtataaaatttttttatacatgatgtatttttcaattttttttgactttttaatacgaactgtcgacgaaatgggaatgggtgtacccatttcaccgtcaaaacaataaagcaccttttaacgagggaactaatagaaggacatggtcgtgggccccaactatagggtttgagaatgcggctcgaggttagccgcggatcgggccagacccgagaccccgatctaagaatggccaaatggctagccaagttaaattttaacaagtataaagaaaaaatgcccttcaatagcctctccatcatgt

SEQ ID NO: 6908 - DNA, 977 bp, Oryza sativa
cgtcagcgccgtccccagccgcgcgcccgctgccgccgccgccttccgcgccgtctccagccgcgcccgccgtcgccgtccgcaccgtcgtcggaagtgctaatgcgaagaggtagagggagaggaaaagggggagaaagatgggggagaagcggtatagaggctgacgcatagatcccgctgtcatagactcaaaatagagaggatggatggagagattgttggagtaaacaaccaatttgacttaacaaatgaaatggagagttggccaaatagacatttggagagttgaatttagagagcatgttggagatgctctaaccaagctccttgccgaagcccgcgcccttcggctggaagggaagagcgctcaacaaggagcgttcctagcgtaggagccgaggaagcgcccggacctaggtacgggctgaacctacccaggcgagtctctctttcccactctcccgctctcgtcagattacgtaacaaaggctaccacggtctcggcatgcccggggcccaggctgactttgccctcggtagggatcgtttctccttctctacgaaggaagtgcatgaaagcttattagggaagtaactcagagatatccgtccggttgtatcttcctcgagaagctcgactagaaatatcctaactaccgccttaaagacgcaaggggcacggtcagctgtaaggcactgcaccccccttatgatgaaaccaaagcttacagaagatttatcccactgacaatggaaagacttcgacaagacttctgcagcgaatcattagggtcggtggtgccccagacacgtgtcgcacatgcccgttgttgacgatcgttatcgatcagtttcgccagtcaatattactaaaataaaggagaactagttatgtttgcaatgcatatttgtgttagaataagttattttccactagcactaggattataaccccttgcagaaaataagtacaa

SEQ ID NO: 6909 - DNA, 10690 bp, Oryza sativa
cttaacccatgaaatcatttcttttttgtttctttcttttccctggtttcttttgtttttttctcccttccatggcattatccggtatggctggttgcgttgtgtaaacaaattcttattcttcaaatataatgacgtgcaatccttttgtgcgttcggaaaaaacccatggaatctaacttattgtattcatagttataattaccatattcaagtcattaccagaggatgaaaggtgctcatcagagaataggaggtacatgaacttccatgtatatccacgttcgtgaattcggcttgactttttttttggtttgttggaaccatgccaccctatatttgtaaaatttgagatatgctacccgtatctcaatgacatgtaggacccacatgagtcaataacatgtgggtcagggtggcatattcacaaattttgtaaattttgtgtggcatggttcaaattgtccccttttttttaaggattacaggtgactaaaatctagcaatatcctctgcactggttactctgggagtagttagtttcacttattattattttttcgaataagagtttcacttattaattaggccccggcatttggtaatgaaactaattattaatcacgcggagttttttgcttcaccgtttaaataattggatgtcgatctcaagaatctgatagagctagcacatgatgatgtatatactacccccgttttttaataaatgacgtcgttgattttttctcacatgtttgactattcatcttatttaaaaaattgacgtaattataatttattttgttatgagttgttttatcactcatattactttaagtgtgatttatatcttatacatctatataaaatctttgaataaaatgaatggtcaaacatgtgataaaaagtcaacggcgtcatctattaaaaaatggagggagtatatcgatgccgacaaggcgagatggatcaggttttccaaatgttcagatttgtgagccccagcaattaatcatgcatatatatgcatttggtttcatacgatacacacgttgtcaaacacatggatgaccctgctccggaacgcaatagcaaaagaaaaaaaaagtctcatttctttctttattaatgctttgaagttgttgcgtattagcctagatatatatgtaattaagttgtcataattttattgtgcacccagatggcaggactaatacgcaacgaaagagaagttgcaggagttaaaggcaacttcttttttgcggggggaaagaaatatattactcactcataaagttctcgcttaataaatgtgagataagattacaactctctcccaaccaaaatccagcaagaaaatcagctctagccgtatttgcaagatgatggctaatgcaattctggctacgacatattttcttaatagaaatcaccctttcacccacaagcagatgcctcacttcatgaatgatgttggctagaacagaaaaatctctaccggtaccctgcagaagctggaccactgaggcacaatctgtttccacctgaatcggaagcaaagtccaatggatcgccagcttaagcccttcaacacaggcacgcagctctgattctagcgggttgttgcatctttcaaggggtttgcaagaagtgaagatgatatcaccagcgctattcctgaggatcattccaagaccccccttaccggagctagcgtcaaaggatccatccacatttaatttcatccagccatcttttggtctctcccagcatggttggtgattgttaagcactcgatatttaggccgttctttcagaggtacagtcctcacgacatgcttttcttttatcaggtcagctagaggagcttgcagtttctggatcagtgaatcgacatagctctgcataaatctctgtgacgtctccgtcggcggggctgacttgccatgtattagctcattcctcacgtaccagttgcgccacagagtcatcaagaacatggcctgttcatattctggaattttttcaaggcaatcaaacagccaaaaccttcctaaaacagaggcctttatatctactgaaacacttcccgatttatgcatacatgaccaaagctggctagcttgaatgcacctgcagagagcatgagcatcgtcttcattttccctgtcgcagatttggcacatatcagattgttccaattttctcttctttttatttaccatggtcgccaggcagttggaggccaccctccaagcaaagattttgaccttttgaggaaccttgcatttccaaatcatctcccatgctttgttaatattatttgtcccagagctagaactttcttttatattcactaactgagctgccaatctgtaagcgcttcgaactgagaacataccgttcttattagggtgccaggcaatgaagtcttcctccgatcttgaagaaatgcagatgttcagtataacctctgcatccaaattatggaaatactgatggattttcggcacatcccaggatccatcttctgtaattaggtcagacacccactttagtctgcagtttgctttcccagtgattggtcttcttgagtgatctcttggcagccatggatcccgccagatccgaattgaatttccattacccactctccaaataatgcccttttttaacaaatctaggccatactcaatgcttctccatgctggggacgagttactcccaaaggaagtgtcaatcagggaaccatgggggaaatattttgctttaagaactctagcacacaggctatctgggtatgttatcaacctccatgcttgccgggccagaagtgcctggttgaaaagccgatagtctctgaaaccaaggccacccaagctttttggtttcgttaacgaatcccaggctttccaatgcatttttctctggccgttcatggaatcccaccaaaagttatttgttagtttcgttagatcatcaataacagattcaggtaatttaaaaatccccatcacatatactgggatggcttgaatcacagccttgatcaacacttcttttccacccgtggagagatggttctcaccccattggatcactcttttccaaatcttagcttgcagactctgaaaacgtcctttgtgcatccgtccctccggggtaggaaatcccagatatctatcttcaaacctgtctctttccacttgtaaaatttctgatatagcctcactgacagccggggtcgaggctcctcccatgaggatagaacatttggctgggttaattaattgtccagtgcccatggcataggatgagagcacttcttttaccacttccgcctctctttggtgtgctttaaagaataagagggtatcatcagcaaagagtaagtgggaaattccaggggcagctctgcagactttaaaaggggtcaaagaattctgggccaccttttccttcagcagcaatgacagtccatctgccacgaacaaaaataggaagggcgagagaggatctccttgccttaaacctctagttggagcgaatgattgaagtagggttccattgaattttaccatgtatctcaccgaggtaacacacttcataatccagttaacccatcggcgagcaaaacccaacttattcattgccatctccaagaaacgccaatccaccctgtcgtaggcttttgatagatccagtttatatgcacaagctgcgtggtttgccttcttgttcttttgcatagcatggaaacattcaaaggctaagagagcgttgtcagttatcattcttccctgcacaaaggcactttgttccacagaaacaagatcatctaggatcggtctcaatctgttaaccaggcatttggataccactttgtagacaacattacataagcttatcggccgaaagtctcgcaaatctactggttgttccttcttagggataagaacaatggccgtatcattgaccccttcaggcatcagtccagtttggaagaaacggcgaactgcaccgattatatcagctttaattgtgccccagttgcgctgatagaacctggctggaaagccatctggaccaggtgatttcaggggcccaatttggaaaattgcctgagaaatttcatcctccgtaaaatcctcacaaagcttctcattcatgatatccgtaaccttttcctggataagacgagtaacggtttcaggattaagatttggatcagcagtgtacacatcctgaaaatattcagttgccatgctctccaacttattgtcgaactgtgaacagttccatttgcatcccgtagtttggagattttattcttctttgctctccatactgcctggctatgaaaaaatttcgtatttcgatccccatcctttagccaattaactctggaccgctgcagccacagcatttcctctctgtacaacagctcgttcatatggtctgtcgcattgcgaattaccgttctgtcggcgtttgattctataagttccgccaattttttccgagccttctccagttctcttcctacatttttcactttggctctgctccaagatcgcagcgctgtcatgacctttgccagggctttgttgatgtcttcgagatcagccttttctcccgcaactacccaggcttcctcaattacctgggtagcttctggttccctctcccacacaatctcataatggaggcatttctgacgaagttggtggggatctttcactaccaggttcagcaaaattgggcagtgatcagaacatggggagacaagatgcacaacctgagcggtagagtatatatctctccatttatcatctgccactattcgatcaagcctaactttaacattcctccatccctccctcttattatcataagtgtgtgatacacctttaaatcccagatcatgtaattcacaatcttgcaggacatcacggaaatcctgcatttggggttcaccccgtggggttcttgagaagtgttcaaactgccacatagtttcattaaaatcaccaatgacggcccagggcaaggacgaagattggtggattgttctcagcaacgaccacattcgatgtctattctcaacacggggttcaccatacacaaaagtaacatgccactgtggttcctctggggacaattgcacatacgcatcaatatatcttttattaatatctttgacatcgactaaaacagactcatcccaatacaaggcaagaccaccactcataccttcactgctaacaccagtaaaacccctaagacccagtctccctcttaagcgactcatcttctccacactttgtctagtttcacatagaaaaaccagtcgggaactcgcctcctttgataaggcacacagatctcgaactgacgcagggttccccatcccacggcagttccaggctaggcaactcatttctcctggcgagaccctctcataggtcccgccagtttaccagcagcccctgggctggttgcttccatgtcttccacgccaatgtttgcctccactcccttcttgagcctcttcattgcccgtgttgagcttgccgtttcctccgctcctctctggccatactccaaaacagcctgctggacaatgcctgagctctttgttgtcggcaaagctttcctctttgttgggcttccaaattcttcagtagagccatctccaaaggaaacttgctgtacattcaggtctctaattgctgggatcatctccattgaaggtattgagctggtttccttactaaccaaatccttgcccttcttctgtccaaggcttgacacctccgagacgtgcagcatatttgtctggtcagcaagttgactatctattgagtcttcaccttttccttctctaatatcaaaaccatcaaaagcatccacccttgtgggttgatcttcatatctcttagcatcctgtctaatacccgctgacgaagaactcacacttcctgggcccctgaaagacaattttctctgaacaccttgagaatgaactgcttttactttacccacttttctctcaaagggttttaagggcgaacaacggagttcagcagaaaatactaaaggctcattctcatttgtcagtctcttttcgcattctttatctgagtgtccgataaacccacagaagaaacaaaagtgtgggactctttcatatcgaaggtgaaatctgcgagtctcctctttgccttgcacctttatcttaatagctagcattcttcttagggggcgattgactgggagatccacccgtatacggaagaaatcatgcttattgcatccatcctcctggacatccacttcgcgaactttgcccatcttactgccatagagttcacctcttgctctgttcatcataactaggggaaggtcatagatcctgacccaaatagggactgtatccaagttcaccatggaagggtttaacaagccattaaactccgccaccaataaagcatctcctctgtgcaaccatggacctccttgcagcacgaaattatagtccccttctgcattaaaagacacaatgaagaggttatcctttagggacttgtaactcatctccgcccgcaaacgccatgctcttctcatatcctcaaacagagccgactgattaggaaacttgagcgagtagaacctcgctaggatcgtccattgaccggccttctgaacttcgttctcttcgatttcaatttcaaccgcatcctcctcctcatcgacaacctctccttcagtgaaaactgtagggccttgactgctcaggttattacttgccaacccaccatcatgatttccagacgatggcagcactcttgaacctgttgcctgatcatgtatcccatccacgctttgattcagaactagtacagcttggagttcagattccaacctgctccctgggggcaacgacgacgcaccggaaggcttcgggtgggcaactatcgcattgatagtcccttgatcacccccaccctcggcagccgccatgaccttaagcacaagggctagatgaccgaaccctagattgaaacctgcactagatatctgtgacccgagagatatttttgattttatcccttccttgtacctgaatttataccccagcagctccgagtccttttctttcacggttgatcgccaaaacagatccacatcaatgatatctttggtgtgacccctgtagaacttgccgtaccagaatttgacaacaggcgtaattctaccaaacttcatatccgccctcctcctcggattaggattccattgtcccatgataagcctccatcctgcccgatgtcgaaaagcattaggccagatccaaccagaaccagcacgattaacctgatcaccaacccaattacagatcgcagacgtgacctccgcagactttctgagcagatcggagagaacctccatccagatcctcctttcatgggaggagaaggctgccgcaacccagtcgcctgggtgccgcccagaccctaactcacgccaaaacatgtttgtacaagttaaaggcaacttgaaaacaatataggagtatatgaccaccaatcaaacttaaatcactgaaatatcgcttacctttcatacattcatcagttgtctggataagagtggataaaaagaaaacctaataaatgttaatgtgatgaatttgatgacaatgaccccgagttattttttcaaaacacggaagatgctcacatacattgatgcacatacacgcgcaccacctataaccataccggagagactgtcatttctcaatattgacaaatttattaccacagatagcaacaataaaatttaaaaaataattaatcgtaaatacgagcacgtgcatcagatataaaacttaataaaaacttagattgatagagttacagttttttttaaccccgcagtgtatacttgtattaaaggagaggaagccactgtatagtagccttgaggctaagagttaccgttctagtcaggggcggatccagcgtggggcggcggggtctcgagcctccactactactgatgtaaagactatgagagcccccacaaagaccccactaaaattttttaccatatataactttatctaggtttggtttagacctcattgcctatttctttattgatcccgccactgattctagttcatgacaccataagttattcgatgttgatccggccactgattctagttcatgacagcataagttatggatcacatcgataaaaacatatgccggtttagttctcaaccactgtactaattctttagctggtttcaaacaaaataggacaagcatataaagatgcgatggaatttgaaaacatagattgccaagtgccatatctctactgttttgccagtttgtccacgagccaaaagaaggctccaatgagaattcccccgtacatgccggggtggcgccacatgacaatgactgacaggctggccccacgtcctacctggctggccccacccctgctctttctctttctcttcttccctttcgtcttcgtcttcgtcgtcgtcgactcgtcgtggccgccggcaactcacgcccaccgcgcgcgcgcgcgaattaatacaaacacattaacacacacagagagagaaaattggcgcgcctcgcgctgtgcgccttcgaattttggaggcgacgcgcgggaggacggaatcggccggggattcgctgcgtcgccgcgcgagagcgagaggaggaggaggaggaggaagccgggatgggggtgtcggacaacacggtggggctttcgctggcggtggcgtccagcgccttcatcggcgccagcttcatcctcaagaagatcggactcatccgcgccggcaagggcggcgtccgcgcaggtcatctctctctttgctttgctgcctcattctcaggtcaaccgttgtttgcttcttgggattggtcgccgcctagctcaattggtcgcacggcatctcgcttagtttgacgacgcccgcatctcaatcccttctctggggaataatcgaacactttggtggatcttgattcgtatgcagcaacacctggaattatggattacgcagagcatttttgcaattggatcccatcctgtcctgatgattagggtggtttttttgtttgacaaatcgttgcttacctgcgccgccgcgattgggtggcggctgctgttgctccgcttctagatcttgacgaggctgcggttggttagtccaagtcgtaagcctgctcgtgcgtgcaaatcagcatcgcggtcgtcgccattgtcgctgtcttctagatgcaaacggaaactcttgctgtttcgtcttggaagaccttgtcaattcaaatgcttttgggtcggatctctaaaatttgaacccagatatcttgactttcagatgccgtgctccctatttatccccctgcgttcaattaccatggttggcattttggcaatgtaaaagcaaatgtttttttttactgtttcatctccgttgccaatctaaacatggattctttttctttttctttttttttacttactctgatgactctttgtgggtaattgccctcccatttcatcttacctgcttcttttctaacacattacaggtggtggaggatacacttatcttttggaacctctatggtgggctggaatgatgacaagtatgctcactctacacagcatttacagttagcttaattaaacttgacaatgcagctgaatgtcatctctgttgattgcacaagtgttgcttggggagatagcaaacttcgttgcttatacctttgcaccagccgtacttgtgactccccttggggcactaagcataatcgtaaggtgatttttttcaaaccaaagccttaagttcagtagtcagcactatctttgattctcctatatatggttgacatacattttgttttttttctccaatttggacagttcatttttagcacatttcgtgctgaaggaacggcttgagaagctaggtgttcttggttgtgtatcatgcattgtcggttcagttattgttgttatacatgctcctcaagaacatatgcctaattctgtagaggaaatctggaacttagccattcaaccaggttagtcactgacacacatttctgcaacactgtataggtcacagctatataactaacatgctttctctgaacatattgtggtttcaacacctccaggatttctaacatatgcggtagcaaccttagtagtcgtggcagcactagttctcttctttgaacctcgatatggtcagacaaatatcatgatatatctgggcatctgctcttctatgggatcactaacagtaagtgtgttttgctattggatgcacaatctagtggtaggcatatgtggttaacgaaccattggtattctgtaggtcgttagcatcaaagccattggtgttgctataaagcttacgctggatggaatgaaccaggttgcttatccacacacatggctttttgttatcattgcaatcatctgtgtggtttctcagataaattacctcaataaggtaacacattttcctggctaccaattacttggtgcaagtatgttttgctcgattgcttcctcatgatctatttttcagtttttgaaaatctttgaaaaataaatttgtttt

SEQ ID NO: 6910 - DNA, 401 bp, Oryza sativa
gaaagaacaaactttttttttctgatccatgtgttgaatgaacaaaccttttctgtttaaccatgacaaggaacaaactttatatctggaccatgacaaagaacaaacttttaatgtgcttaaaataaataatggttctaactataactaatataattgaaatgatctgatacgattatacgaagtgtcattgaaaaattgtaaactttacgtagaggcaataatagagggggcccctgcatggagatgcagccacgttccatccactggaactgcactagtactgtactgcagcttgtgctttcctctgagcacaatccttgttgccttgtgcacggtcaactggggagaggacaaatgttacctttgggccaaagtgtgaacttttttttttctgcaga

SEQ ID NO: 6911 - DNA, 363 bp, Oryza sativa
cacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatg

SEQ ID NO: 6912 - DNA, 11023 bp, Oryza sativa
  unsure (1)..(11023): unsure at all n locations
tctgacgataaacgccacttctgatctccccttactgaccgaggaaataagcttcactgctacagaacaatctacctccacaacgatgggtagcagagtccattgaagagccatattaatcccttctttgcaagctagaagctccgcctcaaaaggaccactgcaatgatcaagaaaaccgcaggcagagaaaattacttctccttggctattcctcagcactgcaccaatacaccccttaccggagctggcatcaaacgacccatctacgttgagcttcatccatccctgatttggtttctcccatctcagaatcgctggggttgaagcagatggatccttcattttcggcattctgctatactggacgatatgcttccctttaattaaatntatcgattggcactgtctaacttncagtaaggacgagatataactntcaaggaatctcttagacactccaacagggggaggattttaccatgtgtgatctcgttacgaacataccaaatacgccacaacaccatcaggaacatagcatgttcttcccgcggaactatcttcaactgatctagtatccagtctgctcctgtacagtttccgacaatgcctttggttccttccctactacttgcatagcatcccacagcttttttgcttgcggacatcgacagagagcatgtgcaacgtcctctgcctccaccccgcagataccgcaggtgccagaagcttcaagcttcctcttattcttgttttccatagttgcaaggctattggttgcagctctccaggtgaaaaccttgactttttgcggtacattgcatttccaaaccaaattccatgccttggatatttcagcttcagaggaccccgacccattgtcaatagctgctagctgaagagcgagtttgtaagccgatctcaccgagaaaatacccaacttatccggatgccaggctaagaagtcttcctctgctcttgccgagggtcggattgtcaagatcaactcagcatccactggccagaagatcctcttaaccacctgttcatcccatgtaccatccactcccattaaatctgcaacccatttggttctacaattacctctcacagcaataggtcttcgcgagtgattcctcggcagccacggatcacgccagattctgattgagtgaccattacccaccctccatataacgcctttctttagcaactcaagaccatactctattgctcgccatctgggtgaagcatttcccccaaaggcagttgtcaattaaggaaccagaagggtagtatttagccctcaacacccgagcacagagactttccggcctgtcaatcagccgccatgcttgtctagccaagagagcttggttaaacaatctaaagtctctaaaacccagaccaccgttttgcttaggttttaccagctggtcctaggatcgccaatatgttttcctcttgcctctatcagcaccccaccagaaactacgagaaattttattaagatcctcacaaacagaattagaaagcttaaacaagcccataacatacaccggtatggcttggatgactgcttttagcataatttcctttcccccacttgataggaaattctctccccacatgatgattcttttccaaatcttctcttgtaaactttggaatttacctttactcattctttcctctggcgttggaaaacccagatatttatcctcaaagcttttattcccaagctgtaagcaattcctgatcgcagtttgggtatctgctgggcaagactcaccaaacagtatagagcacttcagtgggttaattaactgcccagtccctgcagcatattggccaagaactgacttgattgtctctgcctgctcgacttctgctttgaagaataaaagcatgtcatcagcgaataacagatgtgatatccctggtgcagatcagcacactttaaccggagttaaattcccctgatttaccttctcatccagcaataacaagagcccatccgcaacaaacaaaaacagaaaaagcgataacggatcttcctgacgtaagccacgagttggagcgaatgtatcgaggagggttccattgaatttaacaacgaatctcaccgttgttatacacttcataatccacttaacccatcagtgagcgaaacccaccttgtacatggcttgctccaaaaagacccagtccacactatcataagccttcaagagatcaagcttataagcgcaagctgccttgttctggtgtttgttcttctggataaagtgaaaacactcgaaagcaaggagtgcgttatccgttatcagtcttcctggcacgaaggcactttgattaaccgagatcaactcatccaaaatcgaccgaagtctgtttaccaagcatttagagacgattttatatagaacgttgcataagctgatagggcgaaagtctttcagctccacaggctgatcaatttttgggatcaacacaatagcagtttcatttgccccttctggcatgattcctgaatgaaaaaattccttcactgccgccaccacatcagacttgatagtagcccagttcctttggtagaatctcactgggaatccgtcaggcccaggggccttcaatgggccaatctggaagagggcatcggctatctcttcatctgtaaattccttgcataagttctcattcatcgctgcagtaaccttcttctgaaacaactgggacacacttgcctgatcgagatttgggtctgctttgtaaatctccttgaagtaatcagtagccaacttttccatagttgttgccgtattatgaatagtaccatcactagccctgagcctagagatcctattcttttttgccctccacaccgctttactatgaaagaactttgtgttgcgatccccctctttcaaccaactaatccttgatctttgcagccaaagcatctcctctctatacaacagttcattcatgcggtctaaggcctgacggatctctctactgtcagcatttcattccattaacattgccagatgtttccttgccttttctagctctctaccaatgttcttaaacttcaccttactccaagactgaagagcccccataacccttttcaaagctttgctaatatcccccagatgcaacatctcatctgactctactcaagcatccttaactatgtcctggactgctggttcacgttcccaacatatctcatagtgcaggcatttagcacggcactgtctatcactcccggttgtaaacttaactaggatgggagaatgatcagaacatggcgaagtcagatggaccacctgtgcattggtaaaaatatccctccaactttcatctgccaaagctctatccagccgaacctttacattggctgaaccttgtcgcttattatcatacgtatgaggtacccctgaaaaacccaagtctaccagctgacaagtctgtaacacatctctaaacgcctgcatttgggcattactccttttcctaacagaagtatgctcaaattgccatagagcttcattaaaatcccctacgacaagccacggcagagaggaagtctgtttaagagcatttagatgagcctacatcctgcatcgattttccactcgtggttcaccgtacacaaaagtcacatgccacaaaggaccatccgaggacagacgcacatacgcatcaataaatctttcattaatagaaattatttccatgtggatagattcatgccaaaacaaagcaagacccccgctcatcccctcatagttaacccccacaaaacccttgaggcccaatcttgatcgcagacgtttaactctatcgaccttttgtcttgtctcactgagaaacacgatatgggaacccgcctccttaaccaaggcgcaaaggtcatgaactgacgcagcgttcccgataccgcgacagttccaagccatgcaattcattgctcctgacgggacccgaccatcggtcccgtcagttgaccagcggccccagggctggttgcctccttctccttcccggttactaccccttcagtcttcctggctctcttcagtgcccgtgaagaaacgcccgattcaaacacagatttgctgctttcttccaccatttgttgatattccagcagagcttgcatgactctccctgacttctttgttgcaccctgtgtttgaggttccctcctgtcctctccactgcaatcttcagacaattcatcaccgtaggaagcttgctgacttatagtcttaatagccggtatcatctcacaagaaggtaatgaagttgtatcttccacaccatccaaccgaatctcaggtccacgtttatggcttgctccctctcttcctgggagagaaaccttctgtacttctgtctcccccaccttcattttctctgcatagcccgccaactgttcatcaatctgtgtgtccccttccttctttgcagactcaaaaccatcatgagcgtccactcttggtggaaccaagtcctccccctgatctccttgtttctgtcgtgaggacaatgaacttgcactccctgcccccctgaagaacaggttacgcaccacccctgaagatgatggtactttcaccttactcaccttcctctcaaagggttttagaggggagcatcttaactctgccgaaaacttgaagggctggtcattgttgactcctttcctattgcactccttgtcagagtgtcccagatatccacatatgaaacaaaaatgcggcaccctttcataccaaagatcaaaacgctttgtgacctctttgccctgtgctaacatctttatagccaacttcgactttaacggacgcttgacagataagtccacacgaatcctaaagaaatcatgtttgttccgcccatcgtcacccacatccacctcccgaacttgtcccaatttgctgccgtataattcacctcttgctttcatcatcagtactaaaggtaggtcatagattctaacccaaatagggactgtctccagtggaacttcagatggcctcgacagaccatcaaacctagcaaccaatagagcatcacctctatgtatccatggaccacctttcaagacaaactcataatctccttcagcactgaaagttatgatgaacatattatcccataaggatttataactcatgtcagcccgcaatctccatgctctcctcatatcatcaaacaaagccgcctgatttggcacccgcagagagtagaatctagcaaggattgtccactgtcctgcctcctgtacttccccttcttcaagaatcacttcaactacatcttcctcctcctcattcatctctccttcagtaaacttctctggcctcaaagtattatctcctgagcccgtgtccatcttcaaagcctgtgacgaaacctgctcctcatggccgtcctccacaggaaacaatgcccttgaatccggtgccgcactcatcggaccagccatggtgctatctgccggcttcgggtgggcaatcgtttcaccaacgatccctaaatcacccccaccggcgacaatagacatgggtcctttcagttgcggagagaggaatagccctaatttgcatattagattggcaaggaccttttgatctttgaatcttacctttggccgtcctatttcctcatatatgtagtgattctcaacagagtccataatctgcatcattaccaccccaggaaaccgactcggatcacacttcctcaattccaatcattcccaaagatgaaagattgcagatacttcccaaaacaaccgagaaatcaactgaccatccaacttgatcaagaactcaccacatattccgtacgcaggcagaaaccctgcagacctccttagcagatcggagataaactccatccaaatccatctcacagcacaggagatagccgccgccccgcgatcgcctgggcgtcgcccaaaccctagctccgtcatttccggcaatcacatttactataaaagctcttgtttgaccatgttaacttgtaaaattaagttaatcgtgctatctaattaaaaatggtctcatcaatggcatgcagaatcgcagaataatcgtggaaggatataaaaggagggggcatcatggccacgtcggtttgtcgtcggagaccggagctgacttgtacatataccggctggactagtcaatccaatgactctgaccaatcgacgatggatattgggatgggatcggcatcggacggcccggatcacgcggcacaagggctagtccttttcacatgcactaattaatcatctgtagtacagtattactcctgcttcttaatcaatttcacactctaattgacacgcacgcacatggccatcgttgatcatcgatgctatgaaaagaatatactccctccatcatccataaaagttagaaatatctcactttgagtttttctaaataagttattattatttatagtctttatacattcaagacttaaatgaaaaaataaattaaatgtttgattagtatctaagaagtcatctaaatactcattggttgcatgcttgcattcacttcttaattttgtaacatctaaaatgatttaatttcttcttgttcttggtgacaaaaataataggtgtaacttttgtgaatggagggagtataatcgacatggatgcaatgatgtatgcatgagatggtgataaatatgatgatgccaacacatccacaagactccactaattagaccgcttgaccagcgctgatttgcataaaaccagcacagataacgtccacccaccaccgtacttctgaatataagatatcctatatatcaatatttgttatattagaatatgtcacatactattacaaagttgattttttagacggagggagtgcgtgtctcacaagtcacaagtacaactccataaagaaaaaaccaatcttatctatatgtgttcaaggattgacactaataataccccatcagtgtcggcagtattaatcggcattgattaatgaggagactatcagtgttggtcttactgtatccacgatactttagacgggaaacctatttttggtacggccctaaagtgattagagagactagtgttgattttacagtgtccataatactttagatgggaaatctatcttgatacaacatgtttagttgtgtttaatagttttagcatgcaataatatgtgtcgtctttgctggttaataatcttaaccgggactaaaaagacctctgcaacacctacctagctataaggctcctcccatgagttatcatatcattgctaaaattctagtgtcgattgggaacccgacaatgagagcaagtttaatagtatagccaaatactagctccaattcatttatagccaatctaatagctcattcatacaatagtacactattaatatctggtcccatctgtcatacacacagcgtcttggagtctgtgctacagtctatagcccgctgctcttctctctcctcatttatctacttaaaatatgtttacagctggctttatagcctgctattatacctgctctggtagccctttgtagataatagtgcaacagtaaacacatgaatttcgtatttgtatacaccaatgggagaattgcaacagtatagtacatacaaacaactactacatgcaaggaatatttctccttttccttttcaaaatatcgagatcagtctaccagctgtgtatgaccactacatatggggaaaaaaataaaccgaaaagaaacaacctctgcagtgtgcaatgttgaattctacgacgatgctgctgccagagtgtggttgtcgttgggatgtgacacgacaatttatatttgcaagctagcagctggatgtacgagtagtcaacacattattacggttgcaatccttgaccggattaaataaacagacttaacttaacttcttgagatgattcacctaatgacctaattaagaacatcgtccctgtgcccacctagacctagctagttataatctctgttcgtttaaacttccgtttccgtgcgactaatgacactgaccgagctggttcaaatatatattcacttgtcatgatcgatttctaatatgtgctgaataatataatggcttctaaggcaatgtttctttcagcttgagattattataatccagattattgggagtaagctgaaagaaacatacaacttattaaagtagcttattataatctggagcacagcttattataatctaataagctcatttaggtgagctttttccagattattgggtgaaaaattacccaccatgccacccactccctctttagacttgcaaacccaataatttaggctctaataatgtaggaaagaaacaattaaccgcttattctactacagattataacaatctagcttatagtaatctgactcagtaatctagattataataatcctaagctgaaataaacagagcctaatactggttggtaagcacaaacgctttgattgcaattagttactcctatacgtgcttaccagctacttcatccgtatcaatttactgttctactccctctgtcatatgatatagcaaccaataactgaatggaacgcctccctccgtcttataatatagcgtagtcacatccggttttaggttgttgtattttgggacggagggtataataaatttcacactaaattaagaacaaaaatcataataaaaagaacatgacatactactctgcagtatatactctcttcggcataaagaaaaaaaaggtaaggatttaaaaatttctatagctttcattaatatggggagaaaaatttatgaggaagagtaaaccagaagaatgagagagtactgttgggttgatggttaaaataatacttcctccgtttcacaatgtgagtcattttagtatttttcacattatatatatttatatagatttattaacatcaagatgatttctaaaaaaaacattaagatgaatatggaaaatgctaaaatgacttacattgtgaaacagggaaagtaataacaatgataatatcatagtattaatgagattttagaaagctaaaccgatagtatatactttacgcatctgacaagcatatgcagtcctatttatagtaggagaacaatgacttttgtttgtgatcaaaggacacgtgcggtttttccattgacggtacctgcattaaggtcaaaattaagcgtgtttcggttttgaagaagccaaatccaattttcaactatgcacacataactaccatttcgttcggagactaaacccagcaatttagcatacgtggtctaatcctaccatcgacaataataatataaattaataataacagaggaaaaacattcagcaacagtattactcacagcaagactttttaatcttgctgtatctgtaacagtacacccttcatccaaaaaaaaaataatttcaacaacaaatctaaatatagactatgtgtagatttataataaaaaaattgattcttttaattttgaatggaaggagtatgcagtagtagtaaaaatatctcctagagaatttttattctatgagaacaaattatatattaagctcttttttttgccctatgaacacacgcacgcaaaccctacccctatgagcatcttcaaagactgggcccgactgggccggcaaattctggagagattgacgaagtaaccctaccccctatgagcatcttcaaagactaggctggactgggccggcaaattctggagagattgacgaagttaccacaggcgcctagctgttgacgggtacgtcgcctaccactgaaagcacaacgccgataaatcctggaaaattcgctcccatggggagtcgaacccaggaccttaggtgctactgaggctcttgtaaccactaggctacaggccgatattaagcttttgaaacaaaaaaattggttactattaatattttgaagtttctaaatgatggtcaagaaattaatcgacttaatttaccctattcattttcatattacaagttgttttgatttttctaatcaagtttgtaaaaaaaaagtaacatctaaaacatcatattaacttcatcaaatctaacattaaatatacattttgataatatgtctatgtttattttaattaaaaatattactatatttttaaaattttggttaaatccaaagaagttcaacatcaacttataatataaaacaaaaacagtagtagtaagtagatactttctccttaaaaaaaatccaacctaagataggatatgatatatcctattacaacgaatttgatattttaggttagacttttttttactgaaggagtaaatctgatatatgaccattttggattgatgccaaaatgtgccctgccaatttattggtaccttcaatagtaatagtataggtttggattgaagccaaattgtttggctattcctatgatcaatttggcactaatctagagtcttcttctctgtatcatcaacatttggcaacatattagtagcaatccaaacatgtataataaatctctaccttacaaaaaaaaattggtaataccaaaacatgccaagaatttggtagatactctctccgtctcataaaaacgaatctaggaccggatgtgacatattctagtactacgaatctggatatgatatgttacatccggtactaggttggttttttatgggacggaggaagtaaggtagagaacaaaagagccccataatttttagcgcagtggtaaactggggagtggattttcacccctcgaggggatatcctcttgttgtttgcacatcactcaaatggttatgaaaaaatttgaaagaaattgagaagatgtattaacatgtgatatatcactccacaaacatgcaacttctacatctcgcaaaaaaaaataaattcgtttgttttttcgttgcgagatgtagaagttaaat

SEQ ID NO: 6913 - DNA, 32273 bp, Oryza sativa
attttttccataacaaagatacatgtaaacaacgagatgatgaaaatagtttctccggtaaactgtggtggagaagtggagaaccgaataggccttgcaaagagagagggggaggcgcctggcgtacgtgagcgtggcgtgggcgcgggagagagaacaagtcaaaggatgcgaacgcaacaagacgagcaccagcagcatggtcaggacgacacaacacaactagtctcctcgactactcgtctctcggtcttccttccctccccctcttcctcctcttgctcttcccttccaattccaatcccgcgcgccgatccgatccattcccaccaccaccaccgtcgtctccctcactccaacctccgccacctgcgaaacctaagcttgctgctccgccgacgaggctgatacgtgctgagatactactagtagcacctgtacgtctaagctagagctatggggtgcgtgtgctccaggcggtttcgggacgacgccgcgccgcgctcggtgcagccgctcgccgccgcctacgaggcgcgccggggtcgctacggccctggcgacttcgactccggcgagctcgccatcccgccgcccaagctactcacctcccacaaggtactctactactactaccaccgtaattttctatgcatcatgtgctgcatgtgttggaattttcgagctccatcgatccatcgagatgtgcttcagctcaactctccgccctgcttgcctgcaacttccatcggacagctgcatgtgctgctctctacttcgcgatttgtttctgcttagttaggtagccagccggtgagaattctccacgacttgatgcaccaaacacgcgttgccgcaaacggagcgctttgtttgggttcgaaatctcaatccgccttccacgtccaattcctcaaaatcacaagttgggggtattattgatttgatgttattttttgctgcgtttcttctctcgccgccgtgttcagaaattcagagaagccgtcaaactgagcatcactgtgaagctttaattgagctgcctttcgctgtcaaggcttccatggggacttcatctgaagctgctctctcgtatttcagtctccgctttgattaactcaaatcaaactagattggcagtggtctgaggatgcagaatttcacaaaccgtggggaatctgcactgcatctttgcatgaattctttaagcggatcaggggaaagagagggacacaccaatacatacagcaagtgaaaaccaacagcttacacacacaaaaattcatcaagtccgtgtaggatgcagcagagtcaatcttggcggcccttggtttatcatattgtaagcactattgtcctataggaggaggattccgtccttttgctcagataagtgaagaactgccgtgcttatttaacgttcacgttgctgtcagcctgagtctacttcttggactggtcaagccagcgacccaaccatgagcttctgcttttgttccttcctgctgaccacttttccatgccaaccatggagtttgggaaattacatccttcacttttcttcttgcaaagacatgagtgatctgcttagcttctacttggaagaaaacactaaatgtgcaggagctaataagtgagacaaagtacagactgtataactggaaagaagctgactttgtttatgtactctcagcatgttactagtgttataattcaggcacccagtgattcggcagtcatcctggagatggaaaaagatatagacagatggttactaaagtatcgggttaagaaatacaccaatgcgcagcctactttgatctggccaatgcgcatcaggggtgatcgtctatatatcatcagaaaaatgaaaggaggccatctcccccaaagtgaaaggactacggaatagccttagaggagtgacctccccattttgtttcatttcacccgtttcattcattgagtctatgttttcatcgaaaagcttgcacttcaaattggcttgtttcataattttgcaataagattgacaggaaaagcactgctagttcaaataaatataccttctttcttaggttctttgttacgacgaaacatctgatattattcttcttagaggggataatacgtttctctcgctcttccttttgctttgtttgtgctataactagttgtctttctattggaaattgaaggcagcaaaagcggagactatatcattagaagataagagtagtcttttcctttcatattaactctgacatactaagttgtgacaggtaccagaaacaggtacacttttaggaagagccagcattgctgctgtcgaggtgttagataccctcgggagtagcatgacaaatttaaatcatggcagtggatttctctctgggggaacaaatcgaggcaatagagtctgtattttagcatttgaagtcgcaaacacaatagctaaagcttccaatttgtggagatcttgctccgacacgagtataaaggaattgaaggaagaaatattgcgttcagatggagtgcaaatattggtctcctcaaattccagtgaactattgtatattgcttatgttgacaaaaggtatgattggttcaagaaggaagttgtcctatcgttcctttttttttttgttgttaatgcgattggctgacatggatttgatggaattctacagggatgaacttgacatcttttcaagagaagtaattcgatttggtaacctgtgtaaagacccaacatggcataacttaggacgctatttcaacaagtaagaatctgagaagtatgcttttcatttaagatgctatttacaatcatatcagcacttcctgtacttaacactatgctgttgctgtgaattctgatgtgcagattaacgacagattttgcgcctcaggatcattcaaaagagcatatggaaactactatccagcaattgatcaatttggctcaaaatacttctgtatgtatcacttgataatttctgtattttgccgtatgtaattgataatacttataatttttatggagtcaagatgtaggattcattaatttattattattattctcccttcaaattattgaacggttaaactgctgtaggaatcaggattcaagaatttttcattaggccttaatatcttatcatgaaggactaagtctcgttgcataacatagaaccacagttttgaggtgctggttcgaaggatatgctgatgggcttgttttgtaattgcaggaactctatcatgaattgcatgcgctggacaggtttgagcaggattttcaaagaaaatttcatgaagaagagtcagtgccagcagccagacgtggtacagttatactgatgtcatttttaagaaaatatattgttgatagatgctagaatttaagcaagagggttttccattagctcaccttaattagtgacgtgctgtagattgctctttaaaatacttaaaatggacagacgtatcatgtaacctattcggtcacgaagtggttttccttgggtgtcttcttttttatgtttgcttctttcacacaatgttgttcaaagtatagaaaatggtgatgcttattggtttcaatcttcttgttcttggcagagagtgttatgatcttgcatagtgaactaaagcgccagagaaagcttgtgaaaactctcaagaagaagtctttggggtctcgaactttagagaccgtatttcttaagccacattttgctctgttgcttgattacttcataccaccagattgcatttattggaatatggcccattgtctaacaatcgcaaattgatgaatactctgctcataatatccacacatttttattttgaagaatgcttacactgaattctgtcattggctatccagattgtggagaagcttgttgatattgtcgtatttttacataagcaaattcgggattcattcagtgaagctggtaggtgatactcaactggatggtttgcagtagcttaaaatttgtgcgacgatatgctaacacctctctaattaaaaaagtttctgtaggtgctgaccttttcaattcagagcaagctcaaaacaaaagactaggttcctgcggtctagccttacattatgcgaacataatcaatcaaattgaaaatattgtaagttgttttgacttttgatgatccatacccatgtttttcatcccttctggatgtaccactttcaccgtctacacgtttgctatatctgatcttaagactcagtgctctcataatctactgtgtctgctggatatgccccacttccatagctcacatgcttgctatatataatcttaatattcagcatttgcataaagttttgattatgttgatgaatcattcatttattcattttccttaagttaactacaacagtcagttgtaatgaatattttatgtttggtcagtataaagtatctattagtttcttagctactgagtactagttccaacaccatagtgcataggttgtattaccaaagtctagatgtttaatccttaatctccactacagctgatacttgattgattatagagtcaaagttctcaaaacaatgtgtaattatgcaggtttctagaccactctctcttcctcctagtgctagggacaatctgtatcatggtctgccagtaacagtgaagtcagctctcagatcgcgattgcaatcagttaatgcccaagaagaggtttgtgttctctgcagccctgtggtggtaaaacggttcatttcctatattctttatgcacatggaagcagtagtagtatttagatatgactagctcaacactaataagatcttgttacatgctagtttccataagcatattttgctcctgaaaaaggtgaaagtaaaatagtccatgtagattgaaatcttaatatgataataattctgtatatatcatgttaacaaagttgaggactttatatttccagttgtctccaaagcccgcaaactgataaatgtatgctgttttcattatgtgcagcgtactgtagctcaaattaaagctgaaatgcagaaaactcttcgctggattctaccgattgctgaaaatacaataaggtgggcggaacttgttgcaaagtcctactgacttctgagcttagggttattttctccctaaaattcattcctttgtgttttcatacttttaccagagcacatcaaggttttggatgggtcggcgaatgggcaaaccttgggttagtatcaaatcgtgatttgcttatcatataccttggaatttccattgataatataacatgagataaaatagtaacaagtattgctccttgcaacataacctaacatactgctattttctagttgcgaaatgaacaagaaatcaggctcccagctcagtatcacccgtgtccagactcttcattacgccgataaggcaaagacggagcaatacatgctcgatctggtggtgctgctccaccatttagttgtccaggtgaagaacagaggctatgggagcaagtcctcaaagcacgaccagtcccgatcccgcaagggaatggatcttcaacctgaatccaagctcaacacatctccagtgaacaacgccacatatccgagcccgttgtcggagtccgaacgcgagacgctggaccacctgagcttcaagaggacgggctacggtaggagcaagagctgcgagcctccacccaatagagggaagaaggcacatcgaacctgggattcatgccggagccatggcagctcgccggcgagggaattcggtaggaactcagcttcagagcttgacaagacgatggacctggatgtaatagatgggttagatagactgacttcttaccacccaacatcccccacattttgttaggtatatgctgcacaaaaataggtattcttttggtgttcctacggttgattgatcgtatatatatcttgtaaatgtgtgtgatctacctatatattctcttacatgtacatatatacatagcttagtagtacagccctgagtttgagtggaaatatagcaagatcacaagtgatgctctatgcctcgttcccatctctccttttgccttacaatttgtgcaatgtaaaggggaagtttcagcacaaaattctacatcatagtgttacttttttttttgaacgactcgcatgagacggtgcgaagttctattgatagagcaggaaaaaattacaagattacaaccgtggagggttgtaaccaggaacaagaaaaagaaaaccatcacccacacaccgacagcgccaacacacaagtccggaagaagactatcaccggaccggccgccgctagaccaacaaaaggaacacagacgagatcgcccccgaggggatgccaaaacgacgtcttcaagaagagaagcgacggaaaaaccgccgccgccgtccgtcggggctcaaaggagccaagactgggcttacgcccagcaagcacccttgaggggtgagacagcacgacaacgccctcaggagggggaacatcgatgtcggtccggtcaaggccgggctaggttttcacccgctgctcaccacctgcgaatccacgactgacgctccgatgctccaccaccgctcaagctctgccgacatgtgggacccctgcaccggcggcccccacccgctagccttcgtgcgtcgaagaccgcgccacacccaccggcagctcctcctcgcaccgaggtcgcctcctccaccgccggccgcgcctctcgcgccaagccggcctcctccaccggacgcgcctctcgcgccagtccggcctccctccatcggccgcgcctctcgcgccaagccggcctccatctccgccgcccgcgccgagccggcctccgctgccatcggctgcgcctctctaagccaagccgatctccgacccctcctatagtgttacttatcaaactcctgtttgggggagcttcttgttagggttctctctaggatcacctaggtttagatctagtcgggtagtactcttgggtggatgaacaacattatagagatgaaacgagagggtttagagaccgaccggttgaggtgttggaggatgaagaggtgccggacatcatcgttgttgtcgcgtgctagacgtgggcggcagcaacggtgtgctcgatggtgatggcggtcgtggcagtggcggtcgtagtcgatgacgagacgtggtacagcggtgagacttcccgtcactggctacgccccctctcgatcggttagggtttgcgggtggagatggcggcggcagcgaacctcgtgtcgtgtcgccccggcctccatccctctttatatggcgcaggatgacgggggcccaccagccattgggctgggcgcccccgatcagggcgcaggtgaaggccaccttgagccgttgggttagggagggagatccatctaacacttctggcagctgcagcttctcatagaatctccagttaccagaagctcccccaaacagtccagctttttacccagattcttagaatatgtagttgtagaatctggaaaatgaactagaagccaaaagctaggttttccaacttcttcagattctcaccagctagcttctcaacaattgtttctcaggatattaagctccaccaaacaggccgaactttgtagcagctggcctcccatcgtttatcttttagattactccaactaaaatttaaattaaacttagttttaagttgattctaagggttttttttaatcttagtttattttttacagtgacttttagatcgataaaaacaaacataaaagttttactcataaactattttcagttgtttcgtataaatcttttttacggcttaataatagctgtagagcaaacaaaagagaaacgatgaagcagacaactgagaagaggtcttggccacaaattgcagccgggtccaacaagtttatccagcaagattatctttctccagtctctcagcaatcttatccagatgcagatatagcagcagcatttctcgcacaagctcattccggcgatgtccatgtccaccacccacctgtacgcggcgagagagacccgaccaccgcctcctccgccgctcgccgtcgccgtcgccgtcgccgtcgacccgcccgccgaattaattaatacggccacagcccacaggtttagtaccccgtttggatttctcctttccaagagaccaatatgccaaagccgtaagatgaatagtgtcctagagttgttctagaggaaaaggataattgacagcaacttttctccaacctggcccttgtcgattgatccccatgctgtatatgatgatgatgatacatctatgtcaattgggttctagaatgaaaatattgtatgtgaatcttgtcggtgcagatgccagccttctagaatctaagatacactaatgggattgtacaaggtcaggcatgtgcatgcatagtgcataaccccagacagctctaaacaagttataatacattaacatgcagcatatcctataggggttctatatttctctaaataagataatagcagtacatctgttctaaaatatacaagtaacttttagctatgaattttttaatggaggtatagctatgcaagcatatataaacaagaaaaatggtccctatgtccaaatagaaaaaaatgtaaaattaatctagaaaaaatgtcatgtctttgtcatcacaagcataactttcaaccgattagtgggcgaaaagcactggatccagataaccacaaagaagaagaaaatcaccctcccccaaaatcattccaaaaacatcaccttctccagcaatgatctgatccaccacagcacattggcctctcatgagatcagctggcctctgcgaaaattactgggaaaaactatgaggctacgatcctgaccgtcgatttcggatcggacggatggatcaccatggataccattcaccgtggaagaaggaaggttggtctccaccatggcgccaaactgtgaaagcaacagccatggagaaggagaaaaggacatgcacatactactctctgactcagcaaacaatcacataatcctctaagaaaataaaaaaaatgatttcttctagagataagatcaagaactcaacgtccaagtggcaccactaaaattcctcaccccctaaactccctataaataattcacctttcttttcttttctgatctcatcgactcgacgacgacgacgcattccgaattattcaagaaattcaagaagtgaacagaggaggaaaggaaacatggcttcgtttgcatccacggcggcgccttggggatgcgtcgccggagctcggcgtggcggcggcggcggcgggcggtgtggggtgcgcgcgtccgcggcgctggcggtggcggcgccggcggcgaggacgcactacgaggtgctcggggtcggggcgggcgcgagcaggggggagatcaaggcggcgtaccggcgtctggcgagggaggtgcacccggacgccggcgccacgggggacgaggacttcatacggctccacgccgcgtacgccacgctcgccgaccccgacgagcgcgcgcggtacgaccgcgccatggccggcccggcggcgtcggcgttccggcgggcgcccgcgtcgtcgttccggcggcggacgtgggagacggaccagtgctggtagggcagaagcacaactccggtgctccctgccctactgcgccgcgctctccgccgccggagctccgtcgggcacggcggtttgccggcgagtgacgtgggattctgtcggccgtcggatccatcatagaaggcccagatcgaagaggaaaagaggaagcggagcgagatatttgcagaggagccctccatttaccatctattgtcaacaaggtcctcccgcgaccatctcggccgttcgatcgacttgtgcggcgcagattgagccaaaaagagaggcgcagtgcggatgttttcctatgggaccctcaagtattcggtattatcaagcatacccccatcccgccgccggcggcggcggcggcggagcaaagtgttgccgcgccggcgagtactgcggtgatcgccggcgtttcgtggggataacaccgctaatgcatggttcttctcctgcaatcctgtgtatatgctgtaacacgaagagaggcaattttagagaactcttttgtgtgctgattagcttgtttatataataggttttagctctgtctctctcaactgtaaatgatcaagaaactattgtttcttctctttccttttcaaatcatcatcgttgagtactaatttgaagaacactcgaatgtgtatctttggtgattcaagttttttaatttttgcagttacctgaataagcatttctagtttttgcatcacttctagtgtcagagacaggatacgctgtccattctgcactctgaataagataaaatatagacatgacctagtttccaaaaaattaaaaaaaacatgacttgaactgaactgctgaagaagaagcagtatacgcctactacttaacagagtgaccagattataaaaagggattttgttcacttgaaatcatctttaggatcaaaagaattgtgtaaagaacacctgcaaattgcgattaactgggaggacaatttttcctgtgaaccataagatgggataaatgcatcccaatacaaccattttgtgatgattctgctagtgctatccacagatgatgtctgttagcacagaacagaaggcgatgcagtctcgggcttgtttgggaggcctacaattcggcccaccaggattcaggccttagcatgaatttctttcatgacaccaaattgaaatctcttgcaccaaatttttcggtttcattcgccagcagtagccgttgccatgccaagatacaggacagcatcacaacgcatcatcgcagcaagtcagaaacagccaatcacatgatgccacgtgcatatagatcgatcgggttcagagtttcttttttaattcagaccatatgcatgctattattctgagttctgaacaatattattctgcagtacaacaaacatgatagtacttgaaatcatcttgaattatataagcccagttgtttatagctactgtatatacactatacagctagctactatacagatataggtgaggtctgatgaacggctcacctcacatatacagatcataagttttttttgacgcaacagatcataagtcaaaacagaatagcattgacatctccatctctgacagagcacaactactgctcgcgtataaacgatcgagtatacaacaatttttgctgctcacctactcgcaactaaacctttcttgtactatctgtttaatgtcttaacctctctgattctctgattgattctgcaacgcatcacacgcatgttgactctttaatttctttatacaacaacttgtaggtttctcggaaggacccatccattcatttgacgaactattttccttagaaaaatgatataaaatagtgaagcccagtagaagctagcttggttatctagctgatcatgacatgaacaatcaaaatttttgcatttgatttgttcactatctcctctctgtctcttctcatccatgggagcacttctccattttctctccctactactcttcctctccttgctccaaggtaagcttagctcaaaaacaaaatcatcaagcatatgcacatttgtaatttaattcagtggacgacgcagctatctgtttttaagcttaattgttcacatgatttgcttgtaatttctctaattcagtgctcgaaatgttgtttgattaagcaagaaatcactgatcaagatgaactcaattgtgatcaatatattaccaggagcacaggctgcgacgttcaccataagcaaccggtgcggctacacggtgtggccgggcatcctctccaacgccggcgtcgcgccgccgtccaccaccggcttcgccctctccccgggccagacgctcgccgtctccgtcgccgccgcctggtccggccgcatctggggccgcacgctctgcggccaggactcctccggcaagttcacctgcgccaccggcgactgcggctcgggcgccgtcgagtgctccggccgcggagccgccccgccggccacgctggcggagttcactctcgccggcggcagcggcggcggcggcggcgatgacttctacgacgtcagcctcgtggacgggtacaacctgccgatgcttgtggcgccgtcgacgccgccgccggcgagcggcggcgcggcgagtaataacgggagcagctgccaggtgacggggtgcgtgatggacctgaacaagtcgtgcccggcggagctgcaggtggtggcggcgtcggcggcgaggagagcggtggcggcgtgcaagagcgcgtgcgaggcgttcgggacggcggagtactgctgcagcggcgcgcacgggtcgccggcgacgtgcgcggcgacggcgtactcgaggttcttcaagggcgcgtgcccgcgagcctacagctacgcgtacgacgacgcgacgtcgacgttcacctgcgcggccgccggcggcggctacgacgtcgtcttctgccccggcatgtccaggtaaattgatcacaaaatatttctgcacgcacgtcttggcatgcatgcatgcgtgctttttttttttcaatttcacattggccctatacaatggcacgtcgtgtacatgtgcatgccatttggcatagcctagacggtccacaccctctatcataatggcactaccactacagacactgacgtgtaagataatagtagggtgagacccatatatcagtgttgtcattggcagtgatattatggtagaggatcctcaccaagcttttgaccagattgacttcggcgtctcgtttctaggcttgtttctttttctttcttttcgattacacggaaatcgtatacgtgcacgcaccacttctatgaatgcgccatctaacacgtacatgagattagaggtgggagacctctcggttctgactctaataactataaaattgatgtctttatccactgataaaaatttgctggctatattttttgtctgcttttctaattttaatcaaagaaacacgctttgggtattagaaaaaaattgttcgtctgtgtcttcggttagttggcattggtaataagttttagtttctgtgactccacaggaactcgaatgacaaatcacaacctgaaaatgatcagatatttaatcaagccttgattaactttttctcgagattacataatttggatgacatagacgcctagggtcgtgacaaaaattttaaaccaaataaggttcaatcgggacattgcgtccatcttaaccgtgttgttcctgattggttttgcagcacaagttgctgatataattttttagttcaatcattttggtgcatcgatcacttgaacgtgacagccagtgctggcatgcaccacgcatcacttgaacaagtttagtatgaacaaaacagagtgtctctctctgtctctgtgggaaagaaaacttgggcgtcgtctgcagaattggctagtttatatatcgtttttggctacaagaatggcgccaaattttttttttctgtttacaattaatttttagaaagtttctgtttacaattatggttaattaatataaaactaagtacatttttatttgctaatgttgcgatgattgcaacctgatgcagcctaaaatctggtggaaatcctgaggcagtaggcttgccacctacctactcaacaatggcgttcactggaaatgcagagagcttgacgatgagcaggaattcgcttgtgatcctcctgatgatcatcagctcagtgatatcgacgctatcttggtgatgtcaattcaaacattgtatttgcgtgatgtatcccattcatgattatagatttagcagcatatttttgccagtttttcttggaggaaaacttcattctttcagagcaggcagcaggttcatccactgctaaaactataatgcacaatgcttcaagattcgcaaatatataaaacatactgtttctgaaaatgcggatccagatcaaactatttctgaaaatgttcacaaatttcaaaaactaaagcaaattacattgtaaaatactgggcgagcttcttcttcttgacctgtacttgtttaccgaagcacgctgacgtccggcgtgcccactttctgatcttcttgtcttcagcaatgtcggaaaaatcacagtgatcatcatcagccaatattgtgtggggttcaatggacataaactccagggcaacggcattctcaaggatgaaatagaccagctcctcctgaggacggtaacaccgaaacccgctcatgtagaccgtcttgaggtgatcatggcggctcaagcgatagtcctcccttgctaccttggtcttgcgaacccgacatttgtacttcttgtaataatacatctgcataattgtaaactctaagcacaaaaacatgaaagctctagctgtttaatctatgcatcacacgaaaaatactacctaacagtatctaacgcatcaaaagccacacatttaccaaaagaatttccatttagttggattcttgtttttatccctctaacaaacaatgaaagcttgatctaattcccactggttctagtgcaatgaaggaaaagaacgacagaaaaacacaattcaattttgtttttcttcaaacattgattattataggtttaaaaaacatttagtatatcatagatagattgaatgcaattgaaaccgcgctaaaaattttaacaggtgtacataatctcaaatgaaaatgagtgaaggcaaaggaattatagcgcacttaatatgactgggtaaaatggatcaatactcacatgccattctagcacctccagtagaggagtgaattccaagtagtgcgccaattgaacaactcccttacaagtattcggagcactagttaagacatatacctcacacttcagatgcctcaaatgcataaacatgttgcgtggttgtcgaaactagatttcgacaataataaaagggggtggctatcaagcttggaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatcttggaaggagtccggattacaaaagataatctatattcctaacggaatatgaagataaaggtaaaatacagtcgtaaccgactaagtctcagggtgtttccttgatacacaagttaagaaacaaacccgagatacagataagatattctatctacattaggtatcctgtacccagttcgaataccatcgccgtgtagatatgggatacccataatctccacagtagcccccgagtcctttgcagtcgaccatcgtaaccctctcaaagatgataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacactattgtgcattacatgacaaaagcgtacgcggcgcctaaataggcatgctagccgactgctttttagccacaataaaagaaatccgagtggtttacactctaaaaggttcacgaatgaactcacttgacaggcatccgaataaaaaaactctaaagattacccatcaagtaccataaagattatggtaataaataagtcaaatagcctaggccatgactatttaccatgaaaactggcatataacacgccaaggaaatgactataataaaaacaagtcattcctagttaacccaaacagcttttgtagcctaaaaaagcttgcaaaaacagcataacgcctttctgtcggacacctttttaacttgcattgcaataattccaaagaattatatgaccgcataaaaaggatttcatcagcattgggcaacactgttgtgtgcataatattgccaaagcaaaatatgcctaagtccctaaggaacacaatgggccacgctgttaaaagtattgggctgaagtattgttcaggcctaggcccattagcacctccgatacccttaactgaaaaatccgatatccaagcggcgcttcgtcttccccgccggaactctcgccattttccccactccctgctacagtgcaaagctgcgccggcgaactagggttcacaactccggccaaatccacctccgaaaagtgcatcaaaatccttctcgtgatccaccgcctcaatccctcacctctcccaagccatccctcgaatcaaatcagcacatttgagtgaaaccgatggcggaagagagagaaagcttcgaaggccaatgggcgtcgtccgacgtaacggaggaggatcttaaggagatggtggcgcacggcgttctccctgccaaggagatcatcgggtggcgaccagcgcacggtgaggctttcccgtctccggatactcatgagattgtggtcttctcgcatttcttctacggcggctttgctcttccgacctcaaaatttttccgcgggatcttgaatttctatggaatcagcttgcatcacctaaacccgaattccatagtgcatatcgccaatttcgtccatgcttgtgaagcctttttggggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggatggcatgcaaactggttctatgttcagaatcccgagcctgctcttcccgggtactcttgtcttcctccagtgtaccaagatacttggaactctcttccaatcggagatgaagcagtacaagccttggagttgttggatcgtatgttaaatcttaaagaacaaggcttacagggagagcaaatcactcggcacttcatcaaatgccgactggcgccaatcaaggaaagatcccgcacagcattcgagttcgacggcaaacatgatcccaaccgtgaagaaccagattccctggatttcaaaatcatgaaggagaggatgtataaaatcttctcaaatgcaattgtagtcagctactctcatcaattgccagttgtgccatataatgcattcaatccgcctccacaggtatacatcggaaaccctcaaaccgtgatcagaacataattttatcttcatgctgagttgactaactatggaagcatcttgttcagggatatgcattgatgaagtcagatccaccagtcactcagcgccggtctcctcgccaacacaccgcgcagggaggtggagggccaacgatcagaccagatccgcaacctcagacctccaaattgactggtcaaacaggtcctcgcaagagaaagctggtactcgatgatgatgaaggcgacgatgataaatctggggataagggcttgcctaataaacccccaaagcgcaccatgcccaggaaaaaattggctggccgtgcaatgccaaagatcagaacatcttccaggtattagatctctcggtatgatttccgcttcggcatgttttccgatgaagataatgccaaatactgaaagaacactctgcaggaaaccatctgatatagatccatctggaaaagaccccgatcctgccatgacagagcaaaatatatccaaggaccccgagccgactgctgaaaaccagccgaccgctgaaagccagccgactggcgcccatgcttcgggcgatagggccaatccgagtgacctgccgccgactggaaaccagtcggcaacaactgaaacggcaacaactcaagagcccccgactggaaaccagtcggacgcaggccctgatcaagagatccccgaggtagaagcgcagacgacgacttcgcaaggaccagaagctggtaacgactcgatagctgggtcttcaggtaaagaacaaagaccacctcacgctcagctaggtacatcttcaggttagttgtcttctcgaacaatggtgatttaaataacctcagtatatccgtctaatgtcttggaaacacatcaggaccatcaggtgatgacggagaagaaatccctcgtataaaggcgaccgacgactctcgtcctcctatcttgatcaaatggtgggacgagaactcacaagccgccggcatagtcataaaccgtcaaaaagaagatgaagaagtgtgccagctgaagaaagcgctcggagaagccactcgtattgtaaatgtaagtcttccgagtgacggccttcggtaactttgttttctttttagcaggactgaaccatgatccatcatgcagagaatccatcttcgcaatgaggccaagactacaactttggaaaagctggttcctcatttgggaactctagaagcagttagggaccagctgcatgagaccaaggagtgcgccaaaaagacagagaaagagttaagggaccgaatcgcccagctccaggatgcaaacttcgaactaagtggttcatcaaaaggtaatcatccagatctgttccattgatttatgctgtcataattgcatcctcaatcatctggatttcaaacagcgcaagccgccaggatggaacagatggcgaagcaaattgaagccctgagagagacaagacagaactggctgcgcaaagggactcggccttgaagaaagtcgaaggtaacgccagctaacaatctgagcttctctccttataacgcaacagatgctcatcataaatgtgttttgcagatcgcaagatcaaatctcaagctcagtttgacgtcctggttggtaagatcaagaggcttgaaggagcaagggataacgtcgccaatgccgctgcaccaattatccaagctatgttcttcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtacccgagaattgaagtcgacaccattgatggatttgcagacgggacaagtgaagaagctgcccttgatcttatcagcagtgcgcaaaatgcggctgataaaattgcgagtgatgttgtagagcaatttcgcaatgacgacctccaaccgagtaatgaagactctgatgatgaaaggactgattctgactgagtttgaatgtaatacatggaggctcaatttgtacaatactggtgtatttatgctgtgcttgatgattcttgcgaagtttttgatttcttaaaagtttttgctaagctttgttgagcctaaaacccaaaggagctattaaaaactttcagtcctcgcaaactaagtagaaaaaccaaacaaggcaatgataaaccaagtaagcaaactgaattgataaaaaatcacactccattattatgatgatagcccccgactgacaacttcaaggagaaaacttgatgtttgacagtcaaaatagggaaatacaatgagaaagttaagcgtagaaacgacgaagatgttcaatgttccaagagttgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagaaaggcacgagatcgaacattgcgattatgataacgtcgcaacccttgtaagtaccgagctgactgaatcaaagctgcttcgcggacctcttccagtcggtgcaagtcgtccactcggtcttcttcatatcgttcttcacggaaattacggaagcgcaaagattcgaactcgacttcactcggcaacattgcttctgccccatagacaaggaaaaaaggtgactggcctgtggcccgactgggcgtggtacgcaaagaccaaagtactgatggtaactgtgacacccatttgccggcatagggtttaagccggtcaaaaacacgagctttaatcccttgaagtatcatgccgttggccctctccacctgtccattgctcattgggtgtgctactgaggcatagcaaatcttgattccaaaatcttcacaaaagtctttgaaaactccgccggtgaattgtgtgccattatcagtgattatccgattgggcactccaaatctatgcacaatgttgatgaagaagtctcgagcattatctgctgtaatcgtgacaacaggcttagcttcgatccacttggaaaatttgtcaatggccacgaagaggtgcgtgtaaccgccgactgcctttttaaacgggccaaccatgtcgagcccccaaaccgcaaacggccaagacagcgggatagtttgcaactcttgagctggtaagtgaatttgtctggcgaaaaattggcaaccttcacatgtgcgcacaattctgtcggcgtcagacactgcagtaggccagaaaaaaccctgccggtaagctttgccgacaatggtgcgcgcagcagcatggtttccgcatatcccagaatgtatgtctttcagcaattgtctcccttcctctaaagatacgcagcgttgcagaattcctgaagggcttttcttgtataattcagcttcatgcataacataaagtttgctccgccttgaaatccgctcggcttcatctttatcttgagggagctcttgagaagttaaaaatcgtatgaagggctctcgccagtcggcttcaaccgtagcgacatcatgagtgcccgcaacttgagtggtatctttgtgaggtaccgtcggcgtataaaggtgttcgacgaaaacatcagagggcgccgcctcacgcttggatccaaagttggcaagtctgtcggcggcttcattgttgtgtcgaagaacgtgactgagctcgagtccatcgaacttgtcttccaacttgcgtacctcttgtcgatatgccatcatattgtcatcaaggcaggaccactctttcataacttggttgacaaccagctgcgaatcgcctcgaactattagacgctttatccctagggaaattgcaatccgtagcccatgaaggagcgcctcatactcggcgacgttgtgagacgccgaaaaatgtatccaaagcacataacttagtctttctccagtcggggaaattaaaaccactccagctccagtgcccgaaagtctttttgacccgtcaaaatgcatggtccagtgctctattttctccacgggggtatcctcttggcactcggtccactcggcaacaaaatcagctaacgcttgagacttgattgaagtgcggggcttgaatgatatgtccaaagacatcaactccaaagcccacttagcaatccgcccatttgcttcgcgattgtgcagaacatcgccgagtggaaatgatgtgaccaccgttaccgagtgaccttgaaagtaatgagacagcttcctggtagtaattaaaataccatataacagcttctgaacctgagggtacctcgttttggaatcggtcaggacctcgctgacgaagtagattggtcgctgaactttctggacatggccttcttcctcacgctcgacgaccaagactgtgctcacaacctggggggtggctgatacatacagcaacaacggctcctgcgggtgtggtgaagctaagaccggtggcttggtgaggagttgtttgaaatcttcgaaggccttctgtgcttcgggtccccactggaagttatctgttttcttcagcagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcctggatgcccctacgagacaccataaaaccaagcagcttccctgacggtactccgaaggtgcacttttcagggtttaatttcatcctgaaagcgcggatgctcgcgaaggtttcttctagatccaaaattaaatcatccttttgcttggtcttgacgactacatcatccacataggcttcaacgttgcggccgatctgtgttgaaaagcatctctggatcatgcgttgataagttgctcctgcgttttttaatccgaacggcatggtgacgtagcagtatgccccaaagggcgtgatgaatgaagtcttcaagcagtcggattccttcagtcggatctgatgataccccgagtagcaatccaaaaaactgagaagctcacagccggcggtcgagtcgactacctggtcaatgcgaggcaacccaaaaggatctttgggacaaaacttgttgaggtcggtataatcgacacacatgcgccattgccctgttttcttccgaactagaaccgggtttgccagccagtcaggatgaaggacttctttgatgaagcctgctgctaacagcttggttaattcctccttgatcgcgtccttcctgtcttgtgcgaatcggcggagtcgttgtttgataggcttggcatcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttagtaggatcagaaggatctaagggaatctttttagtctcggcttcggcttccccactttttgaaatcttggcagcgggcacttctccttcgctcaccgtggttgcagccagtcggatttcctctcgggcagacactatctcgcgggtttgggccatgtcgcaactctccttgtcgcatgtgacagcttgcttgatgtcgctccgtagggttaggactcctcggggaccaggcatcttcatcatcatgtacgtgtagtgcgggacggccatgaacttggctaacgccgggcgtccgagtatggcatggtatgctgtctcgaaatcggcaacttcaaagctgatattctctgtgcggaagttttcccgagtgccaaaagtgaccggaagagtgatctggccgagtggagttgcggataatcctggaattactccatgaaaaggcgcattgcttgattttaactcggagcgagggatctgcatatcatccaaagtcttggcgaagaggatattgagcgcactgccgccatcaatgagggttctgcgaagcttgacgttgcggactactgggtctagtaccagggggtaccgccccgggtggaccactcggtcaggatgatccgagcggtcaaacttgattgcaatctctgaccatcgaagatattggggcgtgtcgggctgaacagcgttgatctcccgttcagtcaacttctgcttccgtttagactcataagccatggggccgccgaaaatatggttgagctctttgcggtggtcttgaaatccagccggggtgtcgccgtcgtccttcttccttgacgtgctttgttcctcgtcggagttcttccgagtagacttggtgtactgctccgcgaactgcttgtagatgaagcactctttggccacgtggttggagtttggatgatgcgggcattgggagttcataatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccaaatttgccgaccaattcttcgtggcgaatccctttggtgaatgcggcgatgatgacgtcgtcggtgatgtcggagatcttgttacgttgttcagaaaatcgccggatgtaatctcgaagggattctccggacttctgaatgacgttgtaaagatcatattgcgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgttgtcacctcctgctgcgcggattgcgagaccgtagacggtaagccacgattctgggttagtggtaccgtcgtacttctctattccagtcggtttgaagccggctggccaatccactcgacgcaggtcgtcggtgaaggctgctaccccatcaaggtcgtcgtcgtagcggtctggcgagtggtgacggcctcgagctgctcggcgctgcatgattgtgtcgcgaagatcgatggggcggcgacgaggcggtgaacgtggccgttctactcggcgctccccacggtagtcgggaggcgagtgcgcggaccgctcgtcgtgacccctgctcctgcgattggatcctgcgccggtgatgctgaggcttggatgacggtagtcctgagatcggaagtgtggaactcggctaccagtcggcgtgtggacgctttcggagttaactggaaccgaggccgcaatcatggtcttggtctggttcaggatgttgacgacatgatcagattggttgtgctcgttttccttgaggagggtgtcgaggagggtgatcgcggcaaccgcattctgctgaggggtacggaaaaccggtatcccttcaacatcttgctggccgatgagatcacgcgctcggcgcccagcttccaaggttcgctgccgtcggtcttcagcctccttcgcgttccgctcatgctcctgctgctcccggcgtagtcgctcttgctcttgtgcttggcgctcctgctccagtcggcggcgctcggtctcgcaacgtgcttcggcttcccgggcttggcgctgctcctccgtttcattgtcggccataaagacgccgaagaaaagaggagtgtagttgtcttctaggcttccgtcgaagtcgtcaagatccacgtcgtcgtagtagcgagaaccgaactcatcgtattccacgatttcggtgggacgtgagtcgacggtgggagagctgtagtagccatccagttggtccgttgaaaccgtgccgagtggttggaggatgacgccgacttccctgaagctaggcgaaatcggtgttaagaccgacttccgcctaggcctacgggatggagacggcgtggtggtggagacggctgccgaatcgtcagggagctgcatcaagatcgatgggtaaggctcatcgtcttgatctggcgttgttggagtagatgcgatctcggccgagtggtttgaagccgactcgatcgagatggtcttgaagcaactttctgccgcgtttgggaatccaaacggaactggaagtcgattctctcccgactggtctgattccgagtcaaggagagaaatcttgccgaagttgttggtgacgaagtcgaggctgccgaaccgaaacgtctgcccgggtgggaagacgaggtcgtcgatgccggtgacggaacccattgcactgatcggcgaaaagcttgacgctacccctacctggcgcgccaactgtcgaaactagatttcgacaataataaaagggggtggctatcaagcttggaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatcttggaaggagtccggattacaaaagataatctatattcctaacggaatatgaagataaaggtaaaatacagtcgtaaccgactaagtctcagggtgtttccttgatacacaagttaagaaacaaacccgagatacagataagatattctatctacattaggtatcctgtacccagttcgaataccatcgccgtgtagatatgggatacccataatctccacagtggtcttgtcaatgtatgaacctgaaagacaaccaaacaaatggtaaggcagtctaccaagcaagcaaacaaatatacaaaaaggcaaaccaaaagatgaattccttggaacaaagggacaaacctgtcctaggtcatagtcgtacatatgtaaatccaagctaagctccttgacaggtaaagcacttggaagcacagtgaacacatggtcaagttgattaagttcaagaaatacgattgttgccttcactgattttgggcaaccatgaagcatgattgagattgcctcccctctatacccaaaacgcgtaagacaggaaacatgaaattcaatcatctgcacctccgtaccccaaatccgcagatgttgaagcttgtcaagttggcatggtattaccaaatcacccacgccagtgcacacactgatatccaagtcctcaagaagagaacatcgtgacagcaagtctggaagatcccccactatttttacatactgcagcgcgagccttttgagcatggtaaaaccagaaatatttggatgtacctctattaatacaacagctaggaacaaagactcaagagcagggtcatgcttagcatccaaagcatcaagtgagaagtggtaaacatcttctagcagatgtttccgtgttggccatctgtttctgtgccgagattgtaggttaacatctataacctttgccatcgatatgtttgaattcatccttgttgaggtcacagttgatgctgaacttatttaaccctattcccttgtggcgtcggacaacatgatttactgtcttagagaagtaccatcggtcaattttgagagtaccctcatcagtaggctcctgcttggtgccatcaaagcacagattagggtggcatgtccagagcattctccagtttcttgacacaaggctcgctctagccgcatctctgagtggcataaaagatactataagctgctgaatatcctgtcattacaagagaaaacaaacgaaggcatgctcaatcaatttgtaggtgctttgattctataataatagaactcatccgtgcaataaggcccaatgtttcatctatgtgaaaaatcacacaggcaggcaaggcatggcaggtgttgatagatgataggggaaaaaatgaacttttttttttaccccggatagagagaagtcagggaaatttagagttttttttgggaatacgcaagatgcgcatctttgtattaagagaaataaagagtatttacacgaacccaaacaagaaaataagagggggacgggaagataggagaaggacccaaagatcttaagcctattctcacgccagcatatggaaacgacctaaaccaagacctaaatgattagcaccggtagcaccgcatgtgtcaaccgccagagagttgcttccgccgccatagctcgggctatctctgaccagggcctttgctgagagttgaaaaccctattgtttctctctttccagattgtccatgcagttagagttgcaattgtgtcaaatccccttctgctagccgctcccactttaaggcgggagttgcaaagccagagataaaaggagtcttcattcagggggagacactgcggtagaccaatgctggaaaggacagcccatcaaagttggcgagactctgggcaagcgaccaagatgtgatcaatagtctcttcatgttgatcacaaaggacacatctatccgggtgaggcaaccccctagaacgcaggcggtccgccgtctagtagcgcctttttgtgaccaaccaggcaaagaaccggcatctcggggagggggggcgaaggtcttccagatgggttcggattggaaaggaaccctacctagaaagagtgcccggtatgccgaacgcgaagagtagactcccgatgcttcccacttccaaataaaagagtcggggtggtcagagagccgcacagaggacctcaggatgctccagagctgaaggtactcaagaatagcctgcaaacccagcgcccctgtgcagtctctaatccatctcctgtcttgaagggcctcggcgaccgtcctgcgacggcgaaaacgtgccgggacagccgcccaaacagccggagcaatgcagcgaatggaggaaccctctagccaaatgtcttcccaaaaaagaatggactccccattgcccacccaacgcagactgttgaagccgtcgcaaagtttcgctcgttcaaggaaaccgggatgttgaggccgtgccatggcttatccggcgaagtgcgctgcaaccagacccatctcgatcttaaggcgatgcccatgcgatccaaatccggtacccccaacccgccgtagcattttggagcacaaacaccaccccatgcgacccgacacttgccaccatgggtactgactttgccggcccaaagaaaacccctccttatcttgtcaattcctttaattacccacttgggtgcatcaagggcaatcagcaaatagattggaatcgagcttaagaccgaattgaccatggtgatgcgaccggttggagacataagatcatattgctagtgcgggagccagcgagcgatcttgtcgacaaacggctgcaggtcctccttcttgaggcggaagatggaaagaggcaggccgaggtatgtgcaaggaaacgaagctagcggacatggaagcgccgattgaatcaaggagaggtcatcatccgagcacctgatcggaagcgccgaacatttgttgaagttcgtgtggagaccggaagcttcgccaaagatgcgcggcactgttgtggcggcctccaaatcggcaaccgtcggcctgacgaaagcgaccacgtcatcagcatagagggagacccagtgagggatccccagcggctggaggagccccaactcttctaccttaacaaagagggagctcagagaatccatggcgaggatgaagatcataggggagataggatccccctgacggacaccacgcctgtgccagatcgtctcccccggcgccccaatttagagttttacctcagggaggtcttgtatctggaaagatggcggcggcctgagtgagtcgctgacactgcggtggtgctccaacctcctcaccttggtggtcgtcggatactccattccatacgctgcagggggagcgagggagacgcaggttagcagtagcagtagaggagagacggggaagggagaaacctggacagagtgtaacaacaacttaacaagggatagggtttatcatattttgaacccgactcgaatcgatcgggaaggatagagattcgatcggcaatcaagaaatccatctagtagcatctttgttacctgcggagaggcttcaatgcgctaccagcgagaagaaaccggcgcatgtccgccatgaatgatggcaagctagtagagtagatagatgggacggacaggtcggaaggagatggagctgacaagtgggtcccacatgtcggtgacccgagcatagaggtaggccgctcaggttcgcgatggctcgataggcatcctgtcttactataaagttatcccccactaactccttaagcttaacatgcaaagatgccacatcatcatccactgacaagatgccacatcatcattcactaattaacaagatgccacatcatcatccactaacaatcatcacatttaaacatcatgcaaacatgctatatcttcatagtttttataatttaaaagcttttcaaatataaacatattaaattatcatccaacataattcacataatgttttaatgtatatctttattatattttatgatatcctatatacttatataagtcatcctcacttagttagtgcttaaatgattaatctatggtccaaattatctctctcctttttttctctaattaagtcatatcacatcaattatttttagcctttagatgattaatctgcggtccaaactatctccctacttttcttcttccataaagtcataccaccttactttttacgaatgaattaccattctatatactatttaaatttaaattatcataaaccacattaatttacttaatctgatgttatctagctatcttacacgttattttttttattgttatcatactgaattctcgcagcaatgcgcggggtttcacctagtattttgaagggttgaaccctagtttgaagctgtcagaaaacaaagtgcccaaaacacacacgcataaaaggaagtaggcttcaggcaatatctaagggcaagtacaacggttcagcgagacccgtcgacatgcactgtttttttgcgaaaacccccccgcacggcgctcgcttcggcccatccgtcgtctcgttcgtcgacgaggccagcgcgtgcttccaggcgaagcgacggcgatgaagcccattgtacaacccaatccgggtaggctcgagaggcgcgggatcagctgcacgggatcagctctctcgcgcgcggaacaggttcgcgccttcctcgcccgcaaaatctctctcgcgcgtgttgaaatagccccccctgcgttccccatccaaccctatttcgatttggccaccatgtcgcggcaggcacggaaggaggcggcggcggcggcgcaagatatgctgaagttggatgcggctcagatgcgcaagccagctgcatcgcaatctcgaaagggtgcggcggcgccgatgcggaaggcccagggaggagctcgggcggcgtcgatggtgccggagcagagcagttcagggttggcggcgcgtgtgccagagcaccggagttcgagatatggcgcggctagtccaccaccaagctccttcaccgacggcagctgcttcttcaacggcagtgccggcggcttcttcggcaacgccggccaaagccctagtggtcaaccatggagttcttaatcttcagatcctgcaacatggtactatctctgaactttgcttctgtgatgagctcaatgatgggaatcatatggctaggaattaattttagatgttatttgcacttccctcgcttatacaagatttgggatacactgtcatgagtttcagtattgtggttgatgcaaagattgattgcactggtgcagatttctttgatagtttaataaagctatgtaactagtttttatccactgtataacatcaaagaggatgaagcactgaaacaaacattagttcctacttttacacataacattagtccctagttgctttcattgctcatatatatgtgtaaaatatggcaggggaaacaatgcaacacctcttggaggcttcataaacttgatccagcctaacttgtctcaacaatttaattttgttggagaccaaaatcagtcagaagatgattactcgactcctatttcagctagggacaatacatatgttaatgttgacagtggtgatgagacacctaggactgagaaaagaatcttttggactcaagaagaagatgttaggatggtgagtctcactgtaaattcactgtgtttatagtttttttacttaccataacagtccaagtgataatatatgctaattaacatttacagatgagctcttggctgctcaattcaacggactcaaccgttggtgctgataggaagaatgaacaatattggactgatgttgaggctacttacaatgagactacaccaagtcataggagaagaaatgccaagcaaatcaaggaccgctttcataaggtaaataagtggactgaccttttccatagtgcttggttgaaggctagaatgatttatacaagtggctataatgatcaaatgtggattgagaaggcccatgtattctatataaaagacaatgagaaactcaatctaggtccttttgtgttgatggaagtatgg

SEQ ID NO: 6914 - DNA, 1609 bp, Oryza sativa
  unsure (1)..(1609): unsure at all n locations
caaagaatatgaactagtctctgttttgctatgttttggaatccaggagcacatcaattgctaattggaagtagtctctgttttgctatgttctgtttctgggattgttttttttttggctattgtgaactgttttttgtgaactgaaacgtgtcaatggaatgtgaactgatgggtcattgcaatgtgaactgatatgatgtgaaatggaatgtgaaatgataaggcaatgccgtgtatgcatttgtatataaaatcaactgctctgtgacttgtatgcatcacaattgtggcgatggaggcctctggtgcctctggtggcgagcatcctggtggcgacgatgaggggtctggtggcgagttcttcgcctctggtggagatggaggcgatgaagatactgtccttgaagaaatcgatccagcggaagtatatacacttgaagattttctcgccgaagatgaaataatggaatcatttcgaaggaagattggcgataaattgaaggccaaaatcgaaggatcttcttctggtccacctcgtcgtcgccagcgtcaaagtggacctagaaggtacatacctaggccaagagaaaagggacatgaagatttagttgctaattatttttcagcaaatcctatctatactgatgagcagtttcggaggaggtttcggatgaataagcctttgtttcttcgaattgtcaatgccctgtctaactgggatcaattttttacccaaagagttgatgcaacaggtcgagatagccactcacctctccaaaagtgcaccgctgctattcgaatgctaggatatggcacaccagcggacgcactagatgaggtactcaagattgcagcgagcacttctttggaatgtttgggaaaatttgccgtaggaataatngaaatgtttggtagcgagtacttgcgttcttcgacaagtgatgaactagaaaaaattttacaagagaatgaagcttcggggcttccagggcatgataggaagtattgattgtatgcattgcaaatgaagaattgtcaaaaaggttggcaagaaatgtttatcaaaggtttcaaaaggtaaacctacaatgatccttgaacgggtagcatctcggggcccttcgtatatggcatgctttttttgccaacgccgggtctcaaaatgatatccagttgttaaccaagtcaccattgttcattcatgcgattaaaggagaagccccccgagtgagttatactgtaaatggaacgcagtatgacacggggtattatcttgccgatggaatatatcccgagtgggctgccttcgtgaagacaataagaaaacctcaaacggagaaacataaattatatgcacaacgacaagaaggggccagaaaggatgtcgagtgtgcatttggcgtgttgcaatcccgttttgatattgtcaaccgtccagcacggttgtggaaaaggaatgatgttgttaatataatgcaagcttgcgttatcctccataatatgatagtggaagatgaaaaggatttggttaaaatcccattggatttgaatgaaaatccaagtgcaaccattgtcctaccaccggaagtgcaaacaaatgacaatc

SEQ ID NO: 6915 - DNA, 1095 bp, Oryza sativa
acctgtgattttaccctcattcatactacatagcaatttttaggttaaaagcggaggagtgtggaggtttatcaacgatatagaggatggtaaaactaaggtacatcagaaataatatgtaccattacacgtattgaaacatagtacagtgacctcggtgcagggttatggtccattagattcatgattcctgagtcaaaaatctttggcatatagacctatgcaatcttgaatgggtaaatctaacactaagcctaacaattccagaaatcaacctacttatttttgagggagtaaatagacatgagtagaaataccacagtacaacaatgcgatgaatgtgtaatattaaaaaccataaggagaaaccatagaatacattcttttcaaaaaaaaaaaacatagaatgcatgacataagatactgtaaaaaaatgaggcctctcggtaacacacctcgtagttctttttggttagcctctcaaggaacggtgatttctctaattgttccttgctgcttccggtaatgtaaaagatgtccttctgccctggcttcatccttgaaatgtactcatcaagagaggcaagtttgccttccgacttggtactgaaacagataaaaactcagttctattatccctcgcatatataactacagcaattagtggacattagaatagaagacaaacctttcaaatctcagaagctttgcaagacggttcctgttagttgcgtcttcaatgatgcccaacttgactgattttccaaactcattccagaacttggcatactggccctttttctcctccattgcacttttttcttcatctgagtacagaagattatgtgagaattacatcataaataacagtatatgacctgtgatccacagagaacttgttacctgtcttatctttgttgctgtactcatcaggatcttcctcagcaagttttctaatcatgtcaagagctttgcggattagtttcttcttgatggtcttcaggctgctatgttgttggagcatttctcgtgatacattgagaggcaatgtgtccgagtcgacgagaccctacagataatagcttataggtttag

SEQ ID NO: 6916 - DNA, 631 bp, Oryza sativa
ctttgttacctgcggagaggcttcaatgcgctaccagcgagaagaaaccggcgcatgtccgccatgaatgatggcaagctagtagagtagatagatgggacggacaggtcggaaggagatggagctgacaagtgggtcccacatgtcggtgacccgagcatagaggtaggccgctcaggttcgcgatggctcgataggcatcctgtcttactataaagttatcccccactaactccttaagcttaacatgcaaagatgccacatcatcatccactgacaagatgccacatcatcattcactaattaacaagatgccacatcatcatccactaacaatcatcacatttaaacatcatgcaaacatgctatatcttcatagtttttataatttaaaagcttttcaaatataaacatattaaattatcatccaacataattcacataatgttttaatgtatatctttattatattttatgatatcctatatacttatataagtcatcctcacttagttagtgcttaaatgaataatctatgggccaaattatctctctcctttttttctctaattaagtcatatcacatcaattatttttagccttttagatgattaatctgcggtccaaacta

SEQ ID NO: 6917 - DNA, 1772 bp, Oryza sativa
aggtcacccccagtctgcatcttttccacaaaagctgcaaaaatttcaaggaattggtatcactcaagtttaagttaaatggcacttggtaaaattctctttacaaacaaatagataatactaaagttttagcaagagaatacacataactttaagagaaatcagtacaaaggagtaatacctgaagttccagatttggcaatggtcccaaggttcttaatgagatcttccttggtcataccaatacccctatcccgaatggagagaatcttcttctccttatccagcttaatctacacgtgcccacagcagatgccatgaagtcaatttccaaaacaagatataccacacaaaaaagactatcagctacgaagtttaatatacctggatttcaagcttagcagtgtcaccttcgcccaaaacctccttatcagtgagagccaggaacctaatcttgtccaaagcctacacataaaaaaaaagcacacattaaattcctagcatctactaataaccttaagggctcatttggattggaggcttttcccgggaatttcataggaatactgttcacatgggattttttcctatcctatcgttcggatcataaaaagtggttatgggaaaactgtaggaaaaaatcctttgctgctgattccacaggaaaaacggaggaaaattccatccactccaatctcttgtttcattccctttgacagaatcaagccaatcaagcaataaaacagccactagataataagcaagacagacgggataagcaagatagcggtagataataaatacagtatacagattactcctcgattactttttatttcctttcctgtaaaccgaatgctctcaacttttatattcctgcgtttttcaatcctatgttttcaacgtgatttcctttcatattcctacgtttttcctatcctgtgtttttccttttcctgtgttctgaataggccctaaaaagggagtcaaaatgcaatacaactacatacatcagaagcattggagatgagctccctcaggaaaatgtccttgttgctgtagagtgagttgatgatgatgtccatgagtctggacacctcagcctggaactcaaatttctccgctgagctcctgagggtcttcctcgagattgactcagcctccctgcacacattccatattgctcatacagatatcaacaacacaataagatggaaacgatcagcattgatcagaagatcgtgcacacctctgaacaacctcagagtccgtggacaggccatggggaacaccaccaatcttctcctctaccttcggcggatcaactaactcatcagtgctgtcatcagcattgacttggagcttcttagctgcagtacaggaagggtcagaaccgaataataatttgaatcatgtgttgacttgcggtagagcaatgtgtgtgaattagacttgagaagcctttaaaaatcactaagatcagtaagttgggggcgctagatcaacaacaatcagcactagatttacactgaactgacttgatacagatgtattattactctcaggactaaaccctatttaaaccccgcatataatgagccctattgcggacaaaattacggtgcgcaatagcagattacggatctagaactagctaaatctcgaaatcgcaataaaccctaccattacaacagatcgaagtggccgcgaacccaacaagcgagatctaaaacaaaaatcagactagaatcaccaccagagatcgcacaaag

SEQ ID NO: 6918 - DNA, 2574 bp, Oryza sativa
aaactccacaaaaacaggttgacatatatcatggaatagcttgccactacctaaaaagctaaaagcacttcctgtcgtatatgaataatggttgaagtgacaatcacattatcagaattagctcttcatagaaatgaagaacgtgaaaagggattctccatattctccaaaagttagtggtgctaacattatgcttctatgaacaatgatctctcctaacaacagaactggaggtagtattgcatggacctattttcgtgggtatcaggctaaaaaaccatgaatcaggcacacactggtaaagtaaatgtctagaagatgtacgtcctgattccaaattatcatttctggagaatatactatgcaatcaacaaagcatgcaggtagcatcttgaatgcttaggtaataggtacaatatcaatgatgtagaggaagcatatggtgtttgtacgaagtgttttttttataaatcattaatttgatgaagcataagcgcacaagtaacacattgctacttgcttagcagcagaacaaaatcaacatgtttctttcaccagaaaaatatgctatacagtgcataggctattgattattgatttttttatcagtcagatatatagtgcattcaaagaggtcatagatatccagcaaaaagaacatgagttaagcattctatcactgtctcgacaagatgaaacaaccaccccacccaccccctcccctttccccaagaaaaaaaacaaaacatttcagtccagatcagctgtcatttcactacatcaaaataccaatacaagataatagactgcagcggatgaactaaacttcagaataatggctctggagcatggttattaaggcgctaaaggaaacctaaggaaccctcatcatgccttatgccttaaggtcacgccttacgcagtgaaaaaaaaaaggaaataaaggactttttcataataattgcagagtccaggactaaaatggaaggctttttcatgacatttacatattccaaggactaaaatggaagatggcaacagatattttatctacccatcccaatccccaatcccgtcgtcacctgtttctccgccgcttgctcgcctccgctcccttgccccggctgccgcctctatcccctccatccactctctcttcccttgctgctgccgctccttgtcattgctcgtgctggatctgggcaacgccagcagttggggacgacggcaacggtgatatcctagtcagatctttttgttcctcccccttcccctcccttcccctgctgcctccgctcttcatgactacggattattgctgccgccgcttctctaggatgggtttatcacttgtttttgccctttctcctctagctttctcgtaaggcggagtggacgccttacaccctggcagcgccttactgccttagggatgccgtaataaccatgctctggagcatgaaattttatcctacgttgactcttcttacaagcatttagtttgtaaatcaaggaaaagagaactaaccaagctagtcataatcttttttagaaggccatagataacagaagattatgaggttgccatactgaatagcagtagctggtagccaaattagtgttttagacagatatagctagtctacatctatactaggatttaaccatgctgaaacgaaggcaaaaggtagcagctagcatttagtatgttagatatatatagttagaagcagtacatgaaatttgcaaaaacagaaaggaaacataactgaccttcatttcttttcagaatttggcatacagccgacaggcatcgtacccatagccccacagactgggagctttgcagatccagattttgcaccttggcattggatactggcaatatcacaggcaccttgccccaacacctgaccactcacagcgccatcctcgcccattgttctcacctgcatccctggactgcaatacatctggtcggcacatcgaaagtcacaggagttcataacctgggcaccaccaagataacttccctgatcaacactagaaaccaaatcgatgttcttcactggcctctgataaggaaaagccccaatctccccttcaatccttcctctaatatcaacgagcaggcaccgcagcctggatacctctgcctcgagcgtggcatggttctggagcttcttcatgagctgctggtttagagccctcaaatgaacaacctcctcctccagcgaggcagtgtgagctttcttcttctccctgtacttcctcacagcggcacggttacccgacggccgcttcttggaggcattgttctccgtcggggactcggcggtctcggcagcatccgacggagtgtcggatggggcggagacgatcttggtgtggacatggacgcaagtgttggtgtgtgagaggtcatgcacaggcgggttgcaagtgtgggtgtgggtgcatgcatggtgctccgtattcttgaggatgtcgtcgaaataactgtccatggagcaactgccgtcggggtcaacaacaacgaccggcgggcaaaagaatgtgttccggttggagaaa

SEQ ID NO: 6919 - DNA, 32539 bp, Oryza sativa
  unsure (1)..(32539): unsure at all n locations
ccgcctgcaaatgggcggcgagggggggcatggaattttgcaggcggcccccttgccgccctccgctagggcgattttgcactgtgcggggggccgcctgcaaatgggcggcgagggggcatgaaattttgcaggcggcccccttgccgccctgggggagggcgattttgtaccgtgctctatattttttttatataaatatcaatagttatcaaatctttttatattgaaaactatacaagattaaaatctccaagactggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaatcttaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcatacgaggtcctgcgatgaggaaacgtgcagttaaaaaatggtgacacattcgtgcaaaagctgaaacaaaaaagaactaatatctaggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctactcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgcccggaaacacctgcctaagtccgaactgtctcatcacacgctgcgggcagtgaggctcaacgaaaatgtcgaacaccatcgccaggatggtgagccagtaagcctggtcgcgtgtgcacaaggacgaaagtcctagcggtgctctcgcagcgacggctttttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactcatccggtcgcaaataagcatgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtgcaaaacaaagcaaagttgagttcaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaatattagttcaacataagtaataatgttcataagcgaattactaacacatattaaccaagagtccaaccaacaaaaagtgtttagtccgaccactcatcccgataccattatgatacaacnccgaatagttcgcaatactactagtacaccaatagtcggaggtactcattacaacaagattgaattgtaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaactggtcccacaactcattaaatttcttctcttggttctgtgcacagagcctcttaaagagatccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcgaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacattcttccttcatgcacctcacttcatacacataatttgttgacttgaccaccctaaactctctctgcaatgaaactgcccaatgcttcaccgcctccttcatctcatccttatgagcataccttgcaccctcaattacctcgttctccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactattgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctttcgtttttttggatttttagtgaatataatgaaatttcacaggggaggggctgggctttataggggggaggcaaaaatcgccctcccccagggcggcaagggggccgcctgcaaaattccatgccccctcgccgcccatttgcaggcggccccccgcacagtgcaaaatcgccctagcggagggcggcaagggggccgcctgcaaaatttcattgccccccctcgcccgagagcgaacggccgtctgccacgtcattttcgccgccctctgggagggcgatttggcggtaggcgactataaccgtcaattttcaaaatggaaaattatttttgtaaaacttttaataaaaaaaattataaataaaaaaaattcctcgttaagagcccgccatggtaatggaaagagagattatagcaagtctagtagtacaacccaccgcttactccaaaaattttatattagcaaaaatcattgtttaatcaatgcaaatgcattgttagttaaactattgtttttctccttgttccgtactctctctcctgacacaagttgcagtgcatggaagttaattggttgaattgctcatgtctgtgttggagcgcgagtgcaggtagcgcttaaatagtcgcccggtgatatactctctcacctccaactcactgtaaaagttgatgtggcaggtttatcgctagttattgtacctgttattaatggcttgatgtggaaaaatgaatggtaatggaaagagagattaatggcttgatgtggaaaagggaagaaatgtccacccctggaaaaattgcctttcttcttctgtttttctattcaactttctctgtttttcgattgaaccctttgttctgaaaaaaaaatgcctttgttcttcctctgtttttcgactgaactctttgctttacctttctcctacttttctatttgtgtttcaattgaactctttgtcttgcctttctcctaccttttctgtttttcaatcgaactgtttgttttttttttttgttaatctttcttcaatacgatagccaagacaaccacctaaaccccaatcatggggctagtattgcgtatctgcataagagcacacgattgtcgtcaaggaaaaaagaactaatagcctatattaaccatcacaatctatataaccaaacaaagcaagcacagcagagtagcagacagctctgaaagatttactccacctcaggacgcagaaacaaattttgcaacaccacagatttccgtacattgcatcattcagcacaaaagtggtagtacatcatcagcgttcaggagttgcttttggtttttcagcacatatattacaagcaacagtagcagtagtgcagcacacccatgactcgtgaaaaaaagaaaacaagagaagacatctgcaaaaactagctgggatggattggggcagagcttctattagtcaggaacgttccaacactgggttgatcgttgaggacgaactatttcttttgctttgcacgatagtcagcagctgctgctttgatggtagacttggcgagtgaggttggctttaggacgctcttcgggttcaaggcctgccgaatcttgaacactgcccatgctgtcccgattgcgtggcctgctgcatccatcccttcattggtcgcagccgcggctttctccccatatctgcagagcagacccaatgtaagagcttaagaagaatctctattgatcatttgatcaattccactacataaggaagaattagagaaaaaggatgtgcatatgatgtgcttcagatatggatgtaggacacgtaagaagtagtagaaatctacatataaagagaggagaaatgagtggaaaggagaataactcgtacttgtgggatacaagaccggtagtcacagttgatgatgtggacagaacattcgttccagccacttcgactgcgtcgcaaatcttccctgttggcatgaattaacgatatgtaagaaagacaatgttaccataatccaaagtgattagctccaacgagccaaattaccataagaaattactgcttcaaagaatgtgttcgggtaaatctgtatattttgttaactgttatactgaagtagatatatcgcataagagatataaagtactatttcatcggaaagcatggcggcaaacagaatatgtccctaaatgtatctaacatgttgagctaaggtcaaccagcatcagaaatgaaaaatagcataatcagtggttggaagtacaaagtggcagcagctgatttaatatgagctgatccagaaggagcatgccaaattaaacagaggaaatggagagccaagaaaaagaattgtatttcattccaaatttaagtcaccagagtacatgcttcttatgctaacttcagatttggcaaaaatttgtatccatcaagttatgcaaattcacaggatatatgcgaccaaaaaacccaagcaaagccttacctacgtcagataattatgacttatataatgcaacccacagggatattcaaattagaaacagaaaaaaaatctgctcatgagtcatgacacaggtgttgtctaggtgagtttaagaataacataaatttattaaattatgaaaccaggtttcatgtctgaataaagcaaacatatcaacactcattataccattaaaaaaaacaataatgcaaagcagacccattatgtaacactaaccagatacaatagaaaagttaaagaatcataccgaatccatcaagcgaagcaagaacaatctctccaggtaacaaattaaagaacttcttgccagcttttgagttagctattgagtttgtaaaatagccagtaacctttacaactccggatagtattccagttgccactttctcagacatttttgtcaccatcttgaccctggcaacaatcacaagcatgaattccttgaagcggaaaattgttaatgcttgatttaacacaatatctccctgcaacgtctattctcatagacactaaaaccatccaaatctaacatgatgtcggtgtgatggcaataataataagcagggagcatacctatttatttaaatggttttgtaacccagcaaaaatctttaaataaaagagaaacacaatgaaggcacattgtatcatcctttttggatagacatacagaaatggtaatactatcacactttagcaatgtaaagttgtaaactaatgaaccatggagaactgaaagcctgaaactgcattcatgccctgataactaaatcccaaatcatactggataaatttggttgacatcggttaattcaaatcacaattacaactaaaatgtgagatagagttactaccttttgatccgcctcaacatctcggggctgacctcggcgtcggcgtcgccgggctgcatcctcctcttgaggacctcgtttccccaccggagcctgtccaccgtcagttcactgcaccacagaatccccttggccaggtgcccggcccccgtcgcgatcgcatttgccaccttcccgccgtactcctccacattgggcgccaccgccgtccagtacgccgccgcctccacctcgtcgcgaaccttgctcgccaacgcctcgccgccgaccacggactggacggagaagctggtgtacgtggcgaggatgccatcgaggcgcgggtcggggtgggagagcgtgaggccgtaatggagagggccggggttggggtcgtcggcggagggcggcacggtgagggagaaggaatagtggcaggggtcgagcttcaccgaggcgacgtcgcgcgcgagcggccactggatggggtggaggagcgcgatggcggcgagggaggtgtcgccggagcggatgcggagcagcgagaggtcgccggcggcgagcgggtagctgcggtggcggtcgatgaggtggagctgcgcccccgggatccggagcaggacgtcctccgacggtggcggggcattggcgtaggcgtcgacgggggtggccggagacgccggggacatcggcgacgagggggaggaggggcctatctggacgggcgcgagatcggccatgctgagcgtggggtagagcggcggagcggagggagcagggctagggttagggttagggttagggttggaggtgttgccgtagtagcagtaggaagccatgggagcgcgccacgggggggaatatacgccgccggggacggtggaggggcggcggctcgccggcgacgtggcgcttgtatagggagagccggccgcgtacgtggcgacggagcccggtgggacccacgcggtttgggggaggtgggtcccgcatggctgtgtttaactaattgggtggttagttttcccatttatggcgatgcttctcgtcaatgacttgtggggtccgttgaaagtgttaactggtggaccatgttttcctggacccacctgtcggtgggtagctttgggtgaagagtaaccggcccacgaggaggtcacgctacccgatgccgatatcggcggagggagctgacgagaagctacgctatttatctttctgacgtgtgggcccatattggccgtcctatccacagcagctttcctccatgagtaagcaacctcgcggccatagcaacagcatccaatccatccatgcccaatgcggtaagtaatctggttaatgatctagtagtaggcttcgtttggaatatgattactacgtgtaacaacttttagttggatggaatgtatcccaataatataaatctggatataccatgtctagatttacagtaatacgttccatccaagcaaaatttactatattttgatatggagggagtagcttttttaatgtaattttcagcttccatatagttcaaattcagaaaataagctaccctttagaaccggaggactgaaaatctagctttttgcatattctcatgccagtcgcccaccaatttgttagaatcttagactgaatttgaaacagattattgacagtgacggagctaaaaatttacaaatagtaagggcctgtttggtacagttccaactcctaaatttaactccaggagttgagtctggagtggagttgtgnagctgtctaaacccagctccacaactctagttcattttgtgagagagctccacccagctccactcccagttttggtggagccgaaactgtttggctgagctccagctctagaaggggtgaagctggagctggagctgtgccaaacaggccctaaggctcaaccaacaaagtctaccgcttaattaatagaatttgttgaatcttcagactttccatgaattcttagatggatttataagggattaaggagataagcttagggcatattcaatggtagagacgagtatggtctcttgaacaatacatgattatttagagaccatgtctttacaataattaagacgataaaggctctaatcattaactcaaaaatattccgttcattaatattctttccttttttttttacccccatgcaaccatatttccatattatagtgattaagagtcgttgttaagccgttgttatgcataataacgatgttttgtctatcctctttcgctttcctccatgtcaacaagtattcctaattaacaacactaagagtccactattgataaccattgtacatgcccttagggctcaagcccatttttttgtctgggaaatgaacaaggcgcagcccgatatccactaggacttttacttgccctgatgtagttgatgcccagcccaacttcacatcatcatcacctattcacactctctaatattctgattcctgcagctttacatatatctacatccactaatcaactttcacaagcaactatctgagaaaacaaaggcctttcagcaatgcaatgctcaaagcagggtctaccatatctatcctgcatctgcatgcaaggaatatgtgccatctacttgcatgagcaacaaacaaaatgcagtgactcaggaatatatcctcctgagtcaaatccaagatgagtaatgaaaagaagaataaaggctcaaaggcaggttaggtgttgtgtgttctttctttcgcatgctttggattcgattctgcactgacggatacgtatactgatttacacatatcgcactatcatacctaaattcgttccccttttaggattcccatctcatatttagcgtcaaattcttcgatcctagatatggaaaaatagacagaaaaaaaaaacatgacaatgaaataacgaatagaactgctagttcagatcattagccccggagataagacatttcaacttcaactttactaatatgcacatattcatttagctattacgcatagcagaaaagcagtagtaatccgcctgttattgtacacgtcaaccacacgcggcaaaagtaccagctaagccaaaattaattagccgctaattaagcgcacacattaacagcaaacaataccgttaagtttggggttcagaaggtgacgaggaggtcaccactattgggctgggccgagtttgggttggagagcatgtggacgacctcgcgcatggtgggccgggccgtgctcgcctcctccacgcacgccatggccaccttgtacaggttcaccatcagcgccaccggctccggcgtcaggcggcggtcggccacggcgaggacggccgccgtgtcggagttgtccggcagctcggcggtcaccttgcggacccagtgcacgatgtccacgccgtcaccgaacccgcccacggggcggcgtccggtgatgagctccaatagcaccacaccgaagctatacacgtcgctcttctcgtccactcgcagcgtgtatgcgtactctgcaaacacaaatagtacataggattgatgaatcagttagatgatacctaacataccatttttagattatcaatcaaaaagatattagtgtaccgatcctttcccaacgcgcataactgaatgtaactacagccattagagctgcacatttgcataactgaatgtaaccacagccactagacagaattttcatttttcagggtagtgcatcacactcgaatcgtttgaaagacaggttatcctgaagctacgtacttcaccaacaacaccatttaagagtggactgacaagtcaataaggagcagatctaccatggagatacagccaagatacgaacgtgatacagctacagtagaacagtatctcctccaattatccaagagagtgccagtgtgccacacacgaggcaacaagacgacacaatatgaatgctagtactccaaaggcaggagactatccattaatccaaaggtagccaaattgccttgcctgccattgaccatacatatggctgcaagatctgcttctgtagaatccaaagaaacagagcagaaaactgaactgaccattaatcacaatcactgctacagccatgcaacggcaagaactgtagctgtaacttttgtttgctgtctgcagaaaaaaaaaagttcacactttggcccaaaggtaacatttgtcctctccccagttgaccgtgcacaaggcaacaaggattgtgctcagaggaaagcacaagctgcagtacagtactagtgcagttccagtggatggaacgtggctgcatctccatgcaggggccccctctattattgcctctacgtaaagtttacaatttttcaatgacacttcgtataatcgtatcagatcatttcaattatattagttatagttagaaccattatttattttaagcacattaaaagtttgttctttgtcatggtccagatataaagtttgttccttgtcatggttaaacagaaaaggtttgttcattcaacacatggatcagaaaaaaaaagtttgttctttcaacacatggatcaggataaacttgttgggtcttggaattcaatatttttcaaacagattcatttcggtaaatttagtactacagtactgtagtggttcgcattgaaaaagaatagtaataagaaataggctaaaaataatatggagaaattattttgggtggttacctggcgcgatgtagccgtaggagccagcaatggcggacatgcactcggaggtggcgccgccgaggaacttggcgaggccgaagtcggcgacgtgcgcctcgaaggcggagtcgaggaggatgttgttggacttgacgtcgcggtggatgatcctcggggcgcagtcatggtggaggtagcagaggccgcacgccgccttcgccgccacccgcgccctcgcctcccacccgaggtgcccccccttcccgccatggagcatctcccccagcgacccattcggcatgtactcgtacagcagcaggttcgtctccctgttcgacacgaaccccagcagcctcacgatgttccggtgcctgatcctccccagcgtcgtcacctccgccgagaacccccggtcgtgctcgccgccgccgcgccccaccaaccgcttgatcgccagctccgccccgcgcgtcacgccgtggtacacgatccccgcgccgcccttcccgatgatgttgtcctccttcacgcactccaccacgtcctccgccgagaactccagcttctggaacgccgtcatcttccacgcccccgaccgccgccgcgccgccgaccgccacgccgagcaccccttcctcgcgcccaggaacgccaccgccaccgccgcgaacgccgccaccagcgccaccagcatcttcttcgagtcccaccgcagccgcagctgggaccccgcgccgccgccgccgccggccatggacggagggcacgcgtcggccacggggccgccgcacagccccgggttgccgacgaacgagctctcgttgaacaccaagaactgcccctgcatcggcacggggcccgagaggctgttgtacgacacgtcgagcgtcgtgaggctcgtcatgttggacatctccggcgggagctcgccggtgagcctgttcctggacacgttcagcgtgcacagtatcttgagcgacgtgatgctctccggtatctcgccggagaagccgttacggctgaggtcgacggcggcgagggaggcgcagcggatgagctcgtctggaatggcgccggtgagcgcgttgccgctgacgttgagcctggacaggttcttgagattgccgatctccggtggcagcgctccggagaagttgttggactccagcgacagcgtctgcagcgccgggaggttgccgatggccggagggatgcggccaccgatcccattgttccccagcagcagcatgccgatcttgtcgccgccgatcacgtccgggagctcgccggtgagcaggttgtcggtgagctccaccatgttggcctgcgggaggttgaagagcccggcgggaaccgggccggtcaagaagttcttggcgaggcggacgcgcgtgagcgtcttgcagtcgccgagcgagtccgggatggggccgaacaggccgttctccatgagcacgagcatctccagccgccggccggcgcagaggtccgccgggatggggccggtgaggtggttggtggccaggtcgagcgtcttgaggcggccgttcttcccgagcccggcggggatgttgccggtgaggttgttgtcccacagctgcagcacctcgagctgcgcgaagccggcgacgaagtccggtatgctgccgcggaggtggttccggaagaggttgaggagcttgaggttggagaggttggcgaggctgggagggatctcgccggcgaggtcgttgacggagaggtcgagcgacgcgaggctgctgagatcgccgagctgcggcggtatctcgccggagaggcggttccactgcaggaagagcgtgtcgaggcgctggagtcggccgagctccggcgggacggggccggtgaggttgcagctgctcatgtcgaggcggaggagcgcgccgaggtcgccgaactccggcgggacgccgccgtcgtactggttgtagtatccgatgtacatctcgcggaggcgggtgaggcgggagagggagacggggacatggccggagagcgtgttgccgttgagtccaaggtactcgagcgcggcgaggtcgccatagctgtccgggattgcgccggtgaagtagttgccgccgaggtggaggtagcggaggcgagcgtgtgaagcggagaagggaggaagcaaccctgagaggttgttgttgtaagcgtcgatgagctcgagcgaggggaagtagggggaggcgccaccgccggagtcggggacggggaagtggccggaaaggttgttgttggagaggttgaggtggcggagagaggggagggtggggagctcgagggggacgtggccggggaggcagcaggcggcgatggtgaggttggcgagggagtcaaggagggcgatctcgggcgggaggtacccggagtggagcgggagggcggtgaggttgatggcgacgacgcgggagcggccgtcgcaggtgacgccggagaaggtgcagtgcgcgggggaggtcgcggccgggtcccagtcggcgaacggcggtggggcggtgccggagggggatggaacgagcgccgccttgagcttggcgagcgcgtagatgtcgcggtcgggggaggcgagggagggtgggaggaggaggaggaggaggaggagagtaggaggcattgtgaaatgcgatggtgagagggggaggggaagaaggcggggtggtggcgggaataaaaggaaggcgggcgcgcggcctgcaggctgcaaggaatggagcagaagcagaagcagaagcagaagctgtgggagtcactgacggcgttaggttggcgtggtcaatgcggcatgtacagataccagaggacgacgacgacgaggcggagactgacagaccgggcgcggagacgatgggacgggacgagatggccggagacgtgtgtggcagacacacacacacacagagccttcccttcttcccttcctccattgattgatcgcgggctgctgggctgctgccaccaggggcggctactagcctttctgctgtttaccaggagtacgtttgaactagtaggggtgtatagttcataccaaaattaaaagtttagttgaaattaaaacaatgtgatgaaaaatttgaaagtttatgtatataggtaagtttttatgtgatggaaaagttgaaagtttgaagaaaaactttggatctaaacttggcttagtattagtctagcacggagatcatcttcgcccttggttaggtggtgtttggatctagggatttaacttcagtctatgtatttagacactaattcatagtgttaaatatagactatttacaaaactaattacataaaatgaaagataatttgcgagacaaattttttaagcttaattaatctataattagagaatgtttactgtagcatcacataggctaactatggattaattaggctcaatagattcgtctcgtgaattagtctaagattatggatggtttttattaatagtctacgtttaatatttataattagtgtccaaacatccgatgttatagggacttaaaagttttagtcccatctaaatagggtctagtttccaactttttcttcagactttcaaatttttcatcacatcaaaactttcctacacacataagctttcaattttaatcaaactttattaaactttcgtttgattttgagcaaatttttagctaaaccgaaattgtttggtcaaaactatcagggtcttttttttaatttgaggaaaaacaaaaggattgaagatcctggggattaccgactacaggagtcgatcgtaggaaacctggtttagtttccaactttttaaaaaaaatttctaacttttatatcacatcaaaactttcttacacatataaacttttaacttttctgtcacaccgttctaatttcaaccaaacttctaattttgacgtgaattaaacacaccccaaattttcatatccaacccatagaaaaaaaaataccaactcactctaaactgttttcttttttccttcgagttggaacgagacaaccaattcatcgagcaaccataataaccagatcaaaagaattaaaagtatacttcctccttcactaatatatggtgttggttagttcatttttgaattaaaatgaaatgtgggaggacttatttttcactaattttacttaaaatatacaggtttaaaaagaatggattgttgtcttcaaaagcgcgcgaattggctctcccctagcaagcgagttcgcaatgccatcctacgaactttacacgagcaattcaatcgtatttacgtgttcttttttctgtttctatgtgttttataatcacgtgtttcaatggaaccctaacttttgctatggagtacaaatttaactaggtgtttcacaaaactgcattaatagcaaaaaattttatcccttacgtgtagatgacatgtgggcttgttttacaacgacttgggtatttgttgggttgggttggtaacttaggcatgaacttatctgagaaataaaaattacagctttttataaatttatatgctactgtagttatctttttataaagatgcatactacagtttttaaaaggaaaaatagtttttaaaattgaatgtgcttcttggtactggcaagcctttctgtcgccctgccacaaaagttgtggcttgtctagcttgtggatcatccaacggccagcaacgtaccagcaccaatccgtcagcggtccagcttaactgacacggtactacgtacaactccctgcaactcgtgtgatccggatctcatctcactgcactgcactgtcaatggcgattttctgctgtccaaaacaattctgaaaccgctttccttttctttttcttctagaactgtaatccaactccctggagtagtattgaattacaactccacacatattgaaatggacatatccggacaagtttggattgtgatccattgaaaaggtactagtaggacacaatttaagatgaggaaaaatatggaaattttggaggatttcaattctataggaaaattttctttgaagccctttaaaacaaaaggattgaatcatatccaatcctttaaaattcctatggaatgagtaattttatagagattttggagaaaatttagcaagagcttcaacctcttggtaacttttctttgagtctatctctcttatccaattcctatgtttttcttgcagttcaatcaaacgattattgatgtgtttttcctcctgcgttttacgatcctctattttcctatcaaaattgtacgttttttttttctgttcataagttttttcaatcgtgccattcaaagggcccttatatctgaactcaatgcatggtttgctttgccactggcactggaactgtagcctactccaagcatcagcagaaagggaagggaagcaaggctaatcaagtcgtcttctttccgagcaaggcctggtttagttctaaattttttcttcaaacttttaatttttctatcatattaaaatttttctacacatataaatttttaatttttttatcacattatttcaattttaaccaaacttttaattttagcatgaactagtagtagtacagcaccatctgcagctgcagccagtgttcatgtgtgctactgctacagctaacaggcagcagctgtgctgtgctgtgctgtgctacggctgctgctactcgcctgcctctggtcgtctatcatctgcccatcaactgattgatgctcaagtcttcgcgtaaagccaaagcaagaagctcacacaaaagcctctccagtacactctgctcatcactcgtcagggtgctcgatctctgctggaagatttgcttgggcatttgaatgcttttggacaagtcaagtgaagtactatatatctcccctattccaatataaggccgtgtttagtttttccgtattctcaactttccaccacatcatattacatcaaaaactttcctacacacataaacttttaatttttttttcaaactcataactttttataaagtttcaacttttttttaagaactaaacacaccctaagtgcagttgtaaatttttatatttttgcaacccagtattttcaaaacatgaaacgaaacgtagacctcgagcgtcttgacatttttaaatccgatggatagaaaataccgaaaaacctacatgaacgactgtttggatagaacgcgagaaaacattagaattagaattttaggaaaacataaatcaaaagagagatcctagacgtaaagaattttttttcaaaagattaaatcttatattattgaaaatccaatccttcaaaattcctgttacaaaaaaagcaatagcttgttcagctctcttgttgttcaaggcgttttggtctatggcatcggcagtaacagcgacgagtcttaatgacaaaataggcacatatcgactagtagctagtctctgttggctggcacctgatgctgcctaacctgtctgccaacattacaattttgttggcgttgacacttgagtttactaccagtagtatcaacaataaagtggactaatacagagataaagcgaagagaaaacaacaaactaaaagtaattagaatctactactactccacttcactatggaatcaattatcagtgaagagcacaaagtccagcttcatgacatgtcagggcatccacacacggtcgacagcataatgctaccgcccactaaactagacttacctgcatgattaatcattcaataatcagatcagtggaggaaagaaagaaagaaagaaagcagtagttctaatggcagtggtagagagtagagaggtgtaggttgatgataaggattggctgcacgtacagcagcatctcacaacagaaactgagaaaagagagagagagtttaccatcaagaacatatatattccattaacctgctctttttttgtgttttgtcatttaacaagcagtgttaggagatgttctagctactccagcccctacaagtgtcaatcagtgtgtgcaagatcgatccacaggacaagaaagctagagctgcagccagtacacgaaaaggctcgatatctcaccacgagcgaaccttcagttgctttaaaattctttttatcatgcatggtgccggcctggttaaattagtggaggaatagaatcacactaagttagatgtttaatcgcaagaaaatggcgtccatccatgcccgacctgacctgacctgggggtggtgaatggaatggaaagaaagcctagctactagtactagtgattccatgggtgacacagaatcgatgcgagtcttgtctgaatccttcgctttgctctgcatttcattgttaggcaggatgcagaggaagaagaagaagagggctccttgtcaatgtcaactcctccctcttcttttaactttttttttgctttgcatcttgtcgccaactcaattcgccatggccgatgacgacgatgaccaagatgaggtgaggcccattcacttagcgggccgaaacacgggccggcccagcacgagaatcaaagcagagacagaccgagctgtgccctagcacaaagccggccgccgccgccgcgcgctcgtctcgttcgcctctcctctgcgtcgccgccgccgtcccgacgattcaaggtatcctactctccctattactctggttcggtagaattaatcttggtggtcagcacttggttggttggtcgaatatgaattagcgtatgagcagctaacctttttgattcatgtggtgcccaattgtttcttgtgaaatcgcaagaaaaaaatatttgtttcttgtgatgtatagggttcgttcctctggttgatttgatttggttatggcaaacggcagcttctgcaaagaattttactactcttgtcctgtttgtgcaagcttaaggcttctgtgtaactgtatagaatgcaacaacagtgtgttcttttgggaagatttggtcgtaatgtgagaggtcaatgggtcatagctctgcatcactctagatcaagtttggtgaatctttatcggacattttacctgtcaagaagtgtgtaagaagaacaactaagaaaggcaatcaccttctttgcactagaactgataggcaagatagaactcatttaactgtagctgcaaaacatcagaactttaactcgtgtgtttttaaattccatggacaatggtctgcttgtactaggatcttaaatagaaacgtctgattctacatatcttcacaaaatgcttagtacttgctgctctcaagcacttaattatgttcaacccttcttttgccactgctgctggtttcacaccttccaattgttgcgatgatttccctatctatattacacatacaaattccagcaaaacctgttctcacattcagctgcgaattatgttggcaggttcaagagtcgatggaagaccaaacagctgctgcagcaggtcttgattcaagagtgaaagccagcttggttcttggaacagaatcatttgcaatcagttcagagtccggtattctatcggagcagctggctgctatgaaggagaagagcatggagatcctgaagggctacatcaccaagcataatgctcccgctgatgtccctgatgaacccatcgagggattatctgatgatgaaggagacgcacctgctaagaacccaccaaagaaacctaagaagcagaagtgatcatccaattgtaatggaaaaggttgatctggaaaagatgtgatcgtcctatcgttggattcatgatgcttagaatttgtaagaaattagctgctcgtacaatagtttgctcaaaggctgaacacactgtatttctccagctagatgcagatctgcccattaacttgtatgagtaagatatatcaacttgaggggtacatgtaaactgcagcataagaaattctggcaattgcatatgctatcatgagtattcaatcacttgttcgagctcctcagcaaaattctgagcccagcgaccaacacaggcctgagttacagacttacggcctgatttggccgttcagtcaagtaggaaattatagtatataaaggtaaggtttaaagaaagcaaaagggcagataacattcttccttccgcacagcagatttgttttggcgttttttagttatctgtacattcaacagagcgaactgtgctagaatacttttaggaatcacattcttttcctacatcaggtgtacaccgagtgctaaagctctgtttcttggtcttgtaaaagaaaaaaaaatcctcaaagcatcttccttgttaagtttaacttgttcatcatcttggtgtagtcctggtcactcgttgaagatatggagagcacaaggacctactgattaagaacattttggcccctcccttcggagtatgaaacaagggaagctagctttataatcagttccaattctgtatctgcagtcttgccccttgatcagagtgcagaagtcagataaaaaggcaggcataccatttcctcggcaacattttcgtggatttctgccttgcactaatcacaaatgcgggcaacaccgccaccactattaccattacttgccagtgtaacctgatgaagttcattgagtacctcagtaaaatcatctggtggggggcatgagaattcaaggatctttcctgagtgaggatgcttaaatctgaaaaaggaacaatgtcacactcaaatggcagaaaaatatgaatcgaaatgcatttgggataatacctacccaagcaacgcggcatggagacatggcctgtctatctttgatatcatatttgaaagatcacaatgatatcttgaaggagttctgggtctcaaaagtgacaatgccatgcttttggtacctccgtatgtttcatccccaagaaggggaatccctaggtactttgcatgtgctcgaatctaaaaatttaaagttgcatgttcatcaataagataaaaaaaggtatccttgaatagaattttccaatattaaggagtactatagcatatatagatcaaatttcaactgttgctcataatcctttgtacctctatttcaagccatacaatagatatgtaaccaagcactacctatgcaagatgcaaattttcttaataaaataaaataatatgaaagtattttactaaggattggtgcatcctttcttaaagaactgggatattgtggggggtctaataacctggtgagttcgtcctgtctccaatctccactctactagtgctgatccaccaccagcaaagacctctcttactttatacctgtagaatctcttgagattagaaggccatctactaagaactaacatagctacttgacagatttttatttaaaagccaagctcttgtataaaaataagattgtcgccatatctacaaatataatcacctaccagtatgaagtgctaacctaatttctgtgatcagttgaaattcatattttttcaaattcaggctgtaaccagtaaagctagtgtatacaaggaaccccctctcttttttttttctttttctttttcgaaattcaggtggttatgactggagttaacacatctgctatatttgaaatgttttgacccaattttccctttatcattccttagtcctagcattaactggggggcaaagaaaagttgaacctttatgtttcctgtaatccatacacagctcaacataatagacatctccacgtaaataacactgctcctagtggcataacttctaaagtttgatgcttgattagttagctatttagcttagtcagttcttgagattaattatattcaagcaaattaaaagggaaaagtgaaaaagcattaaatcccctactagcggcatgtcgtgcatatctatggcctgatccaggagtggcaatcatacggatccggttgttaggatcacgagctataggaacttcaatcctgccagaattcggattcggtgcaccacaagtaagactgatgtacactctgcgtattgtatgcagcttgaattgttctgctaattgtgcatgagaatgctcatcctgttaacaaggggagagtacaaaaggtcttaatgctaacttggtagcaataaaagaatctacattcaatgcagtaacccttgaaattccataaattatgtgctagtttacaaaaggaaaagagtgttctgttttgggttagaacaaaccagtcagtaccttggctacaacaagtagtccacttgtacccttatcaagcctatgcacgataccaggacgcacaagagcttcacggacttctgaacttacttcgccagtagtaaattgatcgatgtcaaacacatcaatatcatcatctgaagaatcagggcattcatcatcaattgaattacgtgctaaacaggtaaatgttgaaatcttgcagtggtgaagtatagcattgactaaggtgccatttgcatttcctggtgctgggtgaacaacctaaaagtcacaacaaacaaatatcaccatgcaggaacaactgtttcgtccatgaattgaaaattcaaaacaagagtttaaggattaaagtgaaaatgcatcgataaagaaagacaggatgtaggagcaaccccaaaaaaatctcttattggttgtaaaggcatattatcagcaaatatacaagactagaatatacaactctaaatatttgcagctgtgacttgtgggacctgcaattgctggaatggtaagactgtttctcatagaagaaagcagactagagggctccagagtcgtgtaaagtacagcttctgattgatgctcggagcaaagcaaacaaaatgccaaagacatcaagcaacaaactagcagaagctgtcaccttaatggcttgttttgtttagaaatggtgattggtgagatagaatgtgcaacctctagcccttgtggcagtgcttttgaatgttttttttggtggtgtggctccactcagttttatttcgactgagcaattcattagaatgaaagagtttaatgtcctttagagtctttaaaaaacctattcagacaagtgttgctttggcatccagagaaaataagaaccaggaaaccaaagcttgctccagtatcactgaaattctgcaaatatggcaaaaatcaaatgttagaaaaaatggcgcataccatatgagccggtttgttcacaacgagaagatggtcatcctcataaacaatgtccagtgggatgtcctctggctctgctctcagtggctgcagctccaacaccgtgcagctgacaatgtctccaccttttaccatatgtgaaacctacatttcgcaatgaatagaaaatcggcttaagaatactatcaatgagaaccaaacagatagttattgacatgtagttacaactgctactacttcatggtctgatatttgcaattggaaagatttgtgccatgttctgtacaaatctttactctacgggagatagagaacaataactctaggaaatttactttgggccacctttaattgctggtgtttcgctttggaccatccttcaacaaatgtttttattttggaccggataattttacctttgtggcacttttgactaccctcaactcttttatccatctacatctaatttgttgtatgccaattgtcaaagaaatggactacatacagctcagcgagtttattgacgaacaggagccggcgtactcaaggtcattcatatgcttgagaagagagtcgaggtgctctaaagtgaaacaaatgcaaagattacacggcgcaatgtgaaaatatcggttaaagagtggtccaaagcgaaacatcggtaagaaaagatggccaaaagtgaaatttacttgtaactaacctaacaatatagtgatctttgctctaaaaaacatctttactgtacggtcttcagaatgagaacacaaacttaggttgagttaagacagcaaattagcaactataaattgtaatttgctcaagacatcgcttattgttgaactaatagaaagatgaaagcttaactggaagcaaatgaggtttcggggaaatcgtgtcaccttggagacgggacggccattgacgacgacgaggccggcgcggatgctcgcctggatacgcgcgcggctgacgcctccgcccccgagcctcgcggagatccacgcgtcgatcctcgagcgcccctcgccggccggcacggcctcctcaaggcgcgtcccaccgtggcctcccctccggctcggcgccaccgcctcagcattcgcgtcggcggcgaggcatctggcgtgcgatgcccccacgcaacggctgcttctcctcctctgtcgccgcagcagggcggagagcgcggtcgcgatcgccggcggcgacgccgccgccgtggttgccatgggagatgggagggggaagtgaagtgggcgaggtggataatgttttggttaatgggccacatttagtttgaaatgggccgggccggcctccatttaccccccacacaaaaagggccggagctctcttttttttttctttttcttttcattttttaaaaaacaacaatacatgctgcagtctaaccatggaatggctacaaaataaaattgcgctattcctttttttatgtgatggcatgggagaaagagacgtcaacaaatacacatgcacaccacacctcacacacctataaatggaataattaattatctgacattcatacgagtggtgataaaaaatttatcattggacccatatattatagaaagcgagtgttaaataattaattgtcacgtcttaaaataggtaaaaagttaaatgtccccctgtaaaagtaccttactataacacacgctcgtataaacggagtcatggagagaccaacgataaattcccggcagatccatttaaaagtggagtcatggagagaccaacaatagattcccggcagatcctattaaaaatgtgctattctggattgtaagggatatgattttctagtgcacatttatggtgctaaataaaaagcaaacaatttgtcagttttttggtgggctgaatttaaaactcgatattttatatacatattaaatgtgaactagtaataaattagatgtatttcatgttgatttaggtgccgtagaaaattgattactccaacataagcacaaccaaaattaaaaacaattgcatagtccaagttgtcaacacccatgtatttattctagtatagtatatctacacactatggttatgaatgacttgtgcaccctcctgattctcttgttaggcatcaatcacaccatgatactgctgtgacatttaatttgtagtgatccattttggaaaagaaaattgataattaaaataaatgtgatggggcccacaagaagcattaggacggtggccccctcaccataactggctggctctgatgtaaatggaaaacttagtgcttggcactgtggatatatgaattggccatgctttcttttatgggacaatagtggatgtgatctctcaaagatatatttttttctaaaaaaattatatacacggtaattaagtctcagaactttataattattattttctatattcttatggaatttattttttctagtgatcattaatttcttcagatgtttttttaaatgtaaattgactactgtaaatgtaaacatatatacaactgaatttataaccgatttaactacgtgatccatcacttattgcatgtgatatttctttatgttattttgagaggcagattgcacgtgacgtgatttttaattcatatacgtgaataattcacgcaccactcgtacgttctgatctttatttatttcagttcacggggtgtgcgtaatgggtgggtcaaatcatagttctcattgatcccacatattaaaacataagcatattaatttatttatgttttttcaggcaaagaaaatgataagaaagttttacgccagcctagctgttcagtactacgtactcctactagatattttagcttaagataaaaggagattttacaagatgataattagaacctctctgttgagacaacttttacccaaaaaaaaaagtgtcgtttgaccgcatatatatgacctgtgctgtcagatactcaaacagaaactttaatttggggagttgcacagtaaaactaattatcaacggccatttcaagcaatagttgattgtgatattctttaaatatggtcaaaattgacggcgtagctggttgcctaactctggttgaagggttttagccatcatcgaattaaagtagttagttctttttcctactaaaacgcatgctaaaaaaacagggctcaaatggcaataaatacatgatgctcactaaattctattaaaaagctagcataatctcgtgtttaatacatatatatgaactaaaatttaatttttaagggatgaagtagcgcactcacgacgtcatctctgtatctttattgtgtttttaccggtagtacttaattagttgcattctgttaaaaagaatttttttttcttttttgtggggaagagagaatatgttaatttggattttgcagttttcacacgctagctagcagcagcttttacttaaaaacagcagcaatttgaaaccttcgttgatcgaactgcctatatctaatatgtaaattagccatggttcttttaagcacaaattttacttattttctgagaagtttacaagtattttattctgaagtttatgacaaattattcagttcttcgagtgtgtgttaatgcccccttgagttgctgtatagaaaaccattattagaaaaacgattttcgaccataggacccatttcactatacaggaactctaaaaacccgcctgtataggggtgtgcgagaggatttgaatatttgatggtcgaccgcttatgaagattcattatcatatacgatcacttaagaggtttatatgcgaactgcgaacgtagatatgtatgctatatattgtgttgtggatttgggaactttgggattttgtgtgtgtggatttgtgaattactgtgaatgtgaattggagttgagtctgggaagctgtcgccgctgagaaacgacgtctgtggaattttttttcgccgaaaatgtgtatttcaggcggatggctcaacttggccgtctacgaaaatcatgcaaaaatagattttttaaggagtgaaccctacgtgtacatccaagatctgggtttgcacagtgcatgtgcccacaaggatatcgatctcactgtgtgagcaactgcgtgtacatatgtgtaccccagttgccgacaatgcaatgtactggctactaaaacacgcgatgccacagtaaacagtgtcattatttatgctgtagttataaacagtgtcattattggatctatcaatttgagaagtattctttttatgctagtagtcgatcgcataaaaaaatgtcatgtcaaaatttatgctagtatggataaaaatagcatcattattggatctatcaaactgagaagtattttttttctaagaaattataaacatgtacttattaaaaaagaaggaacatatactatgaacacataatcttatggtacacactccgtacacaccaactaacaaagttcacccaagtttataaaaaaaaagtagtgcacatattttcaataatattacacccatatggaaattttggcctaaaaatgacaattatgacatatagttttaaaactatcactttttatagctaaaatataatgaatttgaagttgatactttatagatatatgcaatactgctgttggaaatacgtgtatgcttgttagttggtgtgtatagaatacggtcctataaaaacatattctctttttaaaatgcttgggcaataaactggcgatggatttaatatcttacatgtggtacatgtggacaggtcactctagatatatacatcattgcaattttctgatcaatttacgttgtgctggtagtactatatgtattatgtatactatatgcctatatacacgggtggagaaacccttttcagtcccagtttgcaactcctttagtcccaggttgtaaatcgggaccgcgaatctggaactaaagatgggtatctttagtcccaggtgaaataactgggactaatttcacctgggactaaatataaatctttggtccagttggtgttttcaaccgggactaaaaagtttttttccattgttttctgctttttgcatattgattttaaaccgaactcaacaaaaaaaatcatctacattcacaaaatcatccataaattcatagaatgaacatagtcaaattcacatcacaaatttataaatccatatacatcacctacaaatcaagaaattcacatagaaatcaataaaacag

SEQ ID NO: 6920 - DNA, 14599 bp, Oryza sativa
aaaagaaccatattacttatcaaatgagaccattagatccgttatgaaagaaatatattttcatagatattggttttatgtgtaggtagatatagaattatcttattttaagaagcccctttcgaacctgctaagatgaagattaaatactattagcgtatgattaattgacttttatttattttaaattttaaaatatatctatttgatattttaaaataatttatatttattaatttttttatataagtacactgtttagccatttaaaaacgtgataattaacagaaaccaggataaatctgtaccttaattaatcaacagaacctagacgatcacaaagtctttgaaaaaggagggaataaagttatactactcttgattatatttctgttaggataaggttacacttgagtattatatcatctagctaggagtactagattaggttctccaacagggccatacgatcgaaaataatgagaacagaccggcgagcgagcgatcgaacggacctgcacacacgatggatgctcatttatacgcatatacacatggaaactattttaaactcttgagattcccttgtttatataaaaattagctaaatagttatgaaaaattttgaaaaaaaatgaacgttcatataacatatatgtaccactccacaaaaatttagatccaaactcaactcacatattgagatatataaaaaaacaaattcggatataaatagtagtggtataatttacccaaatttatctttttttttctcaatatacagatcaaatttgaaattaagtgttactcctagatgtcactacccactatactctaaattcacattttttttctattttttttctaaaactatttgcattgaatttgaaaaaggagatacacaaggggacatcccttaagggatatattagaatacacctgcataatacgagtacattccttaagtactaaaaccggattaatgaatcaataatcttgatgcatatatgtatatgtgcatgttaattaattggcaacagcaaagataggcatctcgtccctatcacaattcatcgatcacacgtacctgatcgagccccacgtcgtacagtgctgtagctcagtcaatatcagatcgaccgcccggtcggtcgcttcaaaccagtgttatgtacgtacatacgtatatgcaatgcatatacgtgatctcactcctacgcgtatacatacgcgtgctagctagctggagtagttcaacggcagagcagtgctaacttgaatgaattccttattgcatatatgtgatgagatgatgactgttaggagcttgtatggcttcgtccttgggcattatatgaattgttgcggtgatcattaagggtcaaatggagcttgtatgtcagagttggtaaacaatggttatatataaatttttgtcaaccatgaatgtggaggttcagtataataggattaggttccagtttaaatttctctatgtatatttgttcttttttactttttttttggaggaggggggcagtggtctttctggcagttgtgttgtgtatttgaaactctactttcttctaatatattgacgtgtaatccttttatgtgtttggagaaaaaaattattcttctggtattagagtacttcttgccgtatcttgtaatatatactttataaaccatctataatctaaaatgacacaaaaacaagtaataacatgatatacatctaaacttatgaagtaaattaaacaacaagaacaaaacaaaattctaacctattttttggactaaataaatgcaaaaatgagaagagcaaggtcttaccctaaaccctagtcacgataagataaagtatagctgcgtgggagtcgaacatgagacaatgacattctgccgactggattggttgatgatgggcatctggccgaactggggcttaggcggtctcacaaccggtctaggctcttcagccagccttgagttcagcccaagtagtaaataaatgtatcaatggatcctcgcaaaaaaaaagtatcaatagaataacggtttgatattgaaacaaaaatactcctcgtaaatttttttatatttggcactattgatgttttaacataaatttgaccattcattttattattaaaaatatgtaattatcatttaatttatcgtgatttattttaaaaaaattaaataagataaataatggacaatgtagtaaaaaaaatgaaaggaaatatcaatgtaggacagtacagtaaaggtacgtcggtcggtcggtgcagagtataaagcaaggagcgaaaatatctgtgtggcttcgtacctgcaggggacgggcttctgccgtgtctggacacgatgggcctcccctgcattgcatgatttatttatttattgatccattaaattttaccccactcttccacttgctatttatattaatttactccaatttatatactccacgacaggagcgagctgagaaccctaattactactgcatccgttccagaaaaaaaaataattttacatcgttcatcttcaacatttgatcattcttttatttaaaaaaaattatgattaatattttctattgtagatgatgaaatataaagggtactttatgtgtcaataatttttaaaaaaaattataaattttttaaataatacggacgactaattgttggatataaaacttacaactacatttaaaatgtgggggaggtagtacttaattactgcccggaagatccacgatgcacattgcgaatatctagctattccagctgatgaatgcgtgatacatattgtatctgatgagactgttgagtgatgaagctgaagctagctgatgccgatgctgatgctgagcaatctccaatctccccacggggagagattagcccaaccaaacctaaccatgctcttcttcttctcctcctcgtcgatgagtatttagtccatctccttaaatgcagcggtgcgagttagttggcgccataaattccttcacttcaatttcttcctagctcagctttcccctcttctccttctcctcctactacccaatacgactactactagttttctttcttggccatcatcatttgttcctcatcttactctagcttctccattccaaaattcaccaccgccggcgccgccatctccattccaaaatttgctctgcgtcgagtcgtgtgatcgatcgatcgatcgaggtgtacgtgtgcgctgctggggaaaagggaaatggatccgtcgggcgccttcttccacgcggctccccggagcggctcgaatgtgtcgctggcgtcgctggcgaggacggccggagggaggaggatgatgcacagggtcttccgcggcgtcatcaccttcatcttcgccataggtcgctaattaatctctctcttgctattcaatttgcttcttctgaatcttctttccaatctcccttgtttgctttctgctgcctgctctgatagcctgatctacaccgtcttggtgtgggtctgtgtgatccagcttcatttctgcttaatttcatcttgtttatgtgtttcagtgtctcgcatgcatatatatatggcacgagctacttcagatatatattttcccctttttctttttcttgccctccttttcttgtcctgcttcatttccatttcttggtccaagaagaaaaattaagggggacattttttatgcatgtttcatcaccaatactcaactcattttcacattttcccttttcaattcccttctatgatgggttctctctttctttgtggatgaatctgtgtgaagagagaggacatgacatccatgcatcggctgatggagctcaagctgctcaatcagcgctttgtatcatcttggtgtatttgagtcttaataaagcttccattatcttaaaaaaatcagcactttgtatggatggattttacagtgctcaatcttcagagcactgtctgtatttcctttttcaaggcagcatatactgatacttgcttaattggttctcccaacgaaaatacagattttttttgtcggcactgttaatttgcatactgttttatttccttctgagcaagtgcaaagtaatagatactaatattgtttggtcatatacgtgcagaatgggttcttgcacagcttaaaaccacaacttcttttctctgaacaatgcttttcagagtgtgacatttgtctcgttttttttttgttcaatcttgaagcctgaatcttgaaccggaaagctgtggtggtagctatgaatgttaattaacatggatgtgtttgtgtgtgtgcagctggactgtttcttggagcggtgactggcgggctgatcgggctggccaccgagagcggcctcttccgcggcaccggcatcggcgccatcaccggcgccctcgtctccatcgaggtcgtcgactcctccatccgcgtctggcgatcccgccgatccgggatctccagcatctgctatgtggtaagaacgaacacacacatttcttcttcatcatgccgacaggtatagtagattagtagtagctttggagtaggagagcaacctcatagctgcacgcttgcttgcttgcttacctcaactactgaacttccttgtctgtaccagtcatcagtgtgtgttgcttaatttatttatatgaactagtacttgcttaattcatataacctgtttgtgtttattttaaaacaaagggtcaaagctaactgcctcttttatgagatgatacaacttgtcaaaccttgctgtcttgaaagttcagatgattatttcgtacaaaaaagaatagttcagatgatgttttccaaagcaatttgtgcattctttacaatctaattaacctgctcatgtattctcagtaccacttttaggggggggggggggggggaagctccctaggtagattgtgcaacaaatatctgcacaaacgggatctctgaacatctcttctgcttcatctgtcatatatacgtgctcacagccttacattttgctaatttttttttgttggcttgttaaacctaacacaaatctctctgcacaaaatgcagcttaatgtgatctacagcctcctgaccggcaggcttgtccgcgagaaggtcgatccggcggtgcagcgggtggtccggagccaggtcagtttggtcgtctcatgaatctgcccctgcatacatggttgcgtctgattcagaaatatgcagtagcagcttcagttacagatttgtctgacgagattgcctctgaattcagatgaatgcagtggattcatcgcccttcagggagtcccctgacctgttcgagatcgagggcaccaacggcatgccacgggcatccatcgacaagctcccggaggtcaggatcactgaggagtacaggaggaacgccattggtgacctctcgggatgttcagtttgcctccaggtctgaaacttttaccatttctcaaactcactgtacctaaattgaacatctctgcattattgcttgcacattaccttgcaaccaattgatgagagtacattgcatccatatttaatttatcactgtctcgtatcaaaaccgtgtgcttctcattgatgtgccagatctttgcatgaattctcactgattactgaatcctgtgaattctgaaacatttggctcctcttactactgcaggatttccagacaggtgagaaggtgaggagcttgccggattgctggcacgtgttccatgtgccgtgcatcgacggctggttgatcaagcatggatcctgcccgttgtgccggaggaagctgtgagatcgacgacgacgacggccatggtgatcactgctatagttgtagcagaaggaggaggaggctgctctgctttcttgctgtgtgctgcgatcgagttgtccatcagtgttgctgttcttagagaagaagactgacatctctctctctctctatatatatagaaaacccttaatctatagagcattttgtttctgcttatattgctacatgctctatctttttggttgaactatctacatatatatctatatttctatctactcactcctttctccttatgtaacatacctctcaaaactctgaactggcttgtgctgatcatctgatgtataatatataatatataaatatatatcgccccttggacaccatcgcatatcaatctcctggatatacttggtagactggcttaaatcatttctgctcttctgggtcattacagcttgattataattggataattatcaaagagctgagtagctgacacagtttttgcattgagctgtcccagtccagagtctacttcgaagtttagaacaccagtatcactgcatctgcatatgcctgatgcgaggaaagccaataaatatggatctgatgagcatgccatgcagaaaggataagatacagacggcacgcatgcatgcccacatacacgtgctgtatcaatcaagagaacatcatccaaatatccaaaccaaaatgcaaaggatcaacatcatcatcaatgaccagtgccacactgcacaagttaaagaggcacagcggatgagatctggttcagttcaggtacccttgttgagagttggcagagttcttgctgtatccaaagtgaatcttccccaaggggaaagcaacaatttacacggtggtcaataaataagagtgcatgtacaagtcaaaaatatagtagtagtatacataaggtccacaacatcagctaattaagttactccttttttggcttattatttcatatgcactggtgttaaaattcctgcggcggaacaagacttttgctttttcggctggaaagattgagctttccatggagcatcagcagcacaacacaattgaacagctagctattctttttaagtcgatcttgaaacatacattactatgatgctgggattaaagagctggagaagagcttctgtgtctctccatttttttttacatcatggagggaatgatcttggccgaaatgaccggcttttactttaccacaggggaagaaaaccttcttcagtcaggtgtgttgcctccaccatgcattcagggtcacatttgagatgcataaggtgcaagtgtgttgctgcgcagattcacgccgccgccttttaaagaaacagaagggcccctgtaggtgctcgccctgctgacaaggctggagtcgaggaagactactatgacggttatgtcatcatggaagtggcggcgaacaccacggtcaatcttcttgagatctgagtacctcatttctcttttcttggctgcttcttgcaaagctgcctttatgagcctcctagcacttccctgaaagatcaaagagcacaaatcatcagattctttcacttcacaatcaacacttagcgtgtccattttgttttcatgcatgttgccttccactgagggctgaacaataacaaggtaaatgatgctaagcttctgtgccagcaagtagctacaaatttcagctctacttgatcatagatttatatatccacatgagtctattttctattgtatatgcagccatgccaggactatgtacataaaccaatgccatgcaacaaattgttgtactgaagggaaccatccatattcatattttgtattgctgttttggtgacaggctaatatttcattccaagaggcaatattgcttaagctatgtgcatgggtttttctgaaaccttcagaataacatcttgggcttttacgcaatttagtcttaatgctgctatacaaaaggattttggattggctgcaataagaaatcatgtcactgagactacaaaatttattagctatgtggtagtaactcaaggaaatatggtagtagtaaactaccactaattcttatgttggcatttggcaatatatgtcaaccaatgacatgcatggttgcaatggaaaatgccaaccaatgtatctgtatgtttcatgttaatttatttgtgcaggagcaagcacttacattgcgagggctactgtgaacaatgtcaacggcctcttgattggttaagtgctcccatagaccatcagatgcaaatatgagaaattgatcatgtggttgtaggggttgcacactaatcgatggttctgaacttagtatgggcttgtgaaaaggttcccggaggcggaattttgcatacaaaggttcccggttgaactctgatcttttgagataggcatcaccaattgatctgcagacctgcaaaatatataacaaattaaaggaaaacccaacaatcttcacttagaccttggaagaaacataaataaagcagcaagtattgccagatttgtaaactgtacaataaaaactcatcaaacatttggatgccttatcatggtagcctagtgaagggtgtatcaagctctgaagagtggagattggagggatattcataaaatgtttttcactaacaaatggttatttgagggatggcatgaacctaacagataaatagcaaacaaagtatttcttcaaccagcagctatctgtaccacgaaaaaaaaaatctctcaattaagtagatgaacatgcaattaaacaacagacaatgcaaaaccttcgattattctcaagctcctcactggcacaaaatataggagtgatatcacaatcatcaatcacagatgacatctctcatccatgagcagaagaagactttattgcatttatttccaatggtgtaaccacctcgaatctacttggttttgtcttaacattacaaatgcagatgagtttaataagccgattaccatccggaaggtgatgatgggaataatggcagatgcaggaggcaatatgaaatgatccttcaatcaaacttcttcaaagctaaaactgtgttcatagtgatagagaactcacctgaattagaccttttacacgccaaacgttgtgcttgagaacaacaatatgcctatcttccgggtgcattgactgcaattcttttctcactgactcaatgcttacgttatgctctgctgagagttggacagccagaacttctcccgtggctttgacatgtctgcctaaaacaacacgggaatccccaacattagcaacataaagaatgccaccacagattacaccaaccaggcagcacgagccaacagcagctatttgaggcttcacaggccattgcttggtgacaacagagaagaacccatcttctgtagcttcatatgctttcttcagcacatcagcagatatcgaattctgttcagatgcaaaccctgcaatataagccatggaagaatgaaatggtcatggaattgctctaaaacacagtatggaagtagtgcaaaacaacactagtgcatactgtcagtatcaattacttttcagatggtggaataggtgatcgttgatatagcaagccgtctctgggccaccatgtccatcataaaccccgacgaaagttccgtatggaccagagtcaagaaagctcaatggacccgattcaatctggcactgatcctcaagtaagttgttggcctggaccacagccatagagaattccccatttacatgctgaccagtgtccttgtaccatagaagtccatcctgcctgccggcaacatctgagcctgcccgggcatgctggttggatgatggtctccagcatgcccgtaacaagttcatcaatgtcactatcatccctcatcagtcatcccaccacagacgccttcgaggccgcttcatctgagctctaagaaaatgcagcttcacttgttgatacgccgatgttttcctttattctggaaaaaagcatgcatacatatatgaaacagaagtatggattattaatggaactcaagaccattgtatgtgcctagtttggaagcattttaaaggatatcatcttttatttttcattcatttcctttggtgtgtatgctttctataacatctagtgttatacaaattgaagttaataaagttgctttttctacaacaggaaagccaaaatatcaaagaaatatccttcccgataacaataagaccaatgataactttaagtccaagcaaacttgtcttgtgtaacaaatatccttgctgtggggtatagcaaaacaatataccacattctgtagcattctataacgccttagtatgcaacttttatatcaaagagaaagggagaaggcagcagaagacccaactgatcatcgttttttcactatatctcttattactcgagaaacatagcatggccaacacttttttttttccatctcccatcctcacagcaaccaaccgatcaaagctaaaacttagtacaatattctgaaaaaacttactcctactttgcaaatacagtttttctccccccctactatccttcacttggataaacagaaagtgtgaattggtggaatcaaaatcaaacaccttcccccaacctaagaacaagcggacacactcacaccttatcctcgagctaacgagtagaattgcacaccatgatcctcacattaattcccccaatcatatccgcaattcctccctccaattagcgcgggcgcctcttctccccccaagtcgcaagcgaaggacagtccaccaaatcaaaagactcgctcggaattaccatttcataccccccgatccacgaactccacacccgcatacagaaccaaacgatcccccccccccccccaaacgcccaagaacgccaaaatcactaggcataaatcacactaaattcggatcaataaagggagagggaaagccccctcccaaatccaaaagcgagaaattcgcacctcttggcgtggcggacgcggccaattggcggatttcggataggggatttgagggaattggggagggttgcctcgatcgaatcgcgcgatttgggcgtcgccacgctgcttgctctcaatctgtgtccaaaccaagggaggaaaattagtcgcggaagtgaggggaaaaaataccggaggaggagggtagggtaagcggatcgggttttttttccctacccgcctccgatccgacccgaatccgcctcctctcggatcgtatcgacgcggagccaaggggaaatccctctctctctctctctctccgaccagcaccgccggggacgaacgaaccggcggccggcgtgaggcggcgctgactcgtcggcggatcaccggcggcggattcgcggctcgcgctggcgttggatgtcataaatgaagggagaaaaagttgtgggaagtttcataaatgaccctggataaaaatttaattacatattagtccctacaaagactacgtgtagtagtacctagaccaggtttggtttgatgattcagaatctcggatcatcagattagtactaatcaaagattacatacagcttttgtgcttggaagaacttggtattggacacacaccgattttgaaccatctcctgcaaatgttcatacgcagtcacacattgatgatgactttgctactacatataaacttcaactaactgtatgtatgtcaatgctacggtcgtcagtttcacctaatttgatgaaaaaactagaagcttctacgagctttgcttaacaagaaccctattctgctttggacaaacttaacttgatgacatactgacaacttaattttgattcctcaactctgaacatttgcaaccaaagtctgaatatatatatacctgcattcctgcaacaacaagtatatgtgtgctttttcatcttcatctgcctcttgtcaagcaaagttgtcgagttatggtgttattaagtgctactattaagactgatagagatgtatcggcatggtgttgatagagagaagagaaggtagaagcctgcaccagcaaacgcccagcatcatgtcacaccaaccaaacacttgatgatcttcgtcactttcagagtctgaactcaactgaacgtactacgcaggtgtagttactgtttaaacgcttatttacagtacttctacagtttcgactgcagtgcataattcaggcgttcatactactggtggccaataagtatttttaatgaaatatgtccatctctaactggaaaagggaaagaaagcagccatgaaatgtgttaatttcagtcaggtctcaggacagcagcaactctgacgagatggaatgatgaaaacagtgcaaaggatgtccagtacttcttctctggatatacactgcagaaaaagtgaagagatgatgttaattgctgattaatgcatggttttgcagtggtgctttatctaccttgatggcgtgttagcatcaaacaatgactcgtcgttgactcactaaacctttactagcctgatactttagctaaatattggtctgaagaaaaagatcaagttcttgtggccttgtgggaaaggtatatccttttctgacccggttggtttggtttagcctctgccccgttgtttatttgtgttcatcctatggagaaaattaagtcaggctttagtgccaattgccatttgtatatgcagttttgtggtgtcatccaggaagaatgttgccacagatatgtgcaagagaattaagaaataattaggggagtaaccatgcatcgtatcttctcttctcaccacatgaccatagattctccttttctttatcatggtccaagttttcgttccggcgtaatttcagcaagaagcaatggtcttcagaacgactaggaaatgaattagccttttttgcaaattgtcatgttgtcatgcacattataattcatatttaattatgcctgaacatgagatgactgcatgaagaggaaagaaatccagaaaccgtaaattaattatagtagaggtccatttagcttgcaagcaagttgctatcagatgttggtggtcacattctcaagcctctgaaacgtacatgatccaagaattgacaaccaataattcatatatgcgatatatatccaaaacagagtttgggttataaatatacatatcggcttaattatttcctgacaaaatatttgactaactttaatatcaagctcataccggatacattatccatttccagtgataaataattaatgagatgcgatccattatctaaacaaaaataatgagagatggatcggatagcgcacttttggaagtacaaatcgtactcgaataacgaatttgccgtttattctcttgttattctctgagggcatattggctgctaatggggctagctatatattcgatcaagaatataagtttttctgtgttggcttttcagtgttgtctccaaactaagcttgaagtgactaaccgagtatatatacggattactgatactcccatttgcttttgccgaagaatggagggtggagaagaaacataattaataaaagaaagagttaactgataagcagcaattgcaggtaacctgtcaagaatctggcctgaagtcgatcaacacgtaagagaaatcgagtgacagaggaggaaggagaagaagatttggagactaatataagcaaatcattcagacaaggtgattataatatcacggtccccagctagctgagactgagactgatgagacagatctttggagatgatcagaggctgaggcacgagagaatcgatcggcagcttcgcagctgcctctgcgcacgagggccacatcagatagataccccatccgttctaaaatataaacatttttaagattcaaaatttataccaatgatattactgttcttgaaatcaaagcattttcaaccgattaggagcttcagaagggaatgtaagcaattcaaaattttaaaatttgattaatgaggtgactgaaaagaaatattcttcatcgatttttttactagaccacgtagaaatgtttatatgagagaagagattccatgagatggttgtgtctccgtcagtgcagacgcaagtgttggttggtttcaacctttcaggtcagaacaccatgcaggttacagactagcagaaagccacggattgaccaaaggagagccacagatagatagctgcagtaatcaacgaaacactccctggattgctaagttgtatagtaaatcgcatgcatggatggatcgatctctatcagtcagcgattgacgacaaaacgcaggcaggcaggcaggcattttctgaccaaaggaaaatgacctaatagacgctatgtacgtacagtatgtggaattgacgctggttaaagcttctatctccatcgcttacactgtttttttccttcctgatgctgtttagcagtaaaaggtaagctttgcattcaaacagatttttacgcggattgtttacttgattaatttaataaattaatgttttgataaataaacttcaaaattagttttaagaaagtggtctaaataatatagtgtttttttaaaaaaacaacgtttctttaaatgcaaagcaaataatccatgtcaaaaatctaaaaaagaaaagctaaaagaacagtgcctaaagcccaatagacaagacactaaaagtagtatggtagtggagagggatttttatcgcatgtcaattaaataattatgaaa

SEQ ID NO: 6921 - DNA, 5806 bp, Oryza sativa
  unsure (1)..(5806): unsure at all n locations
ttgaaattttcaaacttaattctagagtcggcttacgcttttcgtcgtaacctatattttaatattggcttttaaatgacagatagcatatgtttgctttgtctatttctctacgtgcttaccgatgattgctcaaaccatcgaaatcttattgttattttagaagcatgatacaaacacaggtgctcttaacgcgtgcacactcaccctattaacacatacacacactccatctctataagtatattcggaagactgagttggcatatcaatcttagcctttccttttaaaataacttattttcgccttgtctaagtacgtaaccagaaattaaatgttcttggacggaggggtgtaattaacagcgagtgaaagtcaagtgttttaattaggcaagaaacaatcacaatcgaaacctgactcctgtttggagttagcgcgtttctgccaggtaccatgagaaataaaccagaccattagccacacaaataaaatactggtccgtacacgaaatgcgtggtcatggccgccatggctgacggaagaagcaagcgagtgagctgccaaaatttctgtgtttcccctttctctttcacccgattgtttactgtctacggagtagtccagtttttacacctgctgagctcacacctgacctgacctgacctgaatacatacctaaccgtgaccgatgaggcaatgactgctaattatgttgttgttagtttaattaatctcaaccttaaaacttannaaatttaaaatttaattttgttggttagtttctgatggttttcaattatgggtttttttctatatattaactcgctatatataaaaattttacctgtaaaatattattttaagttgttaataagttttgtgatttataatctatagtctattggttacaagagtctcagtagcatcttaggtcctgggttcgacttcccgtgagagtgaattttccaggatttaacggctttgtgcttttagtcacgcttatagtgacttcgttaatctccattatggatttgccgtctcagtcttcaaagatgctcatggggtagggtttgcgtgcgtgcgcttatatagtgagcgtacgtatgtgagtgtctatattgtactgtgtaattaaagaaaaaactccatcgccagccggcaggcgcagtccatacgtttgtttaattcgtcaatcatctctctcaagtttcaattagtgtgagtcactatcagagtttcagtacttcactattcttcctgtagaatttgggacatccaatggagagctcccagcaatcaacgaagattccacggagttgacacaggtgcactgatctcacgggagaagaataacagtacgtgtttcttctctgtccaacgaaacgcccacttaactacctgacagcatacgtcttgaggatcactgcactattattattaactgatgtttcagctaattaataacaacgaacaaatccgtcgaacaagtcaagcaaatcatctaccttaattagctgttgttagctgagcatttttgttctgcctaaaactatatttgtcggaagttgtgggctgcatgaataattcggtcgaagagagaacactttccgctgctgtattctgttgccacaagaaaaaataacaattctcacggtcaacacgacaccaagtattaagaaaacggcttagcaaaaatcaagtttatcacaggcgacgatctctcgtaatttgtcgagttgacgtgcatattgtccaaatgaatatccaagatctcctcccattagtacatgcctgcatgtgcaactaactgcattacattattacaggataattcagttgatcaggtactgatgattatgtgtcaatcagaagaaactgctctaacgtgcacaaatcattttctgcaacataatctctttcttattccgacttccctacagcttgcagatagcataacctcggaacctttttctttattattcttgatggctggaaactatgatattgtttttttcttctaaagtgttgaccactggaataaattaaaatgtctggtatttcttttacatatatatgagaattgcaacattatatatgttgttagaaatgccttgataataccaggtcttatttctatattttaatacaaggttataaaaatataacggccgcaatcccattttatttaaagactctgtcaaaaacagcgcgcacaaaaaatgcagttattaactagttgttggaaaattttgcagattatcaggttcactgaatgccccgtaataagttgaactgcacaaaagtgctgtggtacagtcaagtcatgatgcataaacatgagtccatgtatattaattaattaatttcaagttttggtctgcctagattaattactttttgagtgccatggccatgggttaagttgaatggtaacgtggccttgtaggtcagttccaaccacaaaagactgagcaatcaacatcaagctggcgacagtcaatccgtgttggtcctgattcatgaacaaaacacaaaaagtaacatgatttgctcgtacgaaccactgagcttgaaaaaagaagaatattatattaaattgatatatatggaaatcatttttgacggattcctaagacttgtttggttggagactaatgatgccacaactttttgactaaagtggctaagattagtcttgtcatacttttgtggcaaactaagggcttatttagtttggagaaatttaaactcataggaataggaaaatggaggactaggaatttttccaagatctttgagtggatggaaaaattcatatgttttctctatacaccttgtagaaaaggaaattttactttgattttcctatagttcaatcctacaaaccgaatgacatctataggcattaatccttaggaatccaaatcctttgtttttcatcaaaaacaaacaagccctaagcttaggcagagttagagagtataatatgtgggccagatgactaagagataggtaaaatagagttgtggtagaaatcaaatattgtctacaaaatagaggtatgataaatttagttgataaccaaacatgcccatcaggatacaatgcattttctattgttagtcaagtacagaacaaatgtttcttattttttgtacggttaaattgatttcagcatgaaaacatagaacaacgacgtagaaaattgtaacccaattcaacaagaatcaagagagcacaatttgggtatggtgagtgaattttggatgaattactttatccaataaacttcaagcatcttggttaatattcatgcacaatgaggtgtgttttaatacttttttttttgaggttcaaagagcaatataatgctgcatgccatcaattcagtgcctgttatcatggattatatatttgattgtagagattttctatacttgattatagagatagatcaaatattttcaggaataaacttaaaaaatactacatacgtaatctgtagcaatatagtacttcagaacacaattttttttgaacgtttagaagtgctataccttcatagtataagctgaaaaagacatggcctaagtacatagttgcgcccatatttcatatatctgaaaaaatcgaacaaaactctaaaacatttctctttctctttagagaatgataatgatttacatctctaaccttttccattaagcatacaactaatccaatactctctttagggagattctagcaattgcaacatcttccagaatctacaactcttctaaacagtccaaattcttacttagggtgtgtttagttcacgccaaaattaaaagtttagttgaaattgaaacgatgtgacggaaaaattgaaagtttgaagaaaaagtttgaaactaaacttggccttgagtagattttaagaacagtcatagaatatagagaataaattagaaaccagaaatttaaaagcgcaacctttttctaattgttatcaggcggttactctgctcattaaatgtttattagaatattaatctcccctaaaaaggattatttccctttacacaaaagtatgttgtgcattcctatcctaattaatccctcacccccacaggttagcaaaaaaagatatactccagggacctaggcgtaaaaagccccctgcctgcctgccgtcccacacgggcacgccgcggcggccacgttctcttcccgctccgacgaattctgctctccattctcctcgccgttgacgaaaaccaaactaagccaagactttgactcgctcgtcacctcgacctcaccatgcgcgtcgctctcctcctcctcctcttaaaatcgatgtcgatggcgcgcaccaaccttcatcttgctgcccccgcgcgcacgccacctcgccccgtccccaccccaccatgcctcactcctcctacctcgccctcgccctcgccgttgcggcggttcttgctatggccgccgtcgaggtgtccggcctcggcttcgacctccaccaccggtactcccccatcgtccagcggtgggcggaggagcgtggccacgctggcgtgtcctggcctgccggcgccgaggtgatcggctcgcccgagtactactccgcgctgtcccgacacgaccacgccctgttcgcgcgacgcgggctcgcccagggcgacggcctcgtcaccttcgccgacggcaacatcaccctgcggctcgacggatcgtacggacaccttctcgccgccgcgcgcccccctgctcttgctccctcctgcgcgccggcgagttgacctgatcgagtttttgcaggctgcactacgcggaggtggcggtgggcacgccgaacacgacgttcctggtggcgctcgacaccggcagcgacctcttctgggtgccctgcgactgaagcagtgcgctcccctcggcaacctcacggcggtggacggcggcggcggcccggagctcaggcagtacagcccgagcaagtcgtcgacgagcaagacggtcacctgcgccagcaacctctgcgaccagcccaacgcctgcgccacggccaccagcagctgcccctacgccgtccgctacgccatggccaacacctcctcctccggcgagctcgtcgaggacgtgctctacctcaccagggagaagggcgccgccgccgccgccgccggagccgccgtgcgaactcccgtggtgttcgggtgcgggcaggtgcagacgggctcgttcctcgacggcgccgccgccgacggcctcatgggtctcggcatggagaaggtgtccgtgcccagcatcctcgccagcaccggcgtcgtcaagtcgaacagcttctccatgtgcttcagcaaagacggcctcggccggatcaacttcggcgacaccggcagcgccgaccagtccgagacgccgttcatcgtcaaatccacacagtaattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6922 - DNA, 636 bp, Oryza sativa
catcacatcctgcgcaaatacacgctagactcgagattgtactgctccattaaatctgaccatgccttctcaaactctgcctctgtttggggttcatttaacacccggtggaactcctgtttgaaactgcttcttttactgtaaatgttccccaagttctccttagcattcttcagaacatgccatttgcaaactctatgaatagtttcaggccaaaccgctttgatcgccacctccatttgatgacagttatctaaaaaagaagttcacaaccattcgagattaaaaacagaagacatatcattaaacacaccactgatccatccaaataaacatatacctgttaaaattgctacaggcctcttcccatgcattgcatcagtaaatgtttggaaaagccacttgaatgcttcgattgtctcctccctcaacaaagcgcaaccaaaaattgctgtttgaaaatggttatttacaccgacaaaaatcccaaatggcatgttgtacctattagtctgatatgtagtatcaaaagtgattgcatccccaaaatggtcaaaacttaatctggaaagagaatgacaccaaaatatatttttaatccttgaagcaccatcaatctgtatggtgtaaaagaaa

SEQ ID NO: 6923 - DNA, 433 bp, Oryza sativa
cacgaaagcgagcacaccgggtggttgctcaggtcgaggggagacgagccaacggctcggattcgtcggagttttttttacggcgacgaattgcggcggcggcaagcggcggaaggagaagggggaagcggcgactatgtcacgaggggccaattcccggcggtgagagcatctacgcggctacgggaatccgttgctagcgtcggattgggcggagctacgccgagcgaggccggcgacgagcgagtgctacggagcacgggcggcgacggcggcgagcacatggcgagcggcggcaacggtcggggcggcgccggctagctacggggaggctacacatgctactaccgaaaactaagggggagagatggagcgaggaggaagaacggagggaggcactaccgtgcgggcgggcgcaatgactagaggccga

SEQ ID NO: 6924 - DNA, 755 bp, Oryza sativa
ttcagcttttgcacgaatgtgtcaccattttttaactgcacgtttcctcatcgcaggacctcgtatgccttcgagcgcgttcgcaggcacgaccggcgcttccgcgagctccgcaggggcgttcgccacctcttcgggcgcgttcgccagctcttcctctcacggagcgtcgatccctcgcccacacggtacttaagattttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcaaggtatgagggacaggggtaagaggcctcgtcagtagtgttctacctcttcagtccttatgtgaccgtttcttttggcttacaaacttgtaaagcagtactacttttgctattactactgcagtactacttgcgtttggctccgctacgtagatcttttcattctatggtgcttgaacaacttatgctcacaacaacacactttccgcgcttcacggtagtgccatattcaatagcgcgcacagttcacaa

SEQ ID NO: 6925 - DNA, 1270 bp, Oryza sativa
attttcaaaatggaaaattatttttgtaaaacttttaataaaaaaaattataaataaaaaaaattccttgacgagaagggcaccatcgtgatcaatcatctgtctggtgggcccaccacaatagactcgggaggcccaagttgatcccaagccgcacgatcaaagccgatgcgcgtcatgattggatttttgccctttgcccctgccccctcgctcctcgtggtggggtgcacatgacacgactgcttccgcgtttcttctcggcgacgcaccccacacacgcacacacacacctccattcgctccccgccacacaacacgagaaaccccccacccttcgctcgccgccgccgccgccgccttccgccgcctcgaaccggaccaaccaacgacggctcgcttccctccgaggcggtaggccacctcctcccggcggctcccccatctggccgcccggcgccgagctggggatccatccgcccgcgattcctctcgccggtaacgactccctatcttcgctgcttggatttgcgaacgacagaatcgaatccagatatatctctctcggttgaatccccgtcgcgttttagtcatcatcattcgtatcgtaggtagggaggatttaggaggagtaggggttccgagtcaacaatttttggtgtgtaatcgtggtgactttgtgaccaggtttgctctccattgccagctgccggtggccatggatgacggggacctcgatttctccaacccggacacattcctctgcccggccgtcggtggtgctgaccccgacggcagctgctccatggacagctatttcgacgacatcctcaaggatacggagcaccatgcatgcacccacacccacacctgcaacccgcctgtgcatgacctctcacacacccacacctgcgtccatgtccacaccaagatcgtctccgccccatccgacactccgtcggatgctgccgagaccgccgagtccccgacggagaacaatgcctccaagaagcggccgtcgggtaaccgtgccgctgtgaggaagtacagggagaagaagaaagctcacactgcctcgctggaggaggaggttgttcatttgagggctctaaaccagcagctcatgaagaagctccagaaccatgccacgctcgaggcagaggtatccaggctgcggtgcctgctcgttgatattagaggaaggattgaaggggagattggggcttttccttatcagaggccagtgaagaacatcgatttggtttctagt

SEQ ID NO: 6926 - DNA, 5872 bp, Oryza sativa
  unsure (1)..(5872): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactgagagagaatgagacacggcaacacaatatttactttgtataactaatgtttgtgcttttgttattttgagtgcaggttccaagggtgccgcagtatgacgaaaggagcaatgtggaagtcatgttggatacaggaaagcaccgtgcagcctgggtaactgctactgtcattaagatggttagcagtaaaaactatgttgttaggcttaaaaataaggaaggctcagttaacatcgtagattactgctatattcgaccacaacctacctttgacagaaagaagtttgagtatgaactggagccctctgcagaggttgaagtgaatctgggtggtgcctggtcgctaggcgtcatctcagatgttggaagctgtggatatggggtaaggctaaaaggacatgatagctcagaggaagaggactacatgcttgtgttgcgtgctttactcagaccctactgcaaacaggatgatcaggaattgatgccttgtacagcaaaggtatttctccaactagtcatgttgttacttgtgatttgggtattttctcctcttctttcttggtactaccagtctactgcagtgttcatttttctgctgtgaataaaagtttacaatgttttcttgccgtgcttgtatgccttcttggaatatgtggtgtttgtcattttaatgtcagtatgccagcttagttgtccctgtgctctggacaagcaggtaacaaagttgaacaagctagagaacaagaacataaaagggaaggcgcgcatgctagtttcaaggaaactgcctaacctaggctgcacacggagtggtggtaaacaaagacacagcatgaaaaaggttgtcctgactccgttcttcttaaattgcaaacttaaattgtgtcttaaattgcaaatttccgcgcattcatacagaaaagcccgcttggcgctttcacaggtcatagtgcttttatcaatatatattttgaccatcaaatattgtgcttcagcatcttatgctaatgacatcatgtttttggtatacgctttcttcctccaagcaatgacattatcttatgctaatgacatcatcttatgctaatgatttagttctctcctaaactgtgttgtcatttggataattgttgttcaggaatttgcttgtacaagtttggatcttccatgtatctctgcacctaaagatgctgttgaaatcaagggcaaatctagttatgtcgatgtagtcgaaatcagtgacaactctggctatgatgttattcatatcagcgatgattcgagctgtaaccctagaagaaagagaaggcgacagaatctcctagaggaataactccattcccggcatacttcctatccgattcaagaatcacaatccaggctgaatatgtcaccagcacgaagtcctttgaactgtgacccgttgctagatgtaatgaggcatcctaaagtagagtcgtgcaaccatgtgttatcacaatcttgtcgccattggaaacaccacaggctcatttcaacaacaatgctgggcagctaattcctctgccaagttatccggtattagagaagttgccagttaaagtgcttcctgaaatgaatgaaatgaaagaaacaaatcatgctcatttacaagctgagttcttggcacctgatgattgtacagccggagaccaaaactatgctctgcctataaaagttgaggtacatacgtctgttatctttatttgagatgaaaattaatcccttcttgattgtctatctgttgctaactcacctcaacttaggtggagagctgggtcgctgatatccgcaagaaagaagcaggtaccggtctgactacctcaaacaactgtgagtacttgttataacgactttgtgttacattcaattgtaaacctgtcttaactagaacgaaaatatcaccagcaatgcagacaattactgatagtggtgaagacaattcaagaaggccacgatcaggagattctgagataccaaattccagtaaattagaaccatattcatctgagcaacaaaggtttgaggccgatctgccatgcatgccagtgcctaacaatgttactattaatactcttcctcttgttaccagacatacgtttcaatttgtttctcggaacaaactggaagtgccagtgagacataagaaggcccctgatgctgtaagaccatctacgttttcccccctgttttatcttctgtttaaatgtatgtgtatttcccatccatgcttgatcatcttgatgctatttgtacagctggagatgaataccaattcggttgtcttctctcccaaggagcaaacacactgtaatttggagatctttagtccaaactgtaagtcttgccacaactttaagatagtaatttttgatgcattgatacttaatactggtctggctgatctgaatattatttttctgcagccaagaagatcattgatgcgtcacactatgaaagttatgcgtcattacagcagcatcctttgggccaatgtcaagttccaaattattggagtgctgcagggcaatcttcatttgtgcatccgagcataacaatgaacctattcacaatattgccagcacctaacagtcatccaactacttttgcctcaagcttgttgatggggccttgtgagaaaatagaggtttttgagaatctgccacaattaccacatttcggaaagttgattggttgccctcctgagctccgcgaaggaaaggctctggggctaatggcatccttcgcaaatatagcagagagcatacaaaacatgtgaattcaggacgaagaaaacgtctttgaggagaaactgaggtgcctctcggaattggaagaggacggatttgatgttagggccctgaaggagcggcttgaaaacctcgtgagcataaagaatcaccagacagaactcaagaagaaaagagcaagattggatcagttcatgcttgagagagaggtggacaatgcctctgtagagcaaagccagaagctgctcgacataatgatcaaggagcttgagctgaaacttttagagtaccgagagaagaaggcatcactcgtggagaagaaagcagcgaactgttcggaaattgcaaagctccaaggcgacatggatcaaattgaggagtcattcctttctgccgagtatgatttccacaccaccgctgctgcgccgtggtaaacattgatgacagtaagtactgctttcttgcttgctcatttgtgcactgcaaccaagtccatttggatggtgttaactgatgtgaaacaatgcaggcagagagctctgttcacagttcacctagacatatcacatacgcatatggttcactgatgtgatgtgatccaatgcattaggggaatgaggcagctagttctcttttgcctagacttgaaatgctgaacttaattaagtttgtatgtataatggttgtcacttgaatttggtagatcatctcattcaatcaggcttgcccccctgacattgatatgcgctgtttggcctttaaccccccccttagtgttggccaatcaagcagctgtaattttctttgtattctcttggttgtaacccctgtactccgttttttttttctactctaatgttaaattctagcagatctcctgccgatgttctccttaaaaaaaaaaaacaggcttgccccatcttcaatgctagctctgttcactgatgtatgtgaaccaatgcattattaggggagtgaggcagctagctctatttgcctagacttgaaatgtcgaacttaattaagtttgtatgtataaatgggtgccacttgaatttggtagatcgtttcactcttgccccatcttcaatgtgagcaaggtctccaacgtctagaatcacctgacctggttaatagttttctgctggaaaaatatgatgctcctcacagtcctctggttgttggggaaaagtgaaaacctctttcggggatattcccaatctcaacaatgagaactgaaaagcgatcttattaacttaatctcagacgttcttagtttcagcagtatgataacctggagtgaacactgaactgaccttggttcttacatcagggctgcacgcgcactgaatctagaaaagcctctggagtagtactaattaattaactaacgatatatagccaatgactactggtgcaaaccttatacattataggagtgtgtaattaattaactgtgtgtgtgtgtgatgagttctatagctagcatttctcgtcggcgtcggcgacggcggtgtgctgctgctgctgctcccgcgaggtggcggcggcggtggcggcccacttggcgcagacgaggtaggcggcgaggttgaggacgctgaggacggcgaggagccagtagaagtagtcgaggcggctgcggtcgatggtgtcgccgagccaggtggtggcgcccttgacgagcgacacgagcacgctgctgaagaagaagccgagcgagagcgtcgtcaggaagagccccgtgctcatcgtcttcatccccttgggcgacctcgtgatgaagaagtccagctgccccgtgtagatgaacgcctcgccggcgcccaccagcaggaactgcggcgtcagcaggaacacgctgatcggcgtggagttcccggtggtggcggcgacggcgacggcgaggcgcttcttctcgcagagcgcggcggcggccatgccgaggatggagagggcgaggccgatgccgatcttctccaggttggtgaagccttgcttgccggtgagtacgcggcagagcgggatgaagacgcggtcgtagacggcgagggtgagcatgatggcgccgacgaagaagacggtgagcgaggcggccgggatctcgaagccggcgccaacgcggcggtccatggtggtggcctgctccacggagaaggtgatcatctgcgcgtagatggtccagaagaggatcgtcgtcgcccacaccggcatcagcctcgccaccatcttcacctcctccacgcgcgacaccgagcagagcttccacgggttgggcgcccccggcccgcccggcccggccacctcgttgtcctcttcgccggccaccaccgccgccatgtccaggcacgggaactgcgcggtgtgcgcgatccgggcgtgctcggggcggtcgtcctcgtagagctccgccgcggtgggcgggcgcttgacgaccccgcgcttccgcgccgcggcgacgagcacctggaggatgtggacgatggggctcccggagctccgcttgtagcggtacctcctggtcccggagaggaagacggcgatggcggcgagcatggcggcggagcagatgccgtaggcccagctccggccgacgtggtcctggacgtagacgagcacggtgacggcgagcagcgtgccgaggctgatgaagaagaagaagcggttgaagaagaggcccatggcggcgcgctcccggccgtcgcggtcgtcgaactggtcggtgccgaagccggagacgctggacttgaggccgccggtgccgagggcgatgaggtagaggcaggcgtagagcacggccatctgcaccggcgtcggctgctccccgggcggcgggcggaggtgggtgacgagggtggaggcggcgaggagggcggtgccgatggactggacgagggcgaagacggcgatggtgaggtagcggccgaggaaggagtcggcgaggaagccgccgaggaggcagaggaggaaggaggtgcccatgaagtcggtgacgacgttg

SEQ ID NO: 6927 - DNA, 15573 bp, Oryza sativa
cacccacccccccgtcgccgacctgtccgccgggcatccccggtagtccaccgcgtcccgcaccatgttccccccgccgccgccgccgccgctccacgccgacgtcttcttctccacctcctgcacgcatgcacacaaatatccatgtcttttactaaccatgcataacatattgcatgcgacaacatgacagagtacgcagttgctaatgaaattaattaactaggaaactaatttgtataacctacatgtatatatatatgaaatgattgaacaagaaattaatatttgtatctcacacgaaccattaattctacgatatatttctgtccactcctggtctcctgtaagctgggaggtcggtcgagtgaaagccttggttgctcgacgacctcgtggacttgcgatctcacccttttataggcgccaagacgggggcatgcacaaacaccatcaaattaacttaaccactcatcattaattagcgtcgaaagggacttgcactacgttctaatccctgtttatgcaggatgtttctgctgcacacatgcaaatggtggtgggggcaggaaatgggtacaataatgcaaacctatgcatataacaatcctaattatatatattcagactatatgatcgatctgtcagtcataagggcacacacaagaaagtgatcagatcagatcagcaggtaggagcacttaattaagctaagctaacccggcctccatgcgttgtcgttggacggtcacaaaggggtcagaggagagaagagaaactgcgacgtggaaactaagaaaagtgagcagcatcaactgggggagataaagtgtagtactagtatgagatgagatgagattggtgaggaattgaagttggggtttcccctctctagtggggaatgttccaggagcttcagctactacggcagctgcattctgtttgtgtacatatgcatgggccctctcatctcatgcccactagtgatctcacaataatgcaaaactagatatataaatactgatagacagaggcaggggatcactggttgatcttgttgttctgtccaacttttccaatttttcacatgcacttgctaggtgcagatcattagcagatacaattagtatacgtttgttgtattattgagcaatgctgtcgatcagttgtggctctaaaaagagagaaatcagaagaaggctattataacttaataagaaaaaaaagtccattttgctctttctaactttttcccttggagcacttaaccccttagacaatttctcgactcatttaattttgacacccccacactattaaaaatggttcacaccttactctctaacaatatttgtctttttcgtttctctctctatataggtcatattttgcaatgaaatttgataggattgatatatgcattataacttacctctcaatattttttgagtttttaaatcgctgcttatataggttagaagcactgagactaatttaagaacagaggttttaaatttcaagcaaaaagtcatgaaaaatttttaaactattttggaacttcgataatggtgtcatatatgactttacaaaatttaagcttaaaatatgacttgtataaagagaaataaagaagataaatgtaattaaccagtcaattgaactatttttaacatttcaagagctaaaataagcttaaaaatagtttagggggttaagtgataaaatgaaatagttagggggagtaaattatttttttttctgttaaattcacatcgctaactgaattttgaataaggactagctaggtagtgtcctcccacttcctagatatgagagtttcaccatgatatacatattttaaagttttttgaacttttgagttttttgttttattagatgttctggttatctacatttgacacccttcttcctaccaaactcgttttgcacaattgcccttcgagaaggtggcagggttctaacttctaaggtgattcttcctgttatcattttttttcataccattatctcattaactatattttattatttagttattctagttttatcatttgtgttgtttgatcattattctttagaaattcaacatgtttcttgtaagaattctgttatttatgtccattcgcacgccctaatcatttgtaaacacctctattaactaaatggtaacataagtcactgtataatgcattttttagataatggaaacgatttacacactgtatagagcgtgcatggaaaattaaacaacttaatttggccacatattggtaaacaaagtatatattcatatgtacatggaatagatgatatatatgcatataccgggatattatattccattatctaaaaaaatatatgcatatagattttgtgaaaaaaaaggcataccaagttatcataattctaaagtgtttgagatgtccattctaatgtcgggaataacaagtaaagaagaatggagctgaggtagtagtacatacatctctcgaatatttagaagaacatttgagggaatacatccctttctgtcccattacgcactcgatctacagctcaacttttttttccttgatgcggtttaaaagatctctttaattttgccccaacaaaaacagtgataagcctttgctaggtagcatggtgcatatgatcaagataagcaccttcttagccaatggccacatctaggaaaacgaccttgctttgcaaagagaaccattaattggtatcttcatgcacaccatgaacagtacctatacactactgcacatggaagcatatattgtgtccatatatttcagttagttggatcgatctgatcaatcagctaatgttgagatcctagatagatgcatgatggatcatatcgtcttcctcctctggctgccatccctccatcttttggagagagagagagagagagatcccacaccataagcatggagaaaaaaggcagcctccctttgaatctcctcctctaattccatgacctcccacaccttttgcacaggggcctcttcttttccccttcttacaccaggtcctccattttgttgattttttatgtacacatctcgatgaaattatatatatatgggtctctgttccaacctttatatacgtatcgcgcgaaaaagatcgacaagtatatatttttttgtcaaaattcagtaatattgtagctggctagggtatctaccctgatgatcgatcaaaacgatggtgacaagttgtcaaatggaagccttccaatctgaatcctaaatcctagccatgcatgtacatatcacagtagccaaaaaccacacattttcatagtatgcactctatatatttctttctctatcaccccaaattcccagaagccaccaggtgttgataatttaagtatggaatattttgtatgaccaattaacgacaattgtttctttgctaatactagcagaacatatatatatgcttgtaattctagtattaagctagctagatctagctagatagtacaaaaaaatgttgaattagttaatccatcggacatatatatgcatgttaactccatatatattttaaacttaactaggaagataacccacgcattcacgtaggcatgcttattagtttgtttgaaaatagttctaacaaaataagttgaaattaaagtaaggtgatttctatttttaattgagtgttcatcgtatctttttttctgaagaaatctcgataaacttttattggtaataaatgtatttttttaccaccctgcaagccctctctttaaaaattcatatacatgcaattcgttatgcatgtgaatcaataaagatggaaaagttcttttaaaaatatttattatattttaaatttagtgatcgagttattctaatttcaaatctgtattcaaatcaaactattgttttattctaaattgtcattttagtgatttaaattatacttaatattgtatcgtttagtatttggactcatctttttaatagttattttattatttcaaatttaatatatttataactcatacttttatatgaactcttgatattttatattctacatgaaatcttcttattttttttatagttttaatattttttttactttttgaatgtgtatttaatcaaattgcttgttttatttttaattctgaatttagttataaactccttgtagttgatttgcctatcaccatcggcctcacggattatttcgtggatctcctcatcaatgagcctctcctgatgcattggacatgatatggcgtggctcggcggtagagctggagccgttttctagtccttgtcgaagacgtggaacgtctctctccgcccctcttctcaatccttgtccttcatctaatcatctagcgcactattaggcgcaggaactcgtggaagtcgaagctgccgctactgccgtcggtgtccacctcaccaataatgtcttgcagttccgcctccgtcgggttcaggcctagaatatgcatcatggttctaagctccttggtggtgattgaacctgaactttagactcacatatttgaattctttcatcgttttcaaagtgcaaattttgttcaaatatttgtaattagaacggctgcattatctaatttttatatagtaaatatgagaaatatggatcttgaattatgtactcccttcatccaaaagtccaagaccaaggagcaactaactcattcatcatgtgacaaaaccaataaacatacaaccaataaatactaaaatgacttattggttccgattaataatttaatttagcacatagtgactacaaataggactagatttttagagaaaaccaaataatagaatgggtcttagacttttggatggagggagtatttaattataaataacacaacaaatcaaataaattaagaaaagtatgtgtaacttgagaatcacgatcattttgctatctaactattatctttttatatattatgtgttagctagaaaataggggaggagagtggggggggatacctgatttttttggagatttaagggtgaaaattattggctctacctatttaaaggaatatcaatcgttaggttttctttaccataaattttagaaattttcttctcgtttattaagcactgtatgacgtcttaggagcgttaatttgtagaacgccatgtgacagcttgagagcttttatagagaattcaatggacttttagttagtatataatagatattcaaaatggaatggttgtgctagtacgtagctaactggagcaaagcatgcagtcatgcatatagagtggaagctggcgcaacttggtggccgtgatgaaattgtcggtagctagccctatttcatttcgggacccaagaataacatacagttgcacttacctgtatttgcttaccttccaattgccaaaataaaagggggttatgataggttattggacttggacctaacttataaaggagctcaagaatgaaaatacatgtagaagcttggagaatggaagacttgagaggaataatgtaatgttgatatattgtttgcacaatattgaacttatcatgcatacattgcatagtgttcaggcttaacagaaatgcactatggttgggcggattgactatagggtatcactgcgtcgagatcctatatgcagctcactgtagaacacatatcagtaaagtttactacgactgtacatgcagtactgcagagaatctgtatccgggtatcactattatatgctttattttcctcgagagggtgagatgtgctaattgaagtggctttataaaaggggtggatgtctgttgagtaagaggcggcgactagaggaggggagtggaaggaaaggcaagggtaaagaatgcaaagtatttacgtattattttggagaagggatctaaacgatagatatgagatatacatccggtcacctttgttcaaaattaattggggccatagccaaattgataaatataatatagggtgtgtatgcatggtaagatattatctatatccatgcaccccattttgatccttcagttttaaatcccaagcatgatttcaatatttatttaatatttatatatatgcaaaagatactactaatgaactgaagcactggattgcaatttaattattatctctaagaacatgttatggccattgagaatatccaaagtacaatatttatgagtaaataaaaatcataataatacaaatatacttttgttataaagctgtacatgtgattaattatcatgaatccaatctaaaatgacttggggacgtatgtctatttttttttaattagcagtaccatttttatctctactatttaaaaaatgtagtcgtcttccttcctgttgacagaaaacacgaggcctgggagatctgcttaactccagtgcaggtccaaagctcgcctacgggtgtgctagcgtgccagttgatttgatcatgtaaccaacaagaagtagaagcaaagaaatcgcggttaaatctataaatgatagccgatcggctaagtgccgatgacatatcatttatctctgagccgatgtaatatgtgtatcgatcggcaatcttgaataagtaagaaagaactaaatctacttgatcggctgtagatgttaacgatatatactccttatatcgatatatacttaaatcaagtgattgggatagatcggtcgccatgccgagacagtataaaccacttagaccgaaatatatattaataacaggactatatatgtttatagcataaccgatcagatagatctagcatgaatcggctaatactccgatactactttatatcaggatattaaaacaggtatagaatatcaagcaaaagcctaatatattcaaatatagcaatatcttggcataaagggcaaatttaacatgtcaataaagcatatagagcaaatatagttaaatcagataagatcggctgaaactccgatgctaccctaatcggcaaccagaaagcaggctagagattgatattctaagcacgacttaatagatcaaactcaactgatacaacattaagtatgaaaagaagaacaatatctagacaatcaagccgctggaagtttcatagagtggtagatatcttatataatctgagtcaacgtcaaaatctaacctaatcggctgccctcttcgacagatgttagccgattgtagattagatagcggtattgccagagattatataaaatatatgataacccgacgaattacataaacaagattagagtgtcataaagatggaagcactaatcctgagaatgcaagccgtcataacaagttttacctcttgttgaagatcgaaaccgatgcagctcaacccgaaagcaagaactcgtcgaaataaaactaaagcaaaaaggtgacgatgcgcattgtattgaacgtgtgttaaaagttacatagggctcgggtctatttatacccgagaattacaagatatgtctataacggacacgactactatctctaacaaactctaagatactataagtctttgcggcagacttttgcccaatcatatctctaaggaaattacataaaacatcctaattaatagatacaattgcctcctcaggactctatccatttgcggcaatcaccttgaagcacctcaatccaacccaacatcacatatcaagttgtattgctaggatcggctacatcggcttacctaatccgactcagactcagccgatcttatcgtagccgatctggactccagccgatccctgctctgtttcagaactcgatctccacctccgacttcgcttcaatctaatcttctttcccaatgccgatattaccaaatttggttgttaacacttccgtccctttctcattgcgtgcttttttatgtgtgcatagccataatagcattttcaattcaatccacgcatccaacccatcctgaattatataggcctagaacgtgttttatcctcaatccactcatcaaaccaatcacaaaatcatatgggtttgacctgttataaagcacaaacatattactagtatatgagataatctgacatttcactctagatgccactccaagatatgtgttggaccatgctagaaataaaaaaaaaagagtttaaagcgaaatggtagatttgcatgtcttctgaatgacattaaagcattatatttttgagtggtaggtaaaccggccttacctcttataagagtggtgtatgtcaaattttctcctaataaatattatcttgatttcttttcatctattggttctctgacctctccggaggcataacacgtgtgaccacactagccttgccacatgttgagtcctcatgcaccaacagcaataagcctcttgaaaagctaaaaagctccaacatccaacaagcactcggaactcatctgcatttcctcgtgaaggacacgcgatttagctaaaccacacggaatgaaaaattatgtcaccatatagcaagccatacagacatacaaacacatcctaccaaaaattaattgaccaaatataatacactgattgtttgtgaaagttacaaaccttgtaaggcatacaaacgtttaccttctaatgtgacatataataatgtgtttgcattctatgatcaagctcaagtttaaacgtcttttttttggaataatatgtgtgtgctctagttgatataaattaattaatatgaaaaaaaaatatgctagcaatgttaacttgtaggaccaccactgtgtgtaatgaagttgagctatatttaaagttcttacaggtactccctcccatttgataattcctaccactttggataaggaaacatctaaaacatatctttgactataatttttcttttaatatatataataaataaatatttagctttgttaaagtactaagggtgagttcttttgtagtagttgggaactcctaccttctgtacgaataatgaagcatcggattaacgtatgattaattgagtattagctatttaaaaaatgaattaatatgattttttaaagtaactttcctataaaacttttttttaaaaaatgcaacgtttagcagtttaggaaaagcgtgcacggaaaacgaggaaagtggagttaggaactcacactaaagaacacaacctaaataaatatttattgctttcgaatgtttagttcccttagcaaaatttttcaccctgtcacatcgaatgtttaggcacatgcatggagtattaaatataaacgaaaaaataactaattacacatattgcatgtaaattgcgagacgaatcttttaagcctaattgctccatgatctgacaatgtggtgctacaataaacatttgctaatgacggattaattaggcttaataaatttgtctcgcagtttacacgtggattctgtaatttgttttgttattagtttacgtttaatacttcaaatgtgtgtccgtactccgatgtaacacgccaaaacttgtattccgatgtgacacgccaaaactttacacccctggatctaaacacagcctaaatatcctaaagtttctgatagcgaaagttctgatagtttgatcacaaccttatccaaaacaacgagaattatgcaacttgaggaagtatgataaattataattgaaacactacctcacagtattttctaagctaaaagggaacttgtaaattgctagctaggaaccaaccggctagtgcagctttcatgttgttgaattttccattcttttgcatcgacttcttcctatattttccaaaaagagaaaattaacaactcctttccttgtagcatctccaaaatctcaagtgttggctagggtctttgaaccatggaggcatggacaagtggccggacatatgactgacaaactgcaccatgaccatgacaactcgccacacattcaccttcaacttgtgcgaaaacatgttccccttttcaactagtaagctaataagacaatttgatctttaaattcctgaaaacctcagtaatgacacttattttgggtggcagatacataaaattataagacaaatccaacatatatataaatacaaatcatgcactgagattaccaaataaatactgtaggttttataaacctttcttttgagaaacacaagacaaacgtaaatgttcacatacacgtatgcacactcacctctattaacacgcacgcacaaagacactcacatacacgtgtgcatactcatccttatgaatacacatacgcacatccaattataatgagaacatctgaaaaattgagctgacatatcttgagactgatgaagttataatcgatggcttgctgtcaatggatacatcatctacgactaaaataaataaatagccataaatacgaacacccgtactaagtctagaactttaacctgcgtggacaggtttcaccgtaggtttgtaaccttgatggctctgtaaaacctagacagattgatgagtttggaaatgccaattatttataatgcatacacatcatttttacctttcctatatcaatatattaggcaatccctttgctttcttcatgaaaaaaaatcacaacatttcgttatgtgcatccccatgcttgccctcccaagtaccaacctaccttggttaacttgtgaccacactactagaatttcactccccagcactagtgacttttgatgccaataattgggagatcaataacctggctatattgtcaaaaagttgtttcaccctccaaattaacaatggtatattctctttgacagcaacttttcagctacatttgatggactaacacacatctaatttgccagccataaggagtagtcatataggctcatggctagttgcttcatgagcttgttaacttgttatgggagactaatcacaatagctggagtgggaataaaaaggtgcatgtggatagatggcaccaccctgtcatgatcagtgtaagagcaaatcaccaagtggtggtacaggggcttggatcagaacaaaaaaaaaagggtgacttctgaaagacacatgtccatgtgtatatacatgtatgctgtttgtatttgacatttggtgtgtgtagtgtagttgacatatgtttgactcttctgattattccacagggcccagctaactcctcctctagcttaaattctcctatccttagcatcatctggtatgtgtgtgccgaccagttagtggggcaagggttatcagttatcttcagacactaaacttaataattatgttatgtgtgtgacccagctgagcattatatatgttggtagctagagagaagaaaaaggggataactaatgaagcatggtgctcctcccagcagcttttttcagctgaaaatgttttcttctcagatgcataccatgtgagaaagttgaggctcaagggagagagatcatgagtttcattggatgtacctgaggctgccaaatgatcgatgtaggtgtccatgcttccatggaccatacaaaatattccccttgcctgtttgtgtttgttgttgtgttgagggggggatttcggaatcaattgggtgaacaaactggatcacaaagaagttatgataaccagtaaaaaagacaataattttcttagggagtgtctatatttcaaatggttgagaagatttcaaaagtttctatcacttttctcatttcttgaatgacaatccaatggttttcatcaattttcttattacttttttaagtgacgctatttctattgaatagtcccacattggttgtgtaaggtcaatggacctaatatataagtgggggagtctcttaccttattgactagcttttagggtgggaaagactatttacgaactttctttcttagataaaattattctaacctgaacataaatttatactccctccgtttcacaatgtaagattttctagcattgcccacatatacatagatgttaatgaatctaaacatatacatctaaatgaatgtgagtaatgctagaaagtcttatattgtggaacggaggaagtagtttataaaagattacaaaattacatgtaaaagtattcaaacttagataaataaaataaaattatatacaatgataaaatcgcacatcatatggcacaattctaggcttaacaatgtacaattttagatgattgaaaagttaattccatttttgataagcagatagatcgcatatatacgagggaagttgaccgatcataagtcctcccaccgtttggttaatatatattaagagaaaaaaaagctaaaaacgctaggagaaaggcaaacacacgctcctcgtgtggtgaaataaacatggcaaagtgtggtagccaaccaagcgcggatagtgaaatcggaagagaatgggggagaagataccctggacaaacaacactggggccatgttaatcgaataaccgtggcatgtcaacgttacaaatatacccatcagcacaatgcaataattgagctgacccagcaccaccatcaaaatcgctactggcatcgacccaaaatttctccatgatcgaacacacgcacacacatctccttccatgaccagttcatcccaattgacaattgtcagcgtagtgttagctgcagctcgatttagcccaacaattgatcatccacttggccgtcatcagtggcaggtcaagtaacccgacacacacaggagaagatcagattgctctaaatcgcttttaatcttttggttagttgcgtagtcgagtcccatcctggcaccggaccacctggcctgctgccggcgattatcactggctgcagatcgatccgtctcgctgattagattttagctttaatcaatctcaacgccgtgcatttcaccacccattatgccctgtctcgtttgctttttttttcttcttttctttacttctcttcttcctttttgtgctttagagagattaagcccatctcgatcgctacatcctccaaatatctcgctgatcaaaacatatcctccagctacgtggtcaacacgcgtgtccggatcactcactcacgctttgcatacatagttgctcaattattaggcttagtcgacaagacatccctgaaatgttatgtaattcatactctcttcgtcctaaaaaaactgattaaaagttttttttttgacgaaggatgtagtctgtaatgatagtgacagataaaggagtagctagttgaatagtcaggtcagctatagctaaagtttcatacaaaaatggtcagctatagctacgtggtgtttcctctgaacctatcacaagttcagaaaaggagattttttttttggtctgaaaattttgtagctgtctgtatctcccactaactcacattcctgaagaaacagatactgaatatacctcaagagttaggcacgcaagcagtgagaggttgcactctctgagtctcagattcttcaaatgagaatgagagggcgtgtgcaaaaaacgcaggcttcttgtaatgaccaataccaatctatcaattcagagtgtcttctctccaccgttcttttaacctaagagaacaagataacaaaagaggatattttgtggcgatcctgaaaggacatatacaaaaagtgcagagatgccaaaagcatctttgatcctgtcccatgatgagctgccctcatgccaagaagctttcagaagttgtcatcccacgcaattgatctcccaaaatgttcagttatcttgatacctttctttcttcttctgctgctgctatgcaattgcaactttgcaagcatggaagtgatcagatatcactaagtgctcgtggaaggtaggaaaggagattctattctagacattgcatacgcagcagaacaagcaactaaactgaattgaatgcactgtgttttgtttgcccaaggttattatatgatcatatgatgtatatatgggtgttttattctacgatgacaaggcaaaaggagcgcactgcggtttttccaatggtagaaggttgtgagaaagaaacagcagtggtgttgtcctgatagttccactgtatcttttgcatgaaaaatctcttgcaaagcagcaaaggagacatccatgattaaccaataattcgttgcagaatcgccgtaggtgcgacacaaccagatctggtccaaccaccaccagtgcatttaattctcagtattcagaaattatatccctatccttgcactcagtcccaaaggacaccccataaagcttatagaagtttttttttttttgaaactgatcttgaatttgctctgaaagacttctatgaaatcccttaatgatatgggttccaagccgtttcaaaaatgggtagaggctgaaggaacccaggaatcaaggtgtgtccagttttagtcctcttgcacacagcacaagcttgatccaatttaatataatatgttgctctttctccagaatgtccccctaaggccaaatcatgaaaggacttcttgagtttgttttctcaaaggatttcatgttcccacaatatatcatgtctttgtactctctgcataatttcttgagttgtgcatttggatcaagcctaagtttatattagtttcaatttctctgcatttttcatcttcgtttaggacctatttggtagagctctaactcctaaatttagctccaggagttgggtccggagtgaagttgtggagctgcctaaacccagctccacatctttggttcattttgtgagagaactccgctcagctcagctcccattttaggtggagctgaaactgtttagctgagctctagctccacagctggagctgtgccaaacaggcccttactctctacaacctaggtggctatctgggaatcactattagaacttccataaagtgatccaaggattggactatggataaagcattagcagttctattttcctttcctatcttaaatttaaatttatagtaataactcaacaacttgatgagtaatttgtgtcgtactccctcaattatcctttacttatttatatagtcaaaactggcttgttctattctaatggatgttccaacaattagtgcttcatttcttttatgctttcaagattgcgattcctctttctcctaggtagacattacagttgctttggggcctatttcaggagcggattcagtgtatgacaagtccgagcctcgacccagtcaaattttactccatatcgcatgagattagcgaggacactaaagcaatgggatatgtatatatttatttcatgtctacatgatttttgtaggaaaaaaatatgttcaatctaaatgaccatttgagggcttttaaagtaattgataaaatgatttttctctttatatgatcttttttaataactgacaccaatctttttggcactaaatattcctttctctatattttcaggagttttaaagaacccaacattgatatattatttccttttatttgcatagaattgacattatacatgtgaatcatccaaataatca

SEQ ID NO: 6928 - DNA, 572 bp, Oryza sativa
cagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtacccgacacccacccagat

SEQ ID NO: 6929 - DNA, 4721 bp, Oryza sativa
  unsure (1)..(4721): unsure at all n locations
gtgtttgcatttgacatgcaaaaaacaactatcttgtctatcgggagtttaggttttcctaaaggtacatctactctgggtttctcttcttatctgtatcaggcaataatagagccgacaaacataatatgaagattgaaattagatagaagtaaggtagattcaatgctttgtggtacctagcactgattaagacgacgaaaggggaacaaagaagatgttgcccctgtcttgtaagtaggaatccgcaaagaagagttgaagatgagggaacaatcagagaaaaaataggtggagatgaaaaatggactgaagaagatgaaagaagagaaggatggtttctcagaaacgaaagagggggagagctagggagagagaacttgctagagaaatggatagtgatagagcaggattagagtatgggggtctggaaagaataggggaatagcttgccatgctgctacctgtgttgtcttttccaagtcttttcgagggcaggtggcagctgagcataattatgtttattgttttcatactgtgtaggttgggtgatgttggttacggtttggagaacgaatcaattttgtttgccatgtgaattgtgtggtttaagatttgggttggtatgtctatctaaaacgctggagctgataagttttttgcacgcttctatgtgagaaatagcacacatgttacgatagtttaatagcagtcaataccagctatgcgaggcaatgctaacatgcgaggagatataatatttgccaccatttgttagcatccaacatcattacgactgatcatgataatctagccatacagagttatgttgccattgcaaaagctacaggttgttaccatctgacagcattcagcattatcacgatgaatcatgattatgtggaatcccagccacatagataatggatttcacctaaaagtctgtttgcacaaggagtaaggctagcttaattggtttgacatgcactcatgcaacacggcaacaacgcagtctctagaattatcataataacattagccatagattccttttgatcggtgtgaagaaaagacttttaataatggtgggcttctcaggatcaagggtaacagagcaaaaaacaatagccattctgcttgatgtatcacgccttgctgatggccctgcaagtatgtaggaaacatcatgttagagatgcagaagatctttcatataccgtcagagacaaccactatcattatacctgccaccagtggcaccatcagtatcatcagcagcatcatctttgaacagtttcttagcagcaccagttccaggagatggcctaggcctgtttttgtgtgtttcggtttccagttagcttggcagaaaggtttgcacccggtactctgatggataaagaaatgaagtgatgtacctttttttgtacgcctttgaggtgctgttcttagttgcaggggcagaagccacttgtgtaaggctgactgcctcatcatcctatttgacagtagatagagttagcaaatatgatatgcaatatatatatgctacaaagtcaggcataaaacaaactgacctcataacaatcttcattatcaccagcatcctgtgcaggactcttggatgcatattcatttcctgtgttcttatccttttctgtattgattggtgggctactcagagtgcgttgagcatcactgaacccagctgatgggctggctgctatgggctggccaatggaagtatcctgagatgcaaccggcgatagagccatgcaaggcatcagagaagatgtctgggatccagatggagattgcaagagagcaagggaatgactctgagcacccttaacaactctgttcacttgaaaagcaacaatgccgctagagaccgtgttctctgtgaaactcacattccacacaaattctttctcaagcagatcagtgatctctctggatatgcagcccttgccagttggattttccagcatcagtgcctcaactgaacgaccaatcagcctctgcgctaaatgcccaaagataataaatgtagtatctcctgtgtcatctcctgctatcacactgagtttgaacctacagaatgtaatgtagcattagctgtaatgtatcggngtctgtattgcttcaattgctttatcacgactcacctaggtgaagctgagccagttggggggcatgtgctggttccacacctatatagattttcatatggctttgctgtcttcttgcatatatcgcatgcagtataccaccaagaatactccatgttaagtttctttatcacgacagtcactgagaattcatgtttctattaacatcagacggaaacagttaacacagttcatggcataatgcagattataagttcatgaagtgactatagcaaggtcacaccttgaacttaaaagggtgcgggtctcttatctcagcgattgtcttctgttcacagttgttctgaagaataggtgcagctgggagatcaatccatttgattgcctcgtaattcccttcaacactgcacaaaaagaatcagtttagctcaaaaaatcaggacaaagtaagctaagagaacattgtctgatagcgaagtgtagagaataaacctagcagcgagggtgttgacctctggcacatcaatatttatgtaccatttgcaagcagagttacccgacaacgaaacattccctataacaacagtgtcccacgctatgagaacaacagctgaaaacataggacaaaatgcaagcaaggaagctaattgacttacatccatgtcccctgacaagtgtgccaacaaagataactatctgtggcttctccttgccagcactgagaatttcatctgcaggaaagcttgtagctctttctccccataacacaatatttgttgtctcatttctatgttgtgtatgtttaaaagaaatcaaagaggaattgtggtatggtaagtagttagtctcaaacccaaaacagtggtgtgttggaataaaagcagttgtcagggcaaggcaatatgcccagtatgaaagaaaaatgttatgacagtgattgtctgatgtagatgacagattatttgagaggggttagaaaacatcagaaaatgcattaataatatggagtagtaaataagggatgagtgctaactcagcattgcgcatgtagacattcctttttaaactgtcactgtctctaacacgtgtccgaacagttgtcacagatgatatgtcagtgatcactccaatcacatctgttattttgagagcaagaacaaaacacatgtgtgagcaaaccagaggtagtaatataatagataaccaattatagaaccatatctgcagtacctgtgaaagagtctttcctgtcgacacgagagcggagctcttggtaaggtgtgagagtataagcatagtgaccaaagccagcttgtacgtcaacatattcttctataccagtccatctggtgaaattgatcatcatcttgttgtcaactggcctgtaatgtttggtgcatggcttgacccgatagtaggtaagcaagtagaccttgccttcgctgatcagtggtttgaatttcttgccccatggaggataaatcatagcagcaatggcatatccctaatgaaacaatactgtcagtaaaacaaatgacatattgctcaggttttacagcagataaagttcgcaaagcaatcaccttctcaccaaccaaaacaagaccaatatggcgtaagtcgccttcatcgtcctggtcatgatattcccataaccttgatacacgtaccaatagagttggattcccatcaccgagctcaaggttaggaatctgtacttcacccatatgtaaacatagcaaaaaaaacatttggtttgagagatcagcgcacattgaaattttgaagaagctaagtgtgcaagttaagaggtcattagatgaatatacggaaaaaaattcacatggacaatgaagagcagaaaaacagaggcgcacaacagcatcaaacatgggtagtgcgagtgatagctaggtacaaacatcctgcaattgtaaagatttaatatattagtgcatggtatggcatcctggtaatttagctagggatcatccaggaaaaccagacatcaaagtataccatagatgtgactgcttgcagtacttcttggtaaacaacatttttggttttcgtacaacatgcctcgtcctcatcctctatgagaatcctaagaccttctcttgatgttgatctagaaacagcaacataaagttgcccatgtgtgaacacaggttttttcaagtacacgctgactcgtgaaagggtttgtccttggctcttgttaatcgtcattgcataacaaacacgaacagggaactgtcttctctaaagcgtaaaaggccacttaggacttgtggtggtaagtgcaattcgtggtatgaatgttgtctcgccaatatttgtcccagttaaaattacacactctaacaacctattaccaagagaagtgaccaataaccttgtcccattgcatagacccatagattgatttaggtttcgtagtagcataatcgtcacaccttttttgagcacaagcttgtgcgatgggaagttgttgacattaattgaattcaaaaattcagggggtaaaggatgtcaaagtcaggtaaatgatctcttgattttgaaattgtatcacatattaaatac

SEQ ID NO: 6930 - DNA, 15265 bp, Oryza sativa
caaagcatcgtctatgagtcatgggagcctcatcccagattataagagacgttttctgaatcaaatctgcaagcatagttcctcttttaatggtgcaaatgttgttttcatctatgtcgatcgggattttaaatctagaatgagcagtgcgccctctaggtaggagtagagaggcaacccctgaggaggcaaccgctagaacaatttttttctcggatcttattttagaaatcagtgtattccacaaaaatgttttgcctgtcccaccatggccatagacaaagaataacccaggcctgttttcgttcacccgttgcatgattgtgttgaaaacatttctttgatcagtatttagcctaggtatattcaaattagcttctgcagttagggccgcaacatcaagagcaagttcttcgtcaaccatcctatttcctgtaatgtcatctgaataaattgccggctgcggtaagtcgtaatcatcaatgctaccaccactgtttgaaaacacaatgtgaagttctttcattaatagagacaggagcctatcaggaggtattacgtacgaaggattcgataaagcagttctgacacgtcgctgaatgtcatcggtaaaatatgtccaatatttttcaaagagcgagcgcacatatccaacagaacaaaacattacaacgggagcaaacaactgtctcaattggcccgaagacgcagatactatagcctcatcaaatagcaagtgccattcgttatcgctttcaagtaggcctcttgcctcgcatgcttgcctaaaggtcggataaacgataccatcataggtcctaacatcagcatagcacgttgcacctttcactatcattaatagcattcgtaggtagtagagctcaccgctaactgggctgacatagtatatcctgcctattttttcacatggtgttctaggacgccaactacgtgagatgctgtcccatgtccactctctcggaaaatcacagtaagtaagcgttcgtgcactgttatgttttctgttagcctcgaaccactcggttagcatcgtttttttggctacagggctggatagcaaggactttaggtcagaaccttttttgtatcggacaaagttcatgtttggaaggtgcacagctaggcgttctacagaaggcactctgtagtgaatgtcaaattcaaatgcatgccaaagggactcacaggtggacagaaatcttgcatcgatatattcttgtatttcatttcgtggagcagtacagttttcagctggtttgttcggtgcatttccagaaatctcaaagaatgcttttgttctatccgcccctttagtgacatatttgaagagatatttaatcatattagatttattgcaccattctacattaatctgagcctggtattttttcagaagttccatgttgtagggaacaacccatctgttgtcaagattaataccatttttgagaacataccgaccatcattgctacgtttgtaaacagtgaatacaaattcatccatgatggtctcttcttgaaaagatttagggaaatgcttagagcactctcccttcttcatacaggagcatgttttgttcacatcgccacaagggccatggatcataaattcatcaaccaaggcatagcctaaagggtcggttagcacatcaggtatttcagcggaaataaaaccatcgacaataggagcactaaactcaatatttcctgcagcaagccaaaccaggcaatggatatgaggaaggccacgcttttggaactcaactgtatataacactacatatagggatagccaatgttaggacctatacagaacataaaaatggaacttagaaactaggtaaacatcctactagcaaggactggaccaaatgtctttccttctctaatatctgaaatgaattcattcactttcatgttaaacaccctcacaatcatatcggaacgatcgcttggcacctggcctggctcaaacagcaaagcatcatatatttcttgccactttgagttgcatgtaaaggtcacaaaaagatcaggtgaaccaaaaacccgacaaatagccatcgcatcttggtaattttgaaccatgtaacgacgccctccagtaaaactggagggcagcacatatcattggccgacagaatccccggaatcaagaccatgatcaatcgcatcagctattccctggacagattcagaacgcaggtcgggctggttgtcgaaaatgtacttaagcctagattactcaacagttgagtatgagtcaacacataaggaatcgctaagacgaccacagcaagtatatggatttggtttgttcaatcggtaatgtaaacgatagtggtagtactcaagcatggtaacatagcgtctggaggcaccagtgatgctaggaaagtcagtgtactttatacctagatggaatcctcgttcaccataaggaaagagcaaagggtactgaagagccatataggatgggtgcaaagctgagacacgtcgcaatctagcatcgcaagactaaaccatcacatcatacatgtattcgccagctgagtaatctccagctactataccagcaatatcaccactcgttggcaaattgtactggatttcatctcttgaatcacaaccaagcaatctaagtgcaatcttttgatcaccattatcttttagccgatctctagcaaagcggaatgccttaaccaaatcattatgctcatcaagcatagaactaagcccattaacaatgtctgggtctggttcatcagaaggattgtctttttcgtaaatattcattctgtttgcagtttcattttcagtgtcatatatgtaaagttgtgcaaatttaggtcgtgagccttgctgtggcagcaggctgccaataccttggtggacaaccccattaattttgaacacacaaggtgcggtcccattgtttatcgtcttatcaatgttggctcctgaggaagtaaacgcaaaaagagagttatatgatcggatctggcgtaagaatctttttgatcgcacactaccatcaaattttaacagttctgctagcaaagaaggtggttttttcaattcaggcagactaatcttaccacctctacagcataggttgtacagaatcttgcgctgcgagactacagatcctttctttaccctctcctggtaccagaaaacggcaccgcagtgtggacattcatgagatggaccaccatagtaggactgatgagggtacaaagctgcacagcattgatatgagagtacgacagacagtaaagctgaagaaattggtgtagtatgcaacacaacaaacctttcaaggacgcaatatagtcttttggcaaaggcaagatgtcatcagcactgggcgtgggacctatgcgaaccaaaattgtgtgcaaaataagcagtatgcggtgagtcaacccttttttaccccgcagggacacatggaaggcataaccaaggtaagggacaccgaaaaatcgtaccgttaagaataccatcgagagaatggtttgtctgaccaccagatattttcatacgccgcctttccctattaacggcagcagcacttcgtggtatatctagcaatgaacttttccctatgtgttcaaaaatacttagagcactatccgagcctcgcttcgtttgtttggtcaaaatagtttttcggtttattttatcaaaatctggcttacttttggcatttcctaccaaaggctcactgtcaatgggctgttccatggatggtcctgcaccagcactggtaccctgctgcccaacatgtacagattgaaccaggacagaacacatggaatggttgactgactgtgaggagctagaacctacggcagcaaaaatgggagcctgcaagtagcctattggaccaaaccaatatgtttacttacctgtcccagaaaccaaaagcaaacatatatcagaaacgcatggacaacagaccctggcctatggaagcatgccgccttagccggctttcacgtgcgcgctgaacacgcaatgctgcacgacctgacatctgccacaaatcctaaatcacaaaacactgttccctgcaacgtttcttgaaagacaaatgcatcaaacaatccagctcagaacacaatctcaacgcaagcatgtatacacaaaagaatgaatgcacggaacagaaatagctaaattaactgcaaggatcctggcaatacaaaccaactcagcattacaaagtaaacccaaactctgctctaaggttgttgtgtgctatagaagaagtgttcttccctaagaaaactaaaccaaagtgatttgcactggcccagcacaccctcacacggcagatctagcgccccatagcgtgactggagcctagcaagacatgaagccgctgtgagagcagcatccactgcagaggatgcaatctttctataggaaagcagcatgtgaaaattgtagtcatgaacagcgaaccggtactttgcttgcatgaacctaacaacctgctgagcaaccatctcgtgtgaaacaattagcggatctgttgcagcaacccaaaagaacttcctagccagattgttggatgggtgagcctgaccactggcagggtcttcaggcggaaggataagctctacaccagctaacagcgtaccatgcccatcaagctcccaaaggtatgacaccaagggcaaccggcaatgagaagctgcagcattcaacaacgaaacgaacgaaaccccaacaacggccatcccaccaacagcactgcgaattgcagagagagttttcaaacaggagataaaccacccttaaacagtactttaaaggatgaaggtgaggaaggaggcagtgtgcaagaagaaatcgtcaagaagcaacatatagggcaagtatacagggccaagaccaggagacactatatctgtccctttcgtcaagcgtgggaaaaaaagcgctgacgatgcgtcagccccaccaacggttagcgccccccccacttcccggcccctctcacccaccaaacatataatgcaatagagcaaggaataaaggtgcgcaaaaaaaaatgcaagcacccaaaaattttaaataacagccagagcaagaaagcaccttcgccgccacgcaccggaactgtcacagcacccgccacaaggaggaagaaaaccagaggaaagaaaggacctcagccggttcggacggaaagaagccctccctgcacagcacacaaacaaaagatgaagcaagcataagatggatcaagaaaaagaagaaacaaaggtgtcgctgacctggccaaaacgcgaaatcacacaagaaggtgtcctcctatcaatcggcagtgaggtcgctgcaagaagcacacacgaagtaagcacaaggaactccgccaccaagcacagtcgatgcgaggatagcacatacctcgccatagccacgaacagcaacagagaggccggagaagaagcggaacaaaagggacagcaagacggaagagcagtacagtcgaagcaaagaggattaggctggagaagaagcggaagaaaagaagaggagaaaaatatggcgcctttcttgcgtgggacgccgtctcgggcagatctgtaccacgttgtctaacaccgattggccaagcagtacatttgtggggcccacccctctgtccacaaccaccctcgccataaaaaatgggacccacacgtctgcccaccaccacacgcgcgatcaaaaaacgcacacctgggcaattttcacagggcaacatctacccaccccaactatagcagcagggccacccaccgtacacagcggcagggccacccatcagcgaccgagctgcccgttcccgtcgaatgcgcgcataaggaagagggaaaaaagggggcgaggagggggcgaacatgggggcagcagaaagagcagcatgcagcaagaatggtgggagcccacaggacagaggcacatagaaaaaacggtgcagccccacaggacagagacacaaaaaatttaccgaacgacgtggatgcaagtgcaaacgaacacgctagtgcaaataccgcgcaaatcgctccgggaggtgcagatcgcccttacctttaattactctgattatttaaaaggaagagaagggatctttacaaaaatgcaaacacccaacaacatgcattgaggtattttatatctcactgacaaatggcccaaactaaaaaccaactgaattttgctttgcacataacagcttgcctcttgtatcactgatgattggtccaacctatggtggaccccttgtacagtctatggagccatgcaacaaccaaagagtttgcatctatggagagggtaaagcgaacggtaaagtaaagcatgtactactactactactaaccatgaacagtgcaacagtagaagtagctacgtggatggctgtggcagctcaggctgtacctctctaggaatatagatataggtagatgagcccctagtaaaataaggcctatttaatttgaaatacgcgtgcaacaaataacacaacattctctaagtcattctttaaaatacacgtcaacaaataacaaaatattcaatttaaaacacatttccaagaaacaacacaactttgttcatgtggaggaggaggtcgatagggtacacacaatacataaattgatgacattgcacaacttcattccacaaacaaacataaccctaatagtagacacatgaatgagagcacacacttgtctaaaagaaaacacgctctaagaagaaacaacatgtgattcttcttctcttccatgtcaggacaggaactgcatgcattggaactaactgaggaatggaagaatgatgatgggaaacatagcgtgacaaacaatatatgagcatacataaacatgctcttacgccaagacatgtggttggacggccggttgttgctgtatcagagagggcaactcaagccaaggtcctccttatcagctgcatattgtcccctgcttgccgcaacgatgccaggtgcacctagctgccatatggcctacatgaccacaaatccaacaatggcgagggcattccttgtagttatgcatcccttacagaaagagcacttctcccagcttgcgcttgatgacattgttttgtattgttcgagtttcttctttgactgtatgattatgagtttggcaatagactttgtgattatggatttgagactttatatacgagccacaccagatcaccacgggcatatttagtatatgacaagcgggggccttggccccttgtcaaatttaactttatattgtatcccacatgtgtctgttatatgggccccaaatcacatgaggtatattcaatttaaaatacatgtgcaccaaacaagccattgatattcaatttaaaacacatgtccaacaaataacacaatatttattcatcgaggagtaggtcaatagggtatacacattacagaaattggtgacacgacacaacttttttgcataaacaaacataacccaaaaaatacacacttgaagcatagcatagcacaaacttaattaaaatgaaacacactctaaaaagaaactaacacatgatcttgtccttctcacatgtcagggtcgacatctcgcttgtgcatgagaattaattgaggaatgaaagaatgatgatgagaaacattatacatgcatacacaaacaggctcttaccaccaagacatgttatagagagggaacctcaggcctcgtcccctacttgccacaacgagaaaaatgtcaagtgcacctagctgccttgtggcctacatggctgcaaatccaacaatgacaggggcactccttgtagctatgcatcccgcacaaaaggagcacttctctctcttgcgcttcatgaaatttttgtgttttttgtcacgtcctgataaattcatcccgaattaaaaatcattcgctaaaaggaataatagaattaattaaaattcgaaaagaaattggcaaacactaaaatacgtacaagaaaaattcaaatgcggcccggagaatttttgttaaattctccttggtctaaaaggagccctcaaattttacttgaattttcagagcacaaataataattattaagaaataaacaaagttaaaaaggttttataaaaagaaaagctctaaaaagtcttttttcccccccccccttccccctcttgggccggctcggcccatctccctccctctctctcctccccgcggcccactcggcctctccccgcgcgcgcgccgctgacgggcgggcccgcccgccaccctcgctgacgggtggggcccacctgtcatccctatcctcccgccgctcccgccgcctcgcccgtgccctagcgccgccgccgccgcgaatcccgccgcctcccgccgtccccgcgcgcaataaagagggggaaatcactccccgtgattccctctctctttccccccatttttctctccctctctccctcggattcggttggaaaccgctcccgcaaacctcgctggcgccattgatggagcccgagatcgccgcgccggttttcttcccctccggccgttctctccccctcccaacactatataaacgctccccgtgcctcttccgtccggttccgcctctcgccgcccttcctcttcgccggatttgagctcgcgacgtcgctctctctctccgccgtcgccgccgagctccggtccaccgccgtcgtcgccccggacctcctcccgtttcggcgtcgccttcttcgggttcgccgcaacctcgccgacctcgtccacccctccgtttcgcccgccgaccgccggaacgccgccgtcctcgtcgacccgagccgcgccgccgccttcctccgctccggtcgtcgttcccgtcgccgccgtcgacccggggtgagccgtggaccgccgtttcgcttcccccttccctcccctctctcgggcgccgctccgccgcgccggtggtcaccggcggcgaccatcggggcgcgggtgcgccgcctcccgtcggctatgccggcgtggccgccttcgggtgcgccccgcggctgccatgtggggcccggccgtcagccgcccgcgccctcgggtgcggctgacgcgtgggacccacggcgccggccggtgtgagccgggtgcacccggtccaccgtggaccgagaggctgccgcgtgggccccactcccgtggacccggtccgcgcgctcctctctcccggctgacgcaataaatctattttaaattaaattttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttagtagagtaaaagccgtttcttttccgttggtcgtgtagacgctgcagcttcggaagatccgctcttcgtggaagttgaagctgacgtttgggaaagcgagcaaggcaagtcacatcatccttgagcatattgaatcccagtttataaaattattttgatttaaattaatgcattatcgctttatttaaattcccgcgttatcactgttttatttagccttgcctatttacctttgttatggccttattattattgctattgttattattaccttgttcactctagaataaacaaaaccccaactagtgggtactctattcatggttccactagtataaatttaggtagatgcttcgctgattaattaggcaacattaggtgattttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggctggtgtcctgctgctagggggctcaatcctgcctgcctgtcccgggggttccggccgtaggtggggttgggtcggtactcttatttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtatagctctaggatcgtgtttacaaaatagctttgggcaactaagtgacttttaaatgctgtttactgcaaaacttaacccctattattatccccttctacccccttacattaattatgcatctccggtgtggcttgctgagtactgtggttgtactcattcttgctctatctttctccccccttcagtaagagaacctttggagaagaagtcttaggtggagtcttggcttataccccagttgagcgcctgtgaagatggagccgtaggcccgctagtccgctgctatttatttttgattgccaggcctgaagtgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacaagctggtatcagagccatctcgactgtaggataagccaagtggataaaacctaaggacatattttataaataaaactatttgcgaaagttcctctttttcttcttcccctaatgctatttgcaaaaggtttacccttttcttccttcttcaaatttcaactagtactagatggtcaggtcagtgaagaagaagacatcgtcagttgttcgccgaagctccggaagactgcaggatccgctagcgaagtggaggaagcagtgaagccagctgtgaaggagtgaagatcttggagaacccgtcgcagaacctaagccaccctatagggtagtgttgttagtcgtgtgttccttgcttgtgtgtgtagcgcgtgctttgcatcggtgggtggtgatgtaaccatgctaggttgtttgcttaatcaacttgcagaataagtgaaacaaacaacacatcaacaagaagagttagttcctttaaggtcttatctctagttctggtctattctttcctagcttgtttcctctctcacctcaatccctgtaacagatgtttaacagagaaaaaggaaagaatgtcagcgggtatgcctcaagtaactcaagttttcaactcaatccaccactggcctcaagagagttaaccagggcacacccttggtccattccgagcatgctgcttggttcacagctaccattggttggaagtcaagaccaaaatcagtatgtgtttgatcgagcatttgccacccaggtcgatgagcttccaatgccagaagaggatgtccccttttgtcacgattgtagagagcaaggacactatgccctgaattgtccatgggtatatgccaaagaagctccttcctttggtttagcagggcaggcatcgctaaaccagcctcctcgcaccaagtcaagcttgcagcctagtgtgccaagtagagagcccaatggagagaatccattgaatcccgagaattgctttcctcctagcctttcgtaccacgtggggtcacgtactaagcaagccaaaggcaagaagagtaagaatcagaagagaaaagcaccgatgcgaactgaagaagaagtacgtaagatgactattaccagcaccgaatggcctccagcagggataactattcctagacatcaaagaggaaataccttccgaggtgcacgacagttgacccagcacctcctaagccatggtggcagagtatctgatagtgaagggtcagatcaagtctcctcggatgatgaagatgagtctccccgacatctcggcgaggaagaaatggaatcaaaggcatgcacccgttgtggagaaattggacacgttgctagcatgtgtcttacactctgccctcattgtgaggaagaccatccaccaggtgaatgtcccacccgcaaggtgacatgttttctgtgcgaaggtacaaaccatgtgcccaaggattgccaactcagtgtgttgttgaccaagaccgcagaaatccaacgaacaaccctacggttgtctcatcagctagtcagctccaatagcaacatcgacaatatcatccacaacaccaatgctcctcctgctccacctgactctgcaataaatcatagcaataataccttcagcaccaaccattctctgcaccgacagcctcagcaaagaattgttgtcgatggaagaagttgtgtctctccccgacctactccaggccgagcaaagggcaatcaatctcaggagggcgataccaagcagaagaccgttctctgcttcaaatagcaatcagaaggaagcttctcctgtgaatgatagcaatatgcagtcctaacacatcatcacagaaccaatcaaggatgcagtcactagaacaatgccagctatatctctccagaatcaaaatgagcagccacgtttgtggttttcagttcgctacttatcattgtgtaatcgggagtttgcagcaatcatgtaataaataaatacattcatgattataaacaatgagtttgttatgtttatggatgattcatgttgaggatacaatgtaccgatgataagcaccttccctttttgtttaaggcagtgccttgtattcgtgtaataagggagaaatgtgtaatacagacaagttttaagaggattctattggaagatgcggatatgtgatcatgtgtataattgtttactgataaaggagacctagggtctcatttcagaggaatcatattctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcgggtatacctacaaacagttaagaagatccaggggacatcaatatttgagaacatagtagtcgatggttggtaattagtctatcaggtatcagaaaagggtcaaaggtgatatggcagaagaacaatttggatgctccccatctcgaggaagcactaaagaggatcatcggcaattaaaccctagtggcatagatacagatagcaagcaatgtatttccctgaaggtagtcagtgcagctttttgacgaaccacatcaaggtttcactgaaaggcagcaagccaaaggacttcatcgtcaccagaagcgtccgcaatccacattaaagagtaccacctgttagagataagccgaaagaagattgataaaagagattggcaaagatgttctctagcaggaaagaagtaggccgaaaggtgattgataaaggataaacagaaacatgctctgcatcgctcaaggaagacccctgatagtaattgccccgcaacagtcacctggtcattgaggcatcatgaagtaagcaagacgacctaggtaaaagtatttctttgaaggcaaggaatgaaatctttaactcggtatcagatgctacacggagtgaaaagtgcaagcaccggttaccaggcaatgccatgtcttgggagatgatccaatgggaaagagcacatcaaggttaaaggtgtaaaggaatacgttgaatgctaactaaggacaacctgaagataatagtgggaaataaactgaatgtaaagaaagtgaatccgagttgtctgttcatgggaactattcccagttatgaaccaagtgatatgttcgaagatagtctacagaggtcagacaacgaagcttcagatttggcaggataacgatcaaacaataagaaatccagcaataaagccatttgggaagacgtcaaagtatgtcaagtgggataagttggttctcttgggaagcataattcaaaggcaacgttatcgacccttgcatcaaatagcagaagtagctattacccggagaccgggaaagctaatatgaggcagctggtggcaagttagaagtgaatgacaagcatgatattcttatgatgacaaacatggtatcctagtaatgacaagctagtgttgacgcatgacatgaagtggtaacttccatgaggttgacgccaaaaatatggactatgcgaagttctggaactgaagcaccatcttcaagtgccgcaacccagtcgaagtcagctaaaggttcaaccagggacaagtcgggtgaagagaagattccatctgcaacaggagatcgagccaagcagtccagagtggagaagttttgttaggcaagtttgttatagaagacggagcggaagaagtcagacaagaagagaagaccgcccaacctatcttcttgctagcctcctcgaatctcggggacgagattcttgtaaggggggtggatttgtcacgtcctgataaattcatcccgaattaaaaatcattcgctaaaaggaataatagaattaattaaaattcgaaaagaaattggcaaacactaaaatacgtacaagaaaaattcaaatgcggcccggagaatttttgttaaattctccttggtctaaaaggagccctcaaattttacttgaattttcagagcacaaataataattattaagaaataaacaaagttaaaaaggttttataaaaagaaaagctctaaaaagtctttttccccccttcccccttttgggccggctcggcccat

SEQ ID NO: 6931 - DNA, 34963 bp, Oryza sativa
atcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtatagctctaggatcgtgtttacaaaatagctttgggcaactaagtgacttttaaatgctgtttactgcaaaacttaacccctattattatccccttgtacccccttgcattaattatgcatctctggtgtggcttgctgagtactgtggttgtactcattcttgctctatctttctccccccttcagtaagagaacctttggagaagaagtcttaggtggagtcttggcttataccccagttgagcgcctgtgaagatggagccgtaggcccgctagtccgctgctgtttatttttgattgccaggcctgaaatgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacatttttgttcgagtttcttctcaaactttgtgattatgggtttgaggctttatatagcagcaatagcatatcgccaaaggtagatttaatgtatgacaagtagggccttggccccagtaaaatcctatcttactataaagttatcccccactaactccttgagcttgacatgcaaagatgccacatcatcatccactaacaagatgccacatcatcatccactaattaacaagatgtcacatcatcatccactaacaatcatcacatttaaacattatgcaaacatgctatatctttagagtttttataatttaagagcttttcaaatacaaacatgttaaattatcatccaacataattcacataatgtttcaatgtacatctttattatgttttatgatatcctatatacttttatagttcatcctcacttagttagtacttaaatgattaatctatggtccaaattatctttctcctttttttcatctaattaattcatatcacatcacctgtttttagcctttagatgattaatctacagtccaaactatctccctacttttcttcttccataaagtcataccagcttactttttatgtttgaatcaccattctacatactatttaaatttaaattatcataaaccacattaatttatttaatctgatgttatctagctatcttacacgttatttttttattattatcatactaaattcccgcagcaatgcgcggggtttcacctagttttactttgtattgtacccccacgtgtgtccatcatatacttactccggtttagctaacacatcacccccactcctcgggtacttttcttttcttcgcgagcttcgtccttcacgtcggtgattcagcactgcgcatccactctaatcttctctccaattgaaatgggaattagttaaccaaattaagagaggtgaaattataccctacctaaatttgaggatctcaattcccaaatcctcatagcaaacaaagtgaaaagtaaaaggatattcatgtcgcctagagatagggtgaatatgcattcctaaaagcactcgcaactgaatatacactcccgtcagagtatctgaccacaaacactagatactccgatcaacatgttctgattgacaaatttggtcaactggatagtctggctaagtaccagatattccgatcccctaacaacacctcctaaggagcttgtgtcgagaacaatctcacacaatgatttgtgaaggttttccctcaacaccacaagggaagaggtaattgagtgtaaactgagctagattgttacatcttggtggttgcttagaggctaaagtttcttgttggtttgctagcttggtgagatctacaatcgaaagagatctggcttggctccttggagtgttctaccacaagcgatgacaaatcagagatttaggaacccaatgagaaacatactaattaatgtcttatgtactgatgtttgtgatgcagaagtattatcgttctaccctcatagatttcttttttgctatataaatatgatcagaaatttgaatgccgatagcatgtatcattatactctttcataccagaagaaaccagatcttctaatttttatgtacttcaatttagaacttgtttggcaagactccaactctagctctacctcttctagaactggagcccaactaaaaaaagagagtggactggactagaatgatctgaaaaagaactagagaggtggagcaaggtctgggacgttccacaactcaactccaaactccgctccaagagttagattgaggagttagagctctcccaaacatgtccttaattggtctatcagatatattcagaattagggaggtatgaaaaaagaggttacgattttgcaacttccatttgaattttttttaaatctttacattctttaatcctttcattttaggtactgttcctgcttgatgggaggatttagattgaaacatgtgtaaactccctctattttcttaatagatggcattgttgactttaacatgatatttgaccatttgtcttattaaaataatatgtctcatttttttcttttataacttgttttctcatttaaaaaaactttaagtatggcttatattttttaaatttataatatgtttttaattaagacgaatggtcaaacattataccgatagtccattgcgtcatctatttaaaacggaggtggtaacatgaaccaacctaccagcccttattatgctatttctagctcttttaacagcatttaggatagctacatgcagttctattcatatgctataagatctatgcaaaaatattttccttccaggtcattcatgttttggctaggtttgggtatccgtgaagcactggttgttttctatttctatgtttgaaagcactatttaacggatctcctaagatttgttttgacaaaaaaaacaacaagagggcaaactttacaagagagattacataatttgaatttacaagaagtttatgctaaagtgtgtgtccatattgccaaatgggtatgtgttccttctttaccatgaacatatgcagggtaaaataattcctgaagttggtcttccataggttccatgaaggatttacatagttaaaatttttattatccatatgttccaagtgacgatgacatgacttcaataaaaagggctttccaaactaatttgctgcaagtacaatcatattaataaagttcatatgcaaagtcacaggtgaaaaaaagatgcatcacatcctccagggcagcactatacattgcataatacacactctggtcctccttggacgttgtattgtcttcttttcaacatatctctagtgtttaatctatccattaaaagaatatagagaaatacctttagattcattgtacattttcttttccatatcaattttatcggcagaggtggttgcaagtgttcataaaaaagattgtaaacttttttggtgctatactgaccagtgaccagtactccatatattgtgttctgagattattgtatcttgaattgtactttccatttattgaagctgttgtaaagactaaactgataaaggaagagtgaaattgtcgtctatgtttgcacttagaaaaaaaatcccttgttgattgatcttcatttctaacaaaaccaaaagatcagggaatttttcttccaacatatgaccattcctgttgtctttctagcaaactattgtatccctattccgaatgttattttcgatatagctctatagagtggcaataatcagaagatgtctttccgccaaaggaacctttttcagagcaagcatgcggaggttgctgagattggtagttttctgtccaaactaacttgacccagcgaagatctcttctattataaagtttatccagttatttcatgagcagcgctatattatggtgttccaaattaatgattcttaacttcccttttgtttaggttttttaccctatcctaagctgccaaagaaccactccctccgtcctaaaaataaaccaatctaagatgtgatatgatattacatagtacaattaatctggacatgctatcctagattcatttatttttgaatggagggaatagacttgagttgcataccattttctcggtaaacaacacctccttgctctgtctttatgttacatgatttttttggaaccttcaatgtacacatgtggtaggttggtaatgatgaaaaaaatagaattaccactgttaactttgaccatgtgataaataaatttctatggaagatagcctcctgtcagttctatctataagtggaccacagtcaacaactctggactttgttgtgcaacccagaattcctgctatatgatttattgaaattaattttaaggcctgttgactggacatgagtatgaagaagggacttaagaagaaaaaaaagcttatttttaatatacttttgttataataatagtatcatctacacattgaataactggaaaataaccatcttctcctaagattgttgtgcaggttcaatggtcaatgtacttctttccgaagcttctattcttttgagcgctaatggtgtagagtaatagcggttgaggtaggggagtttccccgtaggatctgatgtcaaggtctctgcacatcacccgtgagccatctctgtgcttccttgaggttgccactgccacggacgaaggcagaaaaatctcaagcctagggctggtctgattggacttaagtattttcacaaatcgtgtggtattttcacatgatttgcatggaatttcagagctaggtctagggctcaatctttaagcccacccccagaattttaaattaagttgtgtattcaaaataaaaaatgggtcaaaagtatgatatttggcatgtataatattacatagtattgatggtataatacatagcatacgtattatgtgttggatacaacctcttgggttaaatacaacaactcattttttatacgcacgcatcacatattatatatatatatatatatatatattgtaattaaaaatatgggtattcatcctaatacccttgaattgtgttggggcctcccccgagcagcagaggccaaggaggtgagggatgtctgtcgcattatttgtgtttatatgctctcggctcacaatgttctcttacatgggccttatccaatgacatgggcagccttcaactgatctgagttacaccctcacagagaagcactaactgatatttgtgatggcaatgacatccacctccctcaactgcctttcacatcgcaaagatgtcctcacaacacaactttaaagcaaaactggcaacaaagaacaacaatgacccgaattgtttgaatattcttttgcactatatttgaaaaaaattaggtactaaatatatttattgtaatttttgttttcctgttgtaacgcacagacattgtgctagtaataaataattcttggtaaattatatgatatatagatggtacagattgtaatatctttgaatacattcagagatatgccaaattatgtgacgcgtggaatggatggtacagattgtttcgacaagatgtgttttattaatgatttattcaaagatatatgacttgtttattgatttgcctggctagattaagccaaattctgatgatgtttttctgatggcgaactcaaacggcgtgtctgaagtggtcttgagaaatgaaagtgacgttttcctggggcagccgtccacttttaccctttactgtgtgatgctacaatggcagaagcgttggcatgtccttgagctatgcagttagcatctgaattgggtgtttcaaaatcaatccttgagaccaaacagtctggaggttcagaagatggtagctgatgagaaagtcagcagatcaatatatgtagtaataatccaagatttgaagcaacggctaagtttgcttcatgatttcaggatcaaatggatttgtcggtcagccaatatggcgtcccattttttagcaaagaaatagtgtgctacgaatttacttcgacctatttctctgtctcaccagagtgtttaaggtcccagattgttaaaaactgtaatcaaaccggttccgctgaaaggaaaaaaaaaaagaaacctaagctgtgatgatgcatgaacatcacttagagttagatttgaaatctatttgctgtttgattcactaaatctttttaaataaatatcaaaccttaaagagtaacgtaattgatttgatattaattttggcacagattttgtgaattgcggccatgaatttcagacctgaggctaaaatccatcaaatcctccaaaacatcatttcacaatatactgatgcacacatggcacatcaccagtagtttcagtgctactttaattgcaacatgtataggcgtctctatgatgaacaagatataaagttgcagacccatttttttcattgtcaactatgatgtctgttaagtcaggtattctccgaaaacttgagataaaaacgacatagatatgcttcgtatacatacacatgattgcatattgatcaatcccctatggaacttgatgaattacatatccatttaagtagctaccgtttgaggcgcctcaacactatcaggaaagtatcaaggcagagtgtgtagtcatcgaaggcacttattccacaaaatttaccacgagtcaaaactaatttgtcccctccaatttgaagcctatcaaaggagcaagcgttggaaacctttacaccatggccaaagttcttgtgtgcctgccaatgtacaacaagtgtcaaaaggatttaacacaatcaattaatggccaataatgttgcgagattagttaaaaggcacagtagtatatttatatatactgtaccatataataaaactatgcgaaaactataaagtattccccacctccccacttttttccaatctgtaaggatattcaagaaacagaacaaaattagtgatagtttccggatggcttaagtggataacatagtaattagcaattaccattttattcacttcaatttccatttccatttaccaccttattaacaccacgtgcgatgcatgtacatgcttaagactgactagtgagtgtcaactatggtcattgccaccaaattattgggacataacagtaaacaatggttcaaaaagagcatgagctgaagggaagatctaagtcagatggtaacaattgatgagtttagaacagatgaagcatgaggaatcctgctttgtttggcctatttgatgcatatccaactgacaacgggtaaggatcagggtagagcaatgttgagcacttttgttctacatctgtacaaactatgaatgaattcaacatacatcaactgccctcatcactatataccatcaaaatacgagcgcatttctctatgaaaattctgtactacagcttaagttcatgatcaaacatcaaatattcaagcatgaaacaatcaacatccgcataaagaaaagaaaataccaaatagcaataagtatggactaagaaaatggagtacatgggaatcaatgataactaatttcaagctgtaatgttgcaagatgctttcaaactaaattaaacttacaaacgatatgcccactattttagcatcggagttgctcatttgttgtgcaatttgataggcacaagataaactgcctgatagaactcctctgataaccccattctaggtctaggagtgccaaagaaccatatagatcttcatattacatagctaagatcaaccaagtggaaagtgcacaacagtaaacatcatattacgtagttactgacaaccaatgaaccagaacctgtcagcccataccttagaatgtatgaacaatttttcatatttcaaactactgtactctagaatttcattaatctgataggaaatgaagagggtggcattcagtcaagtctcgtgatgttaagtggaaaaaaattgctagatactacagcataccattgtgatttccagcatgactaaccaagaggtcaaaagttcccttgagaaaatacaattccttagttcactaattaaactcgacagagagttaaatgcgggtacaagaagtgaacaagatagaaaacaaccttcctacaaattgagttatttaggttctcttaagacaatggcaccaatagcaaccactggagcaatttttatcaaatatgaaatatctacttgcctaatcatatgacgacaagttaaattacagatgaaatacaaaagacttacttgccaaggctttatcattgccatatttgggttattggtttgaattggtaaggcatcgatacataaactctcagtacgaaattcaggtgagaaggcaagacaagtagacaactcaaactccatatggtaattgtataaaccaagcaaaggatttcaagaaaaaaaacaaaaatgtttgattgatctagccatgaatattacagaagactctggagaacaacggtgtttcttcaaaatcagtaatcaataccagatattatcaatgagactcagcatagaatgccatgaaaacttcatccttgaaaatacaaacaaacaggatgactgttgataaagatgtcggtgtaacagcaaaaaatttcatgatcagatcattagaataaagtaggataactttggttctgtttattctacacaaactggaagctgctaattgtaaaagagttgttattactcattctgcagccaactggtatgtccaacatcattgtgcgtgcttggcaccaaatataattagtgtgtccagcatgcaaatctccccaaaaaggtaaaatagttcttttgccccatagtttagtgtttgctcatttgccagtttccacattcccagtgaatgacaaccagaactagggaccacatgtcatacacacatatggggcaaaagagcaaatgccatcaacttattgtgggacagaagagcaaatctccccttggaaaattggtttaccagccacaacggcaactgatattaagatggtcccagtccagaagggaaaaaaaaaagtcttgcatggtgcaccattcgtcgaaacaatgtttaggtatcaactcaataatctcattgcgtagcataactacaaataatgggatgttttacttctggtgcgccattcatcaaacaatgtttacgcagcataacaaaatagaccaatattctagtggagcgcttagcttgcttgacatacatagctcctaaagcgtaataagagttaaacaaaagtaggatataaaacttaaaagcacggttgcataagaaagtaaagaaactcatgacacagggcaaaaaaggttgcaaatcactaaataaataaataatgcgtgtatattgctacagaaaaactatgtgcacagaaagttgaatcgcacctagctcctctggacatattactgtgctgttgcctcaaatttccggagcatgtcgcagtgcggcgtctcgtaggaaagcccccagtggcgacgctgcacctcaaccctacaattctgtgagagtattgagaagtaatcccgctcaacatgccgttcgagtgttgcacgctcagtgctctggtgtggatactgctcctcaaagttaggcaacttgacatagtatgtgactccacgtgtggtttggaatttgtgctcataagggtaagagcgggacagcgagtagaccggttcagaagatggcaggaagttgagcaacagcagcaatagaacaggcaacagctgaataagcatccggagagtggagccaccggaattttgcgccccatggccatggtgcatgccgccagtcctgaaatgaaacgtcccaaactgcccaaactgtctggtggtggcaggcgccatcccgccaaagaagaagtttctgaatatctcatccggatcaaattcatcctcataaaacccattatacgcacgggcagtggaggcagccctcctgttgtaagtcaccggctcgtccgagccaacaaggtcatagcgcttgcggctctcggcatcgctgaggcactggaaggccttggagacggccttgaacgcatcctcggcaccgggggccttgttcttgtcgggatgcaccttgagggagagcttgcggtaggccttgcgcacgtcctccacagtgcagtccttctcgaggccgaggatctggtagtagtccctggtgtgcttcttgacctggcgcacaacctccagctgctcagacgtgtatgacctctcaccggcgctctcgtcctcctccttcttcttacccttctgcttcctctctctcagaccatcgctcccggttgcttcctccgcggatgctgccgctgctgacgaccgaggtggcggcggcggcggggcctgtggggacgacgacgaggcggaggacgagggcgggtcgtcctggttgaggagaggatcgagcaggtggtcgatggggagggaggggtccaggcgcttggccttggagaggaacttgacggcgcgggcgctgtcgccggcgtccgccgcggccttcccgatgcggaggcacttgaccgcgtcgtccttgttgccctccatggcgcctccccccgcgcagccgccgcagatctggccgcgcgacggcgagtcaccccctcctcctcctcctccgtgcgatggaccccgatcggatcggctccgcccccaaatccaatctgagaagcgatcgattcgcacaacaaggtggggggaatcagattccgatttccgaacgagccgtggaaatcggccgcatcggatgattgggaggcgcgaccgtgttgggagatgcttacctcgccggagttggagcggagaccggatcggcgtcggcgtcggcggcggcggcgagtcgccgtgggaggggaggaagaagagaggaggggggggagatgtgatgagacggcgacgcgacgaccaccgcgggcggagtcgatatttcccacgactccgtctcgctttgcttcactttcctcaattttctcaggattccttttttttttttttagttttccctctgtttgttcgttctctctgcgagactgcaaatacgcgtgaagaaaagggtgtgggcctgtggtaattgggccaattagaaacctatgtgaggccgtttgtgggtaattagtttaggtttaggaaaccgtaatgatggctccatcgtttgcatatttgcaaacgagtactccaaccatcccaaaaataggtaaacattggtttccgtgtcgatctttgactgtccgtcttatataaaaattttttataattcgtattttcattgttgtgagatgataaaacatgattaatattttatgcgtgacttgtcttttttatttttttttcataatttttttaaataagacggaaggtcaaacgttgggcatggaaaccagggtttctcttttttttgggatggagggagtaataatttgtgaataaaaattttatttgtgtgttcctagcgatcttaaaaaataaagtttaaaaaaaattcaaaatcaactctgaatttaaggttgaaattttaaattttggttgataagtataagtataagagaaaagatgaggcctatagtttcccagttgcttaaaaaaaattctcactcaactcaattggtaaccgtgagaagcacgcggtcacgtaaaaatttttatttccgtcaatagagatatgttatgtgacgatgtatatatgagtacgatgttaatagcctaaaagctcaaagtttagaggagtgacttaaattaaattaaagctaccttgaaataaccatgataccatcgaagattcaaatgggaatattgtgggatactcctattttggtgacaaggatgaagaaaaacaagtggtatcaaaagacactgaaaaacaattggatatatgccaaacgcatgggaaaatgagtgttgaattgtgtcagaattataaatgcgaacacctaaaacttaatctagatcgtaagacaacttatggcctgtttggattggggccaattcttgccctacctatcatttgatagttttgaatagtactagtaatcgtgcacgtgcaatgcacgtctatgttaaaattattggtccaattccactaataagtgaaaaacaatatatttattctaaaccactgatattaacatgaaacttaagtgacaaataatcaaaagccatctgtagtccttttgttatccactgcatttcaaacaaaataaataaaaaatacaaaagcttcacttctcactacatttataacaaagttttacaggtgccatcacaagttaaacttttgcaactaatttggtctaaaataagcaactatagaaccatactctcaccgtaacaatatgcaacctggagattaaaaacaataatccaattaagctaatcaacctgacagactgtcacttctgtcacttctgtccaaggatgaatatctcaatactatacaatcaccactattttttcctttcaaaaaaaaatcacccctattttgcatctgatatacggataagcaaaacattgtggccttgatcggcagcaatggctgctgccgcagctgccctataggtgtaaataccatgtgaaagaagacatgcatagcactcttatgtcacttggccatataaagttttcaactccacaattatatatatacatccctcctgtcctcaacataccagagcacagcagaggtgcatatgaatccatccagattatatatagagaaacaaaccctcttgtaatcaagccgaatttgaagagaaaatgtataacatatgcatacattaattcctttaatatccaaactgaaaattaagaatcaatagtatcagccatggaaaagaactgagttagatcacaaaatcttctgacgaaactaaagatattgaagccaattttctatcaaccactaattgcatgcacaattgagttgtttatatattcatacaacacaaaattgtaaagtgccaacccgaagaagtacatctcgatgtgtcatgcacctatgtttaactgcatgtccatgcatgaaagtcaaggaactccagtagaaagtgatgtttctaccttcacggagtgacagtaacatcaaatgcaaaggttataagtataatacaaaaagaaacactgatctgttcattttgaaagcaacaaactattagcctgaagcacatgtattcacagtaagaaaaaactattgactgagagatcaacttggttcacaggagaaaaaagtatgcttagagctccaactgagacacgaaggagtagctaaaaaaatatgcatcatgagcttaggacttagagcctcctttgcttcttagagcaagtttaatagtatagccaactactagctccaattcatctatagccaatctaatagttcattcatacaatagttacatactacactattaatacctggtcccacctgtcatacacacactgcatcttagagtccgtgctacagctggctataaatctgtagcccgctactcttctctcttctcatttatctacttaaaatatgtttgcagttggcttatagcctgctattgtacctgctcttaggtcctttgcttcttcggttcctcctaactactgaagccaacacatggatgtcacagcattcacattgccatctcccaactcccaagaaacttgcttcattctcatccaccaaggaatcaacctatatgagcataaccttatatgtcacctgaaaagaaaaatgaaacgttcaagtctcaattaatcaagctactactgatcatgggattgcaaccagcgagcatgtatatccatctgaaccatgttgcagtgttttcgttatacatagtgtagctgcagaacacatgcaagaatatgaccccaaggatccataatcatatcttcttggctgttccactgaacaattaatactgaattcattatatgaaaatcctgaaaaaaaaaaggaaaaatgatggttaattggatctcttgagaaaatgacagtataatttatgctcataagaggcaccatctatgaaaaatatataatttagcatagtcgtgacacaacgcaacatgaattctaattgcaccggacctcattcttagtaacatataaattaagcagaaaatcactggacaatgggccataccttatcaccagaagtcatatctcggtaaaacaaatatcattatgttgagacttgagatgatcagcacccaaggaattaacacttatcatttgcacagttgtaaagtaaaacctagaaatgtcttagcaggcattctgatatgggagttgtttagagaaaacatttagagatgtaagttgtcagttgcacaccaatagtgatctgcatctcccatttgtaccattacaccaaaaataacttttagatcacaagcatttgcaattttcccatctataataaatgcacacattcatatggaagcataaaaacatacacaattttaattgccggagtacccaaagtcataagcaagagtaaccgggacaagggaagtagtgttgttgaacctgacagcgccgcaacgggatatatttatttatttgcttgtgatgatgaacacccatcggtgttattattggtggagaaggaggacgatgccccggagctgtcacagcctgattttcgttttaggatttaaaattatttaatcaattattaatagaatttatattaaatgttcattaatttttaagtgaagttaaatgtgggaaataaaattttctaaatataaagcatggctggatttaatttttattaaattctccatgattaattatactatctgaaattttctcggatttttcggagctcaattcctaattttaataatacaaagaatatttcagtaattattcacatattaaattaatcattaaatgagctggtttcaattttgttaaatattttgagtgtccaagtatgttcaagattgttcttggaattatttgagcattggaagtatttttaacaattgaaagatcatttcagtgattaatttaattgggaaaagtaattagaataccgatttttttatttataataactaatccttcacaaattaaataagtagtaattatctgtagggatttaccaaagtagtaaggacgctattgtcatcagcgtccaggtgtggacactggtaataatacatgtccagctcgagacgcactttttaacagcgtccacagtctggtgcaacccaatgtgccttactgccttatcacaccggccgccttatcacaccggccactgtaagcgcttgttgacatctcctgctagcgagccttcgtgttgtcctaagcaacgttagctcgatcactttgttggcgattgagcatgtttaattacttaattatatgctatcactctataatttttgcctttgaagtgcccacgcatgcgttagcttttcctttatctggtccggttgcctctaaaacagatatatagctcgttgttggatcaatcaatttgtagttatatataggtatgtcgattcattttaatatcgctgcatatcgtatcaacatattatggttctagataaattatactcatatatttcaataatccagccaactgtgtcaattacaaatacaggacaaacaatctgggtaggtgttgacgaaaaaatcgaatacaccggcctgggagatctgcttaactccagtgcaggtccaaatcttggtgaaatgcgagcgtgccagtcagtttgatcttgcaactgacaagatatgcaaatagtatatcaaaacagccgatcggctgacaagccgatagagtagttccagccgatagcgataatagccgatgccgataccagccgatagcgatagggtttaagcaatcggctatatgtccaatgtagataataatataaaggcaatcggctgatgatgatgtaataaaataacaatataatccagtataaaccaatcggctagcattgatatgatagaataagcactgatctgaaggttaaagcatacatcggctggaggcccgatgtcatgaaatctacaagattagattaaacagtgaaacctttgttgtcatcggctaaatccaacttatatgtatatgcaatccttatgagccgatgcaacgtccagataactcatcagctgaaaccccgatgaaacccttattggcaatcaagaagcaggctagaaattatggttctaagcacgacttagtagatcaaacttaactgatgcagcactaagtatgaaaagaaatataatatctagacaatcaagccgttgactgagttttcagggtggtagatgtctaagctaatctaatctagcaacgcgatttagccgataccggcagaaaccctaaaatgagaagcagccgatagagctaaattgatatgctaaaactagattaacagagacatatgataaataggtaggcaaatatatcatccaaaccaaagcaatccaagaggtcgaatgtactgatgcagccttgaacgacgccaacgtagacgatacaattgcctggatcggcggaacattggacttatcccttcgccggagatcgaagacgatgcaactccgcatcgggtgccaagttccgccggaacgtaaaaacaaaagtagaagtaaaaagggtggcgatgcgccgaattgtattgatcgtagcgattgatagattacaatgaccccgggtgtacatatttatacccataggttgatacaagtccttgtcggacaagaaagaaactttcctaaagataaaaggaaaagataaagtccttataggacactaaacacactttcctaaagataaaaggaaactaacaaactattcctaattaatagatacaactgccttcttcggactcgatccgtacgtggcaatcatcatgaagcacgtcaactcaatctgacaatgattccaatatcatcttgccggaattggctacatcggcttgccttgtcctattcggtaactgccgatgcacactgtagccgatgcggttccgaagccgattcataccctgtttccgttatcgatttcctcccaaatccgcttcggccttaactccaaatccgatgcatgatttaccaaatttcatcgttaacagtaggtacaatacgttcttgcattaactaggcaaacaaaacgattcaaaccaagtatatatccggacactagataagttcttatacatacgaagaaacgtccacaatctaaaaaagctcacttaaatatataagctagttgcaatgtgcttcttgaaacttttcttagcacttaactacttgtgttgaacttcccgaaaacctaaatcaaacgaaaatgttagtttcaccaagataaaataaggcagctagctgattctcacagagttactgtttgttgagtcactagcttggcctccaccatcttctgtgtgggcactcctatctccatgctctatactgcaaccttttcctgagtatacccaatagtcaaatacttcattgtattgatacttttggataacttgacggaaccatggcaccacaaacaacaatagtaaatctatcaggatgaaacaatcttattgctgaaacaatcaaccgcacaaaaaacctgactagggtccgcatagaggacgtcgctgtcgagcggtcactggtggcggcggcctctagcgcaaggaggtctggacattgttacgaagatgttgacgggatgctggacgtcgttcaatacagcgtccaggtctggacattgttacgaagagcgtccattcctggacgctatagcgtttagcatccatcctacaattaaaatttccctctatcatttactagatatttaattaataggttgttaattattatatataaaaaaatcggaattaaaattcccttttccttttcgggccgaaacaggaaaagttcacatttaatcctccgcccattcttccttctattcggccggccttatcccttcccaaagtctagtttgcatccctccttctatcgggctgtgcaatggaagcccatccaaaagtctgttttgcgtcccctcgctacagtgcatcttcaacctccagccagagccgagctcctgtgcccgtgtcctgttgccgccgcctcctccttccaaatccgacctccccgttgctcctctttccaaattagttgcggaatggaatcctctcaatctcctatacaatttccccacgaaatcctcaaatgtttctatggaaatcctttccaatttcgcggatcaatctttccttttcccggcgaggatcctaaactttcccggagtttctcccgtcgatttgggcccggacccgagctcccgtgcctatataaaggaccctctagtcgtcctccacctatcccctcaagtcccgtcttccaccgtcgctggaaacgctctccccgcgagcaccttctctctccaccgccggccgccgctccagccgcgccgttcgtcgtcgtccatcgtcgccttaggtcgccgctgccaccgttgggttcgcgaggaggagaagaagatcgtcctccacttccccgaagccgaaatccaccggagctccatcgtcgccgtcaacccgaagttcgccgtcgtgttttgatctccaacgaggccctgctgctccttctgtcatcaccaatcttcaccgccacatccattggattcgcagctgcaagcagaagaccgtccaccacctcttctccgccaaagatcgccggaaagtcatcgccaccgtcgatcagtaccccgtcgccactccaacctcgccgccgtcgtcatctgtcgtcgtttgccgtcattcaagtcatcggtgagctcccctcgtcgtgctctttcctccggttcagatcaatttaagtcatccaatcttggtcgactcgatcgagattaatctcagccgtccaaaatcgatataaatctgttcgctcttttcaatgacatattattcctttttaatatatgtcatctatcaaatataatctaatctttttcggaggttgttttaatcttttgtcttaattataaatcatttgtaaatggtttaattaatttggaatagtctttttctttaataggctttaattggaattaattttgtaaattcataattaaatcatatgaaattggaataaggccgttcaagtctcattcatctaaaatcatgatctacatgtttgtttactttatatgttttgtttatttggagtttcttagtctttttctttgttttgcgtgttagcttgtcgtttctgtcgttgcaaaggttcgcgagtgcgccggaagtgttcaagaagattaattgaagaccgttgcaaggcaagtcacacaggtcccaaacacaattcctttgagcatgttgatcctatatttaattctctattaatttcaactatgcatttattttcgaatgtcactggtggtgtgtcacgcccggaaattcactagtaatttccgaacttatttgtgcataaaatcctcgtccagaaatcagccgaggtacacaaactgacaatttaatatacaaatccatcataataataacgttacacttacaaaagaaaagaaaacagcagcggaataacggtctagcgatggcttcagctccactcccacaggcagcttaactggggtataagccaaacatcttctccttctggatcatttttcttcaactgaggttgattgattattgcaagaatgagcatatgacatactcaacaagccacacagcaaatatgcgagtgcacaaggataccaaaggatggcataatataggctcatttgcaaaagcagcatttagcaaaacatttaagagaagtaaaacagtggagtaattaattagaaattttaatcaacactgaacagcacacccatgctgcacaggcccaaccatcctgaacaaccatacccggctgtacagatctaactccaaaccaggagctaaacaaattattaccaggtataacatccataattattgtgagaggtgtgagactaatcacgaaaaacattgctcaacccgcccataaccacgggcacggctattcgaatagttttactctggccagaggtgtaccactgtacccacaagacacagcctcaacatcatgtctaccatgcgtcgcgatactggaaagtacccgaatagaggctgtgacaataccatctgcacaacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatatttctaatcatgactaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttctgaacactcccgacgcactcacgaaccttcgcaacgacggaaacgacaagctaacacgcaaaacgaagaaaaagactaataaaaaccaaataaacagtatatataaagtaaacaaacatgtagatgtcgattttagatgaatttagcaacttgaaccactcaaaaccgagttacgatgatttagttatgaatttcctaagatttaatctattagaaaaacaggaaaaagaaaaaacgatgatgacgtcatgatgacctcatcaatggccggaccaagatggcgacctcgccggagattggatggtcggctgcgactttggaggacatgtacacgtagaggacgacgagacgaacccaacggtactcaccctcgaaccaaacgacgaacgacgacggccggcgacgaggtctagcggcggcgcggcttcggtcgacggtggcgacggggctgcggtggtcagcggcttcgggggtcaggcggccgggcttctccaccctcccgcgcacctaacggtggtgacgacgaccggtggcgacgacggaggcgacggcgcgacgcggatggagctcggccggcgacgacggcggggtggagcacgtggcggcggcgctacgaggcacgggagatcacgggagagggggcaaacgaaagaggaggactaggggatcctatttaaagccttggattgaagagatcggactcctccagcaagaaatcgatccgggaaatcaaaaactcggttttggagataaactcgaaaacgagttcgattcggataagatactcaaagattagctccgatttttgggggtaaagatataggaggataagaggaatatttcccctcaactaattttagaaaaacacaaggggaaaggtcagatttggaggagaaaaaccgagccaaatcggtctcagttcggctgctagaggtagaagataaacagtgtcgagggaggcaaattagacttttcgtcttgggctggctgaaaacaaagcaaagaaagaaagagaaggggggagctcggctgggccgacttgggttgcacggccgtgcacacaaaagagggagatgggctggaaagggcccaagactaggaagaggattattattacttttccaattaaattaatcaatgaaatgatctttgaattgttaaaaatacttcctatgctcaaataattccaagaaaatcttgaacatacttggacacccaaagtttttaacaatattaaaaccagaccatttaatgattaatttaatatgtgggtaattactgaaatgctctttgtaagattaaaattaggaattgagctccgaaaaatccgagaatattccagagagtataattaaccatggagaatttaataaaaaattaaatccatccatgctttatatttaggaaattttatttcccacatttaacttcacttgtaaattaatgaacatttaatataaattctaataataatttattaaataatttataaatcctgaaacaaaaatcaggatgtgacatggtgtgaacctattcctttgttatggccaatttgcattgattaccctatgtcttgattacctcgggttataatttgactagctggatttatatattggttcagctagatgtattagatattgacggagctcgtggctcctcaccgggagaccgcgcaggcccccctttgccggttcggccgggggcttagggtgagatctcaagctctcgctgtgtgtggaaagatcgcgtgccaggaagaaacacgagacacggacgatgtatacaggttcgggccgctgggaagcgtaataccctactcctgtgttttggtgaatttgtgtgtggaagagctacaaaatgtgggccgacctctcccttgttctaggctctgaatctggaaagaatccccctccctctatgggcaaggtcctccttttatacttcaaggggataccacacgcaccctcctctttccaaactggacttttcttctctttatggacggagattggtatggttgctgtccgaatgacacttcgatgggacagcccacacctacctccactcccggcggagacgggcgcaacgtgggatcgtggctgcccgttgctgacgcgaccagtgtcagactggtcattcttgtccaccatgtgtcagtttaacaagatgcatgtttgcccttcttcgtgtaacaccttgcctgtaatggttaggatgaagcctggtataaatctaaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgcaacccgacccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggcgagcagattcgtctcgcccggagatacggcaacgccgcttcggtcggcgagcgtaattaacgcgcgcacgatacaatccgtttcgatcgccacaaccgcatatccacttcatgcgccgtaagcgggcgaatgggattagtggaagcgtgggcacgggaaacgagggagcgagatagcgagatatgagggagcgaggtagtgggcgcgagaaacgaggagccaggcccagcgatggcaagggtataaaagcatcgagaaaaggatttgcttccttcctttcgccattgttcctcttgccttcaccgcctgagctctaactctttctctgctacgccctactttcgccacacgcgctcgttctcaatcatctcttcctccaccgccatggcacggggctctgctctgctcgacggcagtgtactaccgccttcccgcatcgtgaacgagaggcacgccggactgccgcgccgcttcatgcctgagtccgccaccggtcgggagatagtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggtcggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgtcggtagatctgggggaggactacgacgccgtcctcgaccgcctggcgggcctgcgatcccaggggctcaccggggccatggtgtacggcgattacctccgccgccggattgcgccgctccaacggcgcgcccggagcgcctgggagtacactgggcctgaagactacatgcggacccaccagggagccagatgggactgggctcccgaggacttcaagatcgtagttcaaagggtgctgaatcttagctccgcggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaaccatctgccccaggagggggtcgtgcttctgggccccgcgtcgggggctcggggagcagccgccctgccgacgcccaggggaagaggaagctgggaggaacacctcccacatctcctccccgagggggcggggcggcgcgtgccagcagtcggcgcccggaggggggcgcgccgacgtcgcagcccgagggggagcgcaagaagaagcggctccgcaagatgggggagacggaaccatcccggggaaacctgatttcccctccaaagtggtcatttaaccgaccccctcgcaggttcgccccattcttattgcgaccgtctttcttctatcccattaagcaagttttctcttacccatcttgtttgtcttctggttttttattctgcttcagcgatgccccgtcacattcctcccgccaccccaagtccggccagtccgaggccgaagatccggcggccgcagaggagcggaggcgagaagctgaccggcgtgaagccgcagatcgccttcgggaagctgaagaggccgcccgggaggccgcccgggctcgccaagccgaagaagctgctcgggaggaggccgcccgggctcgccaagccgaagaagctgcccgggaggaggccgcccgggctcgccaggctgaggcgacagctgctgctggcgcgtcacttgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccaagccgcgtcgcattttctccaaggcggctcttttcctcatcttctgtcgccccgctgagcgccgagccccttctgcaggccctggccgccgcaaacaccgcagtgctggatgggttcaacgcccaagtggaggccctgcgtgcggaacgagcggagctcgaggccgcatgggcgcgcgttgaggaggggcggcgctcggtggacgccatggtggaggtgggccgtaaggctcaccgccgtcacatctcggagcttgaagcccgcaaggcggcgctggcggaggtcgcccgagaggtggaggaggagcgagaggccgcccttatcgccaccaccgcgatgatcgaggcgcaagacaccctccgccttcagcacgcaagctgggaggcggagctgaagaaaaagctcgacgccgcccaaggggtccttgactccgccgctgcccgagagcggcgggtaacggagactgaagcggcgtctcggcggcgcaaggaggcccttgagtcccgtgccatggcgctggaagaacacgccggcaccgtggagaggggcttgacggaccgcgaggccgccgctgctctccgggaggcgacgctggcggcgcacgaggccgcctgcgccgaggaggagtgcgcgctccgcctccgcgaggacgcactcgctgagcgggagcgagctctcgaggaggctgaggccacgaccaaacggctggcggacagcctgtcccttcgcgaggcggcgcaagaggagcaggcgcgccgcaatcttgaatgcgtccgcgccgagagagccgcactggagcagcgggctgctgacctcgaggcgcgggaaaaggagctggacgcgagggcgcctatcggcggggcggccgcgggcgaaagcgacttagccgcccgcctcgcagctgccgaacacaccgtcgcggaaatgcagcgagcgctggactcctccaccggggaggccgaggcccttcgcttggcgggcgagattgggcccgacatgctttgggatgcggtctcccacatgaagcgcgccggtcggcaagcgggcctctggagaggccagacgtcggtgccccccaccaatctggaaggcctcgctccgcacctcaccaggatggcctgggttctcgaacaactccccgaggagcttgagaagaccatcaagtcatcctcgagggacctcgcgcagggagcggtcgaactcgtgctggcgagctaccaggcccgggaccccaacttctctccatggatggcgctggaggagttccctcccgggaccgagaacgacgcgcgcgcgcgcgtccggaatgccgccgaccacatcgtcaacggcttcgagggctcggcccctcggctcgcgttcgcccctagctccgacgaggagggcgatgccagcggtgaggacgacggtggcgacgaggccggcgacccgggcgcgtcggaatgagcccccgagcccccgtcaatcttcacttttttctttttctttcttctaaggccttcgtgcctcttttgtatagatcaacttaatctgcaatcaaaaatgatgaaaaatttctatgttaactttattttgctatacttatgagttgaggatgatttgtgccgtggtccttttgcattttagcttgatttaagagctcgtgctcaagtcccaatcctcagatggctcgggtcggggctagtgcctggggagatccacatgccgagactggccaggccgggaacatggtgaccgagggttatgggtgacccgattgtgggtttttgccgattcccccccggagttcaccatgccccggggcacggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaacttcttttattgaaatgctgaaataagaaaagtaagactgtgcatgtgtggtagcccccggccaaccctgcacacccgaggggggtgcggggttggcccgagccaaaacctgacacccgaccccccccttcaggggtagaagcgacgaaggtgttcaatgttccacgggtttggcagctccgtgccgtcgcccgtggccagccgtaccgagcccggccgggggacaccgatcactcgatacggaccctcccatattggtgagagcttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataggcctcgggccacttagtgaacttgtcgatcgcaacatacagatactcaaacccgcccagggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgtgaggcggaatgcgctccgcactcgccctcatggatgtcagcaagaagctcaacgccttgttcctgaggaatgcacttcaggaggatcccgttagccgcgcgccgatagagggtcccttctaccagcacgtagcgtttggaaatgcgttgtacgcgttcactcccttggcggtcctcaggtagagtcttatctgtgaggtatgtttggatctcagagatccaagcaatcaatctaagggagtttggagcactcccttcgagtcccgaggcctggactccgacggccctcgggggccggtcaggcgcatccgtctcccctaagggattgggtcgcgccgacggctgggtaagcctttcttcaaaggcgcccggtggggtctgggctcgcgaggacgcgagccgtgagagttcgtcggctatcatgttatcccgcctgggcacatgccgaagctctattccatcgaaatggcgctccatacgccgcacttggcgtacgtaggcgttcatctgtgggtcagagcaccggtactccttacagacctggttaacgactagctgggagtcgcctaataccaagaggcggcggatccccagtccagctgccactctgagtccggcaaggagtccctcgtactctgccatattgttagtcgctcgaaagtcgagacggaccaagtatctgaggacgtctccgttcggagaggtcaacgtgacccctgcaccggcgccctggagagacagagaaccgtcgaactgcatcacccagtgggcggtttgaggcagctgtgagaggttcgtgctggcctcgggcattgagacagtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggtctcactaataaagtagacaggcctctgcacctttcggcggggccgatcctcttcgctaggggccgtatccccggggtgctcttcgtccaagtggcctctcggggcacactcgtctcctgcgctgatgacctcggggtccgaagatgacaggtgcggccttcccacagtggcctcggggccgtcccgggggtcgggggctcctggcgttgtcagacaagcgggcaaagggccagctccggtcgtcaggggcctcaggcctccgttcggctcgggggcctcttctccctgctctctcccgggtcgaatcagcacagggttagcctcggggtcaaagggtggtagatgcggccttcccgcagtggcctcggggccttcctgagggtcgggggcacccggcaccgtctgacaagcgggcagagggccgactccggtcgtcgggggccttaggccaccgttcgactcgggggcctctcctccctgcctgctcccgggccaagtcagcacagagtgggggtgcgcagaatgaggattgtcctcatcgcgctccacaaccaacgctgcactaactacttggggggtcgccgctaagtaaagtagcaggggctcatttggctccggggcgactagaaccgggggagagctgagatatacctttaactgagtaagggcatgttcagcttcctccgtccaagtgaacggcccggagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaaaaacccgagaagcttgcccgcaggtacaccaaacacgcacttatcggggttcagttttatgcgggcagagcggaggttttcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagaatatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaagaaggagacgagcgcgtcttcctatttgtcatccagaagaccaccgatccgtgtggtcttggatgggccgtcgcccaaggcaacctccttgaccgggacctcgtcgcatgtggcaatccgctgcctcggggcggtgggggcagaggggccaagcctctcgtcaccaccctcgggcttggacgcagcagcgaggcggtcggcgcgctgctccatgcaagcaagcgcgactttaagatcgccatggacagagatggggccaccggggcccggcatcttcatctggaggtaggcgtagtggaccgccgccatgaacttcaccaacgcgggcctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgataattggctgggacggtcggagcaccatccccggggccttgatagcatcaaaggccgcgggggaaaggatgttgagagccgctcctccatctatgaggacacgtcccaacttcacgttgcagatggtgggggaaactaccatcgcaacctgccctccccgggcaatgcacggtgggtggtcggtctggtcgaaagtgagagcaacctctgaccaccgcgcccgacgcatcgcctcatgagtaggggccatggccagaagctctcgcttcatagccttgaagctccggcgagagacgtgagcacacgctcctccatcgacggtggcaatggtggccccaggttcttggaaacctaggccatcatcaccatcatcgatgtcaacagcgggggccttctgcttggcctcacttcgccgtttgccggaaggaaccgccggggacttgccctcacggcgttcctgcctcctgtcctcctcccacttcctcgttcgctcagccaaatttttgactgcgcgacagtccgcgagatcgtggagggaggtgttgtggacggagcaccacttgctgactgggcgctcccggctgggagtaccagcctctttctttttgtcgctcgcaggcctcccctttcgggtggcccgcggagcgctctcgacggcgaggacgtgcccctcgtcgccggaatgggccgaccttttcttcctcctcctgtcacgccgccctgtctgagcggcggatccgggggcggccgaagctgccacaccggaaccggaggggttccaggtccaggcctcctccttacgagccactcggtctgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacactctggacgaagaggcgtcctccgttgcgcggggagtacgccggctattacgccggcgctcgatgttgaggcgggcatccggctccccatgctgatcctcccgagtcgaaggtgtcgacgagggagtggcagccgaatgacgtgcagccgccgccgctcgccgcgccctccgccttgacgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcggcgctccccatcttgccgtcctcctgcaccacctgcaactggtgatgccacggatttgtcgaccttctcaagcgcctccccctgcttagggctttggcgcagaggaggtgggggagtacgagctcgacggcgtggattcggctccccgtcgtcgccgctcacactcggagagaggtcgtgcgcttctccttgctcggccattaggctgaacaagaaaaacttggcgcccacggaagagtctgagagctcagaaaacacacgctgagccccctacctggcgcgccagatgacggagctcgtggctcctcaccgggagaccgcgcaggcccccctttgccggttcggccgggggcttagggtgagatctcaagctctcgctgtgtgtggaaagatcgcgtgccaggaagaaacacgagacacggacgatgtatacaggttcgggccgctgggaagcgtaataccctactcctgtgttttggtgaatttgtgtgtggaagagctacaaaatgtgggccgacctctcccttgttctaggctctgaatctggaaagaatccccctccctctatgggcaaggtcctccttttatacttcaaggggataccacacgcacccttctctttcaaactggacttttcttctctttatggacggagaatgtatgggtgctgtccgaatgacacttcgatgggacaggccacacctaccttcacttccggg

SEQ ID NO: 6932 - DNA, 19189 bp, Oryza sativa
gatgcatgtttgcccttcttcgtgtaacaccttgcctgtaatggttaggatgaagcctggtataaatctaaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgcaacccgacccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagatataattgcttagctatgcttagaaacattagcacacgattgggataactaatgttttactattacttattgatggatatttaattgtagctcacgatggtcaatcgtgattgattaattaatttgccaactaaaacttgataatggtgggttgtgagcatatggttttgatggtcgtgctcatgacaattaaggaccggttcacgagtttcggttgtgaaacattaaccgtgctaaccacaagccagcatgggcaacggctttaccttttgtatagcatagttcattgcagggtaccagactgagaagtggcggagataagcccacgggggtcgctggggagtccatgccttgtttataagggattgattatgatctaggaacggtgcgctgtggtggattgtgttatgcgaggggtactgtcacagctcctttccgaggtaccgtggtggtattgaggcgcatggtgacatgtcgtggggctgtgtcttgtgggtacagtggtacacttctggccagagtaaaactattcgaatagccgtgcacgtggtcatgggcgggtctaacaatgtctttcgtgattagtcccacgctactcattaataataatgtggtaattgatggtaattaatttagctcctggtttggaatgctatattcctggtttggagatagatctgtacagccgggtatggttgtccaggatggttgggcctgtgcagcatgggtgtgttgttcagtgttgattaatattgatgattaattactctactgttttacgattctcaaatatttgctaaatactgcttttacaaatgaaccctatattataccattctttggtatccttgtgcacttgcatatttgctatgtggcttgcggagtattccatgtactcaccttgcaataatcaatcaaacctcagttgaagacaagttgcgaaggagaagacgtttggcttataccccagttgagctgcctgtgggagtggagccggagcttcgctagaccataattctgctgctattttctcttttcttttgtaagtatttacgttattagtatgatgaatctgtatattaaattgtcagtttgtgtacctcggctgattcctgaacgaggatttaatgcacaaataagttcagaaattactagtgaattaccagccggataggctaaatctaccgcaggggtgtggtggcaggggatgctggtagcggcgagcgtcagcctcgtggacatcgagcaacctctgagtttcgatggcgcggggacgacgtgcgttgtggtgggcgtcaacgcagccgaggaggctcaacaggacttgggccaaacctctgtagctttgcccatgccgccatccccaccctctcccctcctcaactgctcccctctccggtgtcatcatcgaggctgagactggtggtggtgccggtggctagatccgaagccttcgcatggcttggtccggcgcctcagattcgatgctgccatggctggtcagggaggaagaagagagctcacatcaagggcacataagggatgagtaggagaggacatatcacgggcaatgccagcagtagcaggaggatatgatggatatgcgatgcgggtgaggaggtgattgaggggagcactctcgcccctgcccctcaatggcgtgagctgcacatcaatcgcagggagagaaagagcgcgtggatagtgcaacggataccgcgggcgcggggcgtggatggcgcgcgacaacggtggcgatgaaggcgcgcgctagcgcggtggggatggggatggggatggggagggttccgaattggtgattccagctgcccacttttatctctttcacccgttagatttgatttcaccggttggattgcaagcggtgaactcatcctttttatattagtatagatatttgtttactatttggactgaggctaaggccgtgtttagttctcaaaataaaaacttttcacccatcacatcgaatgtttggacatatgaatagagtattaaatgtggggaaaagaacaattacacagtttgcgtgtaaattgtgagacgaatcttttaagcctaattgcgccatgatttgacaacgtgatgctatagtaaacatttgctaatgacagattaattaggctaataaattcgtctcgtagttttctaacggaacatgcaatttgttttgttattaaactacatttaatacttcaaatgtgtgtctgtatatccaatgtgacaaccaatcctaaattttttcccccactaaatctacctaattcaataggacttcaaaccgaaacagccatcgttagctctcagttcgtcaagtagtcgtgactatgagtcaattctataaagattatagttttcggtgaagtacggatgtgactatgaagatcatttgctacagtaaacgcagcgctctttgccacgctaccaggctactgttccactgttcatcttatttctagccgtccgatcagtcctttcgaggcgtgctggccatccgtagcattaggatagcttttctcctcatccatcgggggaaaagtgttggaatgtaaatcatgtctcctctatcaccggctccctttccttctcccgatcatggtttccggtcatgtttccataaatcggtagagtgagtatggaagatagaggcctatgcatgtaatgctccatgatcaatacaccatcgcgttgagtcattctgtctatcaaaaagaaaacgcggtcttctgcttccctgcgtccgccgcccgacgccctcctgttaacttcgtcggcggctacccctgtcgctgccttcatgtgtgctttcatctccttctcgatctcttgcgtctactgccagtctgccgcgcagccatgtatttctctgccatccttgccatcctcacctgctgccgtgccagaccggcatgtacccgttcgctatggttggcgacggtctccggccaccggccatatctgtccaccgtatacggcctccatttaagctgaatcggagtcgtatcgcgcgcaattgctatcctcctccgtcaccttgcctgtttcctcccaaagacccaaaccccgtcgattcgtgccttgctactgtttctaagtcctgtgttgttcttgctgttccactgtccctgaaggtactccctccttatttatgacgccgttgacttttcgatcaatgtttgaccattcgttttatttaaaaattttatgtaaatatgaaaatatttatgtcatgtttaaaaaacatttgatgacgaatcaagttataataaaataaatgataattacataaattttttgaataaattttttgaataagatgaatggtcaaacgttggataaaaagtcaacggcgtcatgcattaaaatatggaggtagtatttgtttgctgtcttaattaaaatacttgatatgagtgaacataaatgtgttgtatatataggctaagcgcattgccattgcaatgatggtattccgtaaatatttgaggaggtagcagctacttcgcccggcgaaaaaaaatagcagcagctttttttggagggccgccttgattagccttatgtacctaatttctgaatttaggggtgcttttatagttattgatatgagatctgtgaacatagaggttgttcattttgatgttagtttcaaccataccattttttttcaaagttacctaaaaatggctatgtttagtttgttgccaaatttgatcaatacataagaaataataccaaaattttggcaatattgccatcttgccaaaattttgacattgccaaaacttggtaatgtttattttggctacaatttgaacaagcccataattataaatgtggtggacttgggttaaaaaaagcttttatactaacttaaggtattaatccaaaaatcgccactcaaagctaacagttagaggcactgaactgactctgtatcaacattttgctttccagtttaatctaacgtttgcatctttccttttgttttccttcaaaatttttggctttcattgatcataattttcactcatggaaaaagaacaaaaaaaaattgtgatgtgctggtatcagtggcatttgatagccgtttattttggataaaaggaaagatcatgcatccttctctattatcatgtacttccttttgtttcacaatataggtcattctaacattttctatattcatgttaatattaaatgtaacatcaatataaatatggaaaatgctagaatgacctgcattgtgaaacgctgtttttcaccgtgattgagaagtcctatattcattttggatattcacgggatggtatcaaatcatgtttcccacatatgcattgtaatttttcttaatgcagtacccgttagacatgtacagtgatcttctgttgttattctttagtagattttatcgaaagcagggaactttctctaggaaaatccattacccactccccagtggagagagatttgatgccctgatgtatgctgcactctttctccaatgggttttttaattttcatggttggttctgatttactgcttgctatgctcatcgtcccttttctcctttgtttcacagctttacgcaatatatatttttaggttcttttatgtttattttgcctaaacttatgccttttgggtaccttttctctaaatagcatcgaattcaaccaaatgttcgatgctatttacgccaagtttagttccaaaatttttcttcaaacttttaaactttgctatcacatcaaaacttttctgcacacataaacttccaacttttccgtcatatcattccaatttcaaccaaactaccaattttggtgtgaaaaacacacccttagtatatactacactacatggacagttgtcctacattcgatcaccggtacggtgttgttttttctttttggttatatatgcatcagggaactaattagccattttgtccagatcaatcttcatttccacattttataaatattgcgtgcatgcttaccattatagtactcttcacgatgttcccgcggggtacagcctagtaaataggatgactgaaataaggttcgagtaaatgagacatgttaggttagctatacgtatagatttggaaagaggtaaccaaaaccaaattcaaaattttcaaatccctcaaatttgtaggcccccaaacctgctgcctactgcctaggtttccaatttgaaaggaaaaagtacacgaaaggtcccttaacttatcatcgagttacaaaatcgtcccccaaccacaaaaccagatatataaaatccctcaacttacaaaaaccgttcactttaggttctccggtggttttgaccctggtttagtccgacgtagcggctgagtcaacgtgatacccacgtgagccctacatgtcaggatgccactttcccctcctttcccttcctcctcctctccccctctcacttttctcctctgggcagggcggccggcaggtgaggaggaggtcaccgggacgaggcgagagaggaggtccgactgccggcgatgcggtgatggcgcccgccggtacaaatcccacctctgcggcgccatgtcctcctcccgcgggccgtcgtctcctctgtcccacccgaaccctatcgatcccttcgccgcggtagcggcggcgacagcggaggcgccaccgctccgaaaccctatcatcccccatgaccctccctcgccggagatggaggccaccgcggaggcgctcacctgggaggggtgctgtgttggcggaggtgccgcgccaagcatctcgttgatgtgtactggcggttctattggacgctcgggtggagctgcgggcgtggcatgggcgaagcctgctcgaggcagagcagctgccgctgctgccctccgcgtccaaggtggtcaggccggtgtccgcgatggtgccgaggcggaagaaatgcagcttcggcgggtgcaaggtgcggaccatggctatggccaggttctgccactcccacatcctctccgatgaccatggtgatggcatgtcccttccgccgcgctcttgacagacggtgtgggtgatgatgtggcatcctgacatgtgggtcccacgctgacttagccgccacatcggataaaaccggggtcaaaacaaccgaaagacctaaagttaacgatattataagttgaaggatgtcatgtatcaggttttgcggttgggggacgattttgtaactcgatgaaaagttgagggacattcggtatactttttccaatttgaaattgctttcttccaaggccacaaaaaacaagtaataagttcaccggaggtccctcaacttaacagcgagattttttgaggtccctcaaccacaaaaccagaaattttcgcccctaaactcattcaaaccgttcacaggaggtcccttggcagtataggtgggtggtttcgcttacgtggcatcctagtcagaaaaaaaaaattaaaaaatttcgtggggcccacatgtcagctgcactttattttttcttctcttttctctcctcttctctttcctctcctctctctttgccggcggcgggcggcgatgggcgagcgcgcgactggagtaggtggaggggcggcgtcagcgcgctagagcaggcggagcgcgcggtgtctccgggcgagcgcgactacggcgacggcaagcggtgggcgagcgcgacggcgggcaagcggcggctccgagggtgggcggtgcgcggccggagcaggtggagcggcggtgtctccgagcgcgggcggagcagaagggcgggggcgcgacagtcgagcggcggcgacgcgtcacctctttccccctctcccgccggcctcatctcccccaactccgtccgctcccgccgctgcggcgcgccaccacgttgggctcctccgatgagtgcgacggcggcggcgggaaccagcagcaagaacgatgtgctcgttcgctctgtccgctttgcgcgccgctctcgccgccgccaccgacgcgactggcggagtaggccgccacgctcctcctttggccacctccgccgttgcggcctcctcatccgcctgcagtgctcattcgctcgctcgacgcccgtcgtccgctctgctcgcagcccgccgcgcttgccttccgctcgccctccgccgtccaacgccgctccgcgtgccgccgcgccacccgcctccattctgcccacaggccgcgctcggtggactgcgggctcaaggatgacctcgtgttcggggaccctaacgcgccgcggttccgccgccacctcccggatcccgcccccacctcccgccgcggtcgtccgcagtccgccgctgctctcaccggctgtcgccccgctcctgcatgcttcacctgccgcggccgcgctcgcgctccgccgccgccgccgctctcgtcggccgttgccccgctcctgcctgcttcgcttgccgcggacgcgctcgccctacgccgccgccgccgctctcgccggccgtcatcccgcccatctcgtctcgtcgaagaaaacgagagaagagaagaaaggggaaaaggaagggatgtggggcccgcaccattttctctcacttacatgtggtccccacgtactttatttatttatttttgctgactagaatgcaacgtcagcgaaaccacccacctatactgccaagggacctcctgggaacggtttcaatgagtttaggggcgaacatctctggttttgtagttgagggaccttaaaaaaaactcgctgttaagttgagggacctccggtgaacttagtctcaaaaaacaatcgtaattagcaggccgccagcccagcccacctacttttcctacacggcccaactgccacgtcagctaaccacctcattcaatccactccactccacggagccaacccgagctcgcgagatggaagctcacctcggtccgctatcacccgaggcgctcctcttttccgcagatgcgccgcttcccaccaccgttgttgtttatgcgagaagagcatcccccggtggcagaaggtgaagcagcgtgagggccagcgcggccggcgggggctgactgtcgggcctgctcgaaggcaagggcggcggcggcgcgccgacggcgatgacggtgacgccggggaccgtgaaggcgggggaccccgtcctgcacgagccggctcaggacgttgcccccggggacatcccctcggagaaggtccagggcgtcatcgaccggatggtcgccgtcatgcgcaaggcccccggcgtcggcctcgccgccccgcagatcggcgtccccttgaaggtaacccgcaaccgaggacacgattcgtgcgatcgctcctgcattattccattgcattaattgctccaaattactccactaagtcgtctactgttcaactgtttaattacctgcttatgtttgttcctgattgacacatggctgaattgctcgacctgttaaaatttcatagattatcgtcctggaggatacccaagaatacatcagctatgctcccaagaaggacattgaagcgcaggatcgccgtcctttcgatcttcttgtgagtagtagtacatttgtcctatgtagttgccttcaccaacaattatcattaggcaatattgccgccttctcatgccgttttattttccttgtgtcccttggataccaggttatcatcaatcctaagcttaagacgacgagtaaaagaactgcattgttcttcgaggggtgtttgaggtactcgctagaatgcttctttgtgatgttattactagtttctcattatgcattgtactggattacattgtgcttgttctcatgtgtcttctggggatggcagtgtagatggatacagggcacttgtcgagcgacacctggatgttgaggtttcaggtttggacaggaatggacgccccatcaaggtagaagcttcaggatggcaggcacgtatcctgcagcacgaatgtgatcatcttgaaggtacattgtatgttgacacgatggtccctaggacattcagaattgttgataacttggatcttccgcttcctgttggatgccctccaataggtgcacgctgaggtggagagcattccacattttaaaatttccaagtagagataattgcactctatagtatacataaaatttatcccaagtataatatttgcattgctgcttatttctgtgattgccaattttccatgaattgatttttcaatgtctgttgtggtcatacacatgcggagaatcactgccttgtatgttgaattgacatcatgtggtaacattcgttgttggttgtaagatgttcgctcaatgttttttgtatggtgtccatggactctgggagaacaggaattttacacttcaatagaactgtaccttttcctccagtttttgtctcttcaacataatttgcaataccatacacttaatagtgtatactgattatttttatcatatttctgatattcttgaacttctctatatttcgtacaacttgaattttctttcatctgttttgagatttgaagctagttgagattcttccaagtttatgtaaactaatgtggttggttaaattatacaaattgcttttggtggtatggttgtgtctctgtctctcaaagcagcatgtgttgttttcctaaactagagtagcaaaaggaaacatatccatgatgggtgtaacatgattatgttgtctgatcatgtctcagaaccagtttgtttatgcagtatattatgatataatattccttctaacatattaaattcaatacctttctgtattaattttaggatagcttgatgggtggtggaaggtaagccatatataatttaaacccttttgaaaatgcaagttcgcaaagagccttgaacgcaaggaagtgaacattatgtacaaagatagaataagaaaaatgagcactaatagaagttcacaagaataaatgaacagtttgtcattatgatgtatcatttaatatgtaagtatttctccaagtgtcttaaaataatattttaaaacacccttacaatcagttgtctggataatggagtgcatctgttacttcctactgtaggaaggaattatgagacaaaaagctaacaagtatgtacttataagataaattgaacctgaaggaaacagagttcatcagttacgacagaataatgaggaacttcacacatggaccttataacttgagcatcagcatttaacaatcatgacaagtacaaagtgagtcatggtgcagatggaggacataaatgttgcaatcaagtggccacacatgacacattagaaatcaacttaatccttcgaaaccaaaatgttacatcttcgtagtcccaagtatattgtagtctacttaaagccccaagctctgaagaatggaatgcttgactttaaaggcatgcatacatttggaacagtgttttgaagataccaattttctgattctgggagatgaaggttcacttgtttcagaggcaccaaattgtagaccactgtaaagaaaaataaaacaggagaattttcagatggtatgacaatcatatactgtaggcatagacatagccatgaaattaacacataaatcatgtttgaatcagtgttcatgccctcaatattcgttcaatttcgaaacaggcaactcccaaagcattcacctactgcaactgtgcaaaaccaaaggattgagttttatacgaagtagcagttgagattttctttgttacacataccttcaaacaatgaaaactacaataatgtgagaattagatataactacgaaacttttaacatgttaaataactaatctacaggagtgttatgatttcagtctacctaccatcacagcaagccacaagaaagagatgcctttattttttaatatttgcctcttttatgtattttgtcctatgatataggggctacgggttcaataatttgttctcattgttcattggtctatatactacagtcctatcattgagctttgtaaaagataggctggactacatgaaattgagtgctacagcctactggtatgaaactgttgccaagtgtcttaacattatctccaatcctgttgattaagagaactcctgtgggtaacaaaagcaatcatcacatccaggcttgttacaaacttagacaaagtttccagtccattacctgggctgaaggagcttgtcatggaaaatggaacatttgtcagaactctcacataggctggtcctactgacatccaaaatatagaacctgagctgcacagtgaggtggtcgagtacttgagaacttccttttggtcataaagattggtcattgggatccttcaaatctggcctgaatgcaccaactagcctattgcactagcttttttccatcatacagggcaccatgccgcacaacaaggcgacctgcacatggtctgcggttctccatatgtttattctccctttttaaagtagaggaaattgtcctttgcctcacccgctcattgcagagaatccaaactcataatccatcagtttagttaattggtgttggactatagactatagagattctggttgcttgtgccattctccaactctgctatatagatggctttaggaagacccatactgattcagaactaatcatctttgggagaggagagatactagctacacattcagattcagagctaacatccgcagtcaccattgcttcattggaggagagatcattgggtagcaatggcagcccaccatggtagcagcaggaagacaaaggcagagcagtggctattcggtggaagatggaggagaactgtgaaggagacaaagcatcctgttgcctctgaagccaagcctccagctccaacatttcctacagccattcagaaggatggcgacatctgccttgagaagtccagagttcatcttcctggcctgggacagagggagatcatcgatatcgcgcccgggaggaagtcaatgccggaggtggagatcaacatgaaggaggtcagggagatcatcgatatcgtgcccgggaggaagtcgatgccggaggtggagatcaacatgaaggaggtcgtctctgtgcttggtgtgaaggtgatggctgcagacatgtcgccatttatgcagctgcatgctttccggtgtgctaagcggtcccatgatagcttggacaagttcagctcaaggcagctggcccatgatgtgaagaaggtgagcttatttttttttctttcaatttgtgatctttcgcttgtttgtttacttttgttttgtattctgaaagggattgcactgattccgttcattgtatacgctccttccctttgtcttttggacgggttctttgtgaaatcaaattttagaaacttatcatttatgttgtcaattatgagatgcacttctagcatcttctgtatcatgcaatgcacatagccttaatgctgaaacacgtagtaaaatcattatctgatatattagaacctaaatagtgttgctgcttcactttttaatacttgtttttgaaggaaaatgtaatctggcttggcttctaacatcttgtccttgatatccaacaggagtttgataaagtttatggacctacatggcattgcatcgtcggcacaagctacggctctttcgtgacgcatgcgagaggctgtttcctctacttctccatggataagatcatcgtgatgctgttcaagaccaagatcaggaaagtgttagcatcatcttgagctccatagggaccaaccatgacatatctcttgtctcaatggtcaatacacttccatcatgagaaaaaaaaagggtaattaattagtctagctctgtgagagtgaagaaacaggggaagaaaaccacctcaaataattgttttgtccgtgagttgcaagttgcagctgaacaagtactgtggttggatggtgctgatgaatactaagcaccaataggaaagcaggttgtatatgtaaattaattaattaccacttggaaagtgatgtgatgatgaactgttgtttgggtgtagtagttgttgttctccttggggacagctctgacagaggctatacaacaatcgctgtcaggatcacgttgtgagattcctgattagtagagataatcacgggctaatacggttgatcaaataccacctctcgctgtgatgatgaggtagctggttgacaattgtgtctagctcttgtagtagtggagtaaacaatacctggatggatgatggatctcgtcatcaccaccgctcactgtttccaggttctagtccaagctccatggttagtccaagctctgggtttacaagccaagaagacttgttctaccacgtgatggccatcagctcctctggctgtgcaaccatggatgcatatgatgcccggattggttgagtgataagctgtaaaaatataaagaaaccaattaaaaatatttatagctaaaattctattttacccaccattccaaaatgatcatcagattacacaggtataccaaggccctatgtagttcacaccaaacttctccccaactcctaactttccatcacatcatatcacatccaaaactttcctacatacataaactcccaactttttttccgagtaaaatgcaccagcggtccttaaacttgtcaggaggtttcacctaggtccacgaacttgcaaagcgcacatcgagatccctaaacttggtttattgtatcatcccggtccaaaaccgcgtttgaccgtggtcttacctacgtggcataccacgtggatgatgacatggaattttttaatatttttttctcccttcttctttttcctcccttccttttctttctctcctctcccgtgcctccgccagtcgacgcgggagcgggggcgaagaggggggcatcggcgagctcggcgtgagcggggcggacacgagctcggtgtgagcggcagggtggcagggcgagctcgacttgagcagcgatgactgggggaggaggacgacagcgctgcgtgcgtgcggggggaggggtgtcaccggccgcggcccgggggaggtgtcgccgaccgcggttgcgcgtgaggggggaggcgtcggcgagcaagacgcgagcggggcgggcgcgagctcgacggcggcagcggggcggcagggcgagctcgagctcggcagcacgagcttgatggcgtcagcggccatatcgagctccgtgtggcggaggacgacgagctcgagctctctcccccctccatcggcgagctcacccccaactatcccaaacttccaactttctatcacatcatatcacatccaaaattttcctatatacataaactttcaactttttttccaaacctccaactttccccaaacttccaacttttttttaagaaataaacacacagccctactctttggccggcccggcaaaaaactgagcagcagccgccatgaactccccaccctcatttctcattactgcaagagaaattatttattttttagaccttttaatttttagattttaaaaatagtccttttcaaaaataaatttttttggccacgccagtcgaatgggccaacgtcgactgttgataggaattccttcaaccctatctcaaaaccaaccttgtccttgtcgtcaaatgtctcctgataaagctattaaaagctaatttgttagtctgctgtactagtagcagtgacaatcattcgaagtactgattttgtatatctatggcgtgccacacaaatactgcggacaaaattttttgtcatcggattcttttaggctcgtgctgattttaacgagagattgggaatttaaagagatgggattgctaacttctttgtttgatatgtgtttgggagagcacagaaaatgtggtggtttattaatgtataattaattaattaattaatagctaaaaataacttgaaaaatgaattaatatatttttaaaacaactttcgtatagaaattttttgtaaaaaaacacaccatttagtagataaaaagtgtgtacgcgaaaagcgagaggaagaactcagagttttagttggatggggatcaaaaattaagggataaactattgcttttaatacagttaaggggtaaaagttgaggtatttcctctttgcattgtctaatcaaatatcaacctatcgatgatatgggcctaggggtctcaagactagagggaggaggctgcccccaataccacgtggccctcccccgaggggagtcaggcccgaggtgaggcggaggccactccctcatgtgactaggggtcgggctcccccgacccccttagcgggtcaccacgtgcggtaggttaggtggccaccttcgagcgctcacctacccgcattaatggtgacttgagcaggcgcgccacgccgcattttatatggcgtgtaccgcgcgctaaattggtctgtgactggtcaaatgaccgacgggactcgaggtgttaggcgtactactgcatgggtcagggggcgtgcaccttgtcttgtcccatcggtcatgatgacgagaggtcttaacctctcatcccggccagagttggtccatccgccctggtcaattggggattccgtttcccggtgcaaacagtgacccagaagtctccacccattaatagcagctgacatgggagcccctcgtgtcaggcggcaagatttgacaggccctatcatcaagatgacgtgcgcttgctttccaagtcaagagacaagacagacacttaatgcaaaacacttctccaccggagctaggtttttgggcccatgtggtaaccccttgaggtataaaagaaggttcaggcctagtaaaaagggggatggatctgggacgatccatttgacgctctagagcagtctctagccccggatgatcaacaccacattttactccaacaagaagatcttgtaatccttcactcaaggagcatagaacaggagtagggtattacgcttcttagcggcccgaacctgtataaacccttttggtctcatcgtctttgaggggcttgaccccctcaagatcacactgctttgctcaccgaatccttgaatctcacccgctgcccccggtcgaactcacaaaggagggcctcacggcctcccgctatagaaggtcactcctcgacacaaccctttatcttaatataaaatcttatcacaatataaactcccacagcttctaccaaacaatggattgataaaaagaaaatcatgatatcctcactactaattccctacctaaactcctaatgctctctcctaaaatttccaaaacatgctatggtattaaaaacaagagtttgaacgggaaccattggcaggtgtggtgaagttacatgagtatactcatagaatttaaatcttggtacccacaaataagttgcacaccagaccgagatggcacatgcggaattggcatgatcctttgagattgttatggatcctcgattttttcagcatgtcgttccatcgatttataaagtggtgctttgaagacggaacttatggcttgtgttgagggaatctatcatgccatgcaatgggcaatggacgatgcttcctatagttgtggaaacatattgtagtgggatgatcaatatgcggttttctaaggagttagaccgaccaatgccttttttttaaaagaggttgagttccttatggtcggaaataaaaaatttgtattaaaaaaggttcaagctagcaaattatgttagttgtgaagcaagctcaaagtttttgtgggtaactcttgtaaactcatctcacatgttgtgagggaggatttatcttccgattaataaatttcccgtttcaaaaaaaaattatggtataagttgcataaaatctcataaccccaggtattatgacacaaaatttcgcaaaacaacaactatttatcatttgagtttgatctgcgaaactcacaatcatatctcaaatttatgagttatttatccatcatataaatgttacatctatgtaagattttaatagagcatgtcaatttggttaacggcataactgctaagctttaagactataatacatatgattatgtgccacatcaaaatctaagtggttttgtgtaagttgaatcataatagactatgttttataaaatttactctcaatataaatttagtaaatcgcacttctgaatatatgaatgcggtgggtatgtcttgtgtaatcggataaaaaaatttcctaatctgtttggcacagctccagcttcagctcctctcctcctggagctggagctcagccaaacagttttagctctaccaaaaatgggagcggagctgagtggagctctatcacaaaataaactagagttatgaagctggatttagacagcttcacaactccactccagacctaactcttaaagctaaatctagcagttggaactgtaacaaacaggctgtaacggcaccgtaataaacccaacgtcctagctggaacaaatttcttatttgtcaatagaaaagttgaggtcgcgactcgcgagtatatgaggtggaaggataggtttatttatcattaatccttttaatttcacttaagtcaaaaagaaaaaaatctatactccgtagtgcttagctcagcaagacgacgaatttagaaagcagagactcctgcgccgctacagcaaagcaaagcatctcgcgccctagccaagccagccatggcgccgtcgtcgaggaaagagagggcggcggaggcgagggcgagcacctccaagccgtctcctgcgccggccccggcgccggcggtccaggtgcaacggcggccggtgggcgggggccggtggacgagccgccggatatcgttctacgcctcccgcgccttcttcctcctcatcatcctccagatcccgctcttcaggtcgcccccttctcccctcccccaatcccctctgatttacctctgtttccgtgtcgatcgtgcgctgaatcttagctaactcaagaacgcctgattaatctcgtggacgctggtgctgcttggcgacttggggcgtgattaccagatcaagaacggctgggacgcagcacacattcgtgtaggggatgcagggtacgggccttagataggcataattgtggtagaattccatcgaattcctcgattccatgcaaagcctactgccctaaatgttgtgttgatggggaaaggtaggcggtgtactcacatctcgtcagttacccttgttggacaagaagctgttaaagcctccatagtttcaagcggttaaaagcagccatagtttctcgatgtgcagggtttcagtcctcgggccgaaaagcatgattcaggttgcaaaatttggtagaaggcgagttcaaattaggcaaaatttgccacaggacactcaaaaaatgtgtaattggctgagagacaccgcaaaaacgtgacacggctaatggacactacaaaaaaaatttgtgtaattagctataggacaccagagacaatattttataatttttggtcaaaagaggtgagcaatttttcgaaatggcaaaaatgaccttggcgccatcttcctccgcctgaaatcacaaaattagctgg

SEQ ID NO: 6933 - DNA, 12165 bp, Oryza sativa
attacacaatttttgtagtgtccatcagccgggtcacgtttctacggtgtctctcagccaattacacattttttgagtgtcctgtagcaatttttttttttgcggggaatcctgtagcaaattttgccttcaaattaatctagttttgtactgacgtgggaaattgtgtctatattctgatagaactcggtaagagtcaggttgtgacttgatgagaccatatcttggttccccttaaaccctggatcggcttgttcttttttgtcctgaatcgaatagtttcttgctacggtttctgtcataaatttaccaatatgagcaaaccatgtagcgctctcaactatggttgcctcaaaatggatcctgtatgcatatcactacttgccagtaggtttgattttagtgcataggtgtgtatggtagtaacagattaatgtggtagttcaacttcttccctgctattgctagattgatgggctacttttttgttgccattcctgactgctcaatgtggttcagttttggactggatctacgtagagggaattctctcctatcttttcatatattacattgtttcataagagtcctataatttcatatcaagattttcccatacctgtacacgtgctagtgcttttatctggactcgccttttcctcctgagcatggattctaggaaattgtatgttactttgcttctgtaaccatgcttgcttattttaccaaattacattttagtttattgcttaaggttgtcatgattgataaggtcgattttggaaactaaaatacttggaagtacttttctgagtaggacgataaatatactaagtagattctgcttaccttcttctgccatttcagggtcccttgtagagcaggcacatgcacaacgcccattcaagttacatcttcgcagttggtctcaaatgagatattcccaccatctgttgtgaaagcccttctcttccctggggctatagcaagcaaccttactaagagcatgacatttcctaggtggaatgacctgtttgatatttacaatttgacagaagccaagaccgcttcagcagtaattgatctccagcgtctagaggtactctttttttttttttaataactggccaactttcttaagcagataattgtgacaattgttacactttactctctttctcacttctcaaccagattcttgctggaagctacttctgtgctgctggagcacttgttggtgtcataaaccctgggaggatgaccttgtttggtacccttttggttatctggggtctagtgaaagaagcgctctttgggaaaccggtgaacagtgatccaacacaatcagttcatgtttatccgaccattttaattgcactgatttgtgcattcttgtcaataacttacaatgtaaagaagacagtaagaaatagtcagtctgtttcaatcactaagcctctgcaaagttctgccaagtcgaaactgaagtagacacttcattgtctatttgccccttcatccttgtagttcatttccacaaatttattgttgaagactggcccaaaggataacactactgtggttcttgtgtaccactttgaatactgtaaccttcagttttcacctttgtatcaaagacttatatctataacttttattgcaagcatattcactttaatttccctcgtatttatttatgtatatgctgtttacactgttaagactactggcatcatgtcacccttcctcttgaaggatgatattttatctttttgtaaattccatctattacttgctataacctatagctctgaagttctcagatacatgggaagttttcccacagtataacttgttcaatattcattttctttgtcagtacaatcttgctttaatcctctgataaatcaagaatttatgattaccattttagtttaactatttaagtttcccagtaactttgttttcacctatattctcacactggcccaatggacgatgtgtccttctattttattctgcatttggaattctacacaagaagtactttctgaactgttagctgatgaatcgaacaaaatggagttgaagaggacaggacacatgtatctgtcagaatttgctctatcatgaagtgatacatcattagcggcagtactgctgtcctagcatttgtatacttgtattgtgtaaagaagggcaagaatcaaggctgcatgtgcaagtggctcgtctcctatctcttgctctctgttgatgtctggttgatgatgagatcagaggaaaggagacaggctgagccccacccaaaccccatgtgagcattgtccttttaacctgtctgtatttttgtacactctgctgcttgcccttctggtgaaaccagacctgaactcttttatctacccgactgcagcctgaagctgattaacaagtctgaagaagcaaacaatgccacggagctactggatttgtcatgtagaaggggctgaagagataagctgattcggtcgaaatgttaggtggtttctcaagtcagctatcatagtcttctagaatgctcttcttgtcagatttctctcttggcaagagataaaaacaggcataggctcctcttcaataattgagatcccttctctctatgttacttcctcctgctgtcataatgattgctatggttagcctgtcaaggttatacatgagcctatttggttcttgtttttactagtataagtggttgcttaagatctaaaactatccttccacctagactacattagcctctgctagcctaatttgtcaagaagccctgcttttgcagttcacattcttcccaagccttcctacagactgctgttcagacttcagttccatggttcagatgtctatacagaggtcagttgttcttctgttacttcttgaaattaattttagcatttactggtgtttagtgtattcagacttcgagagctatggcaaaatgactcaaaaatgtttgcagggctgcaaccatttcacctccttgttccttatccttgccatttgattgtgtgagtggtacaagtagaagatttgcctcatgtagatcccagtattcatgctttgcctatagtgaaagactatctccaaatgttttgaagaccaacagtgtcgtcgatccctctgaaccgaagattttggatgcgagttcttctgcttcaagaactggacaatatagtgcaactactcatctatcaggtacaattggagtaatgggaatatctgcctcttcctctctcagattcttacagaagcttgtgcattggagtactcgtgatggagaagaggcacctccctttctcgtgtgtaatgatccacttcttaagaaggagctcatgtcatctcaaaattcacagcgcccttccgactgtaacactgctcttgggaagttaaggctgaggaggctcctcttggagaaatctggagtatgctgcattgccatgccatgtaataccttacatgcctaccatgatgaaatttcacaaggatgctctgtaccttccctccatattggtgattgtgttgtaaaggaactcaaatcggcaaacttaaaacctgttgaatatggaagtaatgtttgtgtcggaattctatgtacagacaatacattgaatgcaaagtgttatctaaataagctggagagccaggtaagacatcttttatttggtcatcaatcatcgtttttgcaacaacatatttatttctttttcttaaacaaactactatatatttaatttaaatttaatgtttacaaataagtagctttattgcaaatgaaatagtaagatgtagacaaaatgcttgtttcctaccttgctcagtttgcaaaattttagcaatcaatatttcaggccttcatttggaaacatctatatgacaaccaaagcacttcatatatgttccacctgttaggcaactcatgtcctatatcagtaacgaatgatcagattttcttttcccagtttgctttgcactggtatactttcttttacatgacaggccagtttacaaaaagattgacaaccacagatcttatgccgattgtagtctgcccattcccgatttgccaatcccatgataacttgtccatttccaatttgtcatattattgatatccctttagacattctagttgacattttccttcaatactgtacacccatcccatccaattggcagcatatggttatgttgttttgttcttaaattccattttcacagggttttgaggtgctgcttccagataaagcttcattggagcacacggtattaccagccatcggcgcttttaggagaggggacatggaaggtgcaagaaatctgttgcgaatatcactacaggttatgttcgtgagggctgtcaatacaataatccttgcatctgatgactttgttggtatattacctgatgatgacccactgctcaagaaatgcatagacccaatggatgctttggttagagagaccatcatgtgtgcaagaacagatagcctgagaccatgatatccttcaaagtgatgctggttccttgtacagtttgcaagtagtagatgttttcattttttatctccagcgagcacacatgtaaattttaggatcagagaagaattcactattcatcacaagtcaatatcattaatagtacagtgtattatgcagtgtgatctgggtatgcattatgccttgctgctaagtcaagaaagatgccgagtccatctgcgagttcagattttgtcagatgtgtttgtggcctggccacaccagggaaaacttcaaacaagaatctagaaatcaaatagatgatgtggatgtttctgtggatcagcctgtagatagaacaaatgaagacatcgtcgaatcttaactgcgcagaaggagcacctttctttttcagataagtagcaactgccttgacatctgagatcacagttattcagtaacatctccctcttgtcaaaaatatatccccatcagaaagaatgcagcctcatgctcttccaaacacttctacaaggcgtgttcagacttcagagcctgtatggtaacacagttatcagaaagttatcagtgtgttttttttttcagaagttgtaacagagatgatgcttccattttgacttgggaaagccaatctgagtgggcctgttcactggtattccaagagaatctggtgattggtgtggaggaggagggggaggggcttgaatgttctgtgcacaggtgggattgcaaaaggtgtgcacaatgagtgagcaatgattcaggctgtctgcaggggccttcaccaaacaagtggctaccctttctcccatgcaggaaccagggacaaaaagaaaggaagcacaggggacaatgcaacaccaattgggccttcctctctctgttcttcagggtaagcaaaggcaccaatgcttaacccaagattgatcatatcagaccctgtgctggagaaataaacaactccagcatcatgctattgtgctgtgatatatttgtatacatattcagatatggctttgttttttaagttcttcggtcgtcgcggtcgggatatttattccattatcataagaaataataacaatactacatacatattcagatgttctgatgcttcatgaccgatcacacacttttcttttctcctcttcacaaaaggggaagaggagatcaggagaaagaatagtgctatcttccattcagtctgaaatgatttgaggaagcatctgaagatagtgtaatgctagagctacagaaagcctttgcaatgtgtttgtgtgtgtgtgtggaatgtggattgcctgtgtgcggctgctctgctgccattttgagtgttgaggttttgttgcttgatgaattgatgatgatgatgatgatgcccaaagtggtaataatgctctgcatctcgatcaccttgcttttacaagtaaagcagcgccatgattgttccctggaatcttatccaactatacctccacacacacacaattcttcttgttcatctctccctctatagatttgtgaattccaattgaaagcaaagctatgcttctagtatcaatcagttgagagagagagagagagagagagagagagagagatgaacaagaggtggtcacatcgatcgagcagcaatctgattgagaaaacattcgcttgtggctgcgataattcgctgtcgcctctttgttccctgtacatgataaatataataaatatataataatggcgaagcactaattcggctttgcatatgcgatgaacaattagcaggaaagggagaaggcatctgtttatggatagatttctgccaaatttgtacgccaccgggattgcagttacagtcaaacgattaggaataatccatgtcatgctccatccacatactacatttgttcatcaagcattctaattcttctttctcgcaaagtagacttagagttaagtgtaactaagagagtgaaagacggggcaaatcacaggccaactcgcatttttgctttcttaattatctgccttttattgggaaaaaaaagaggaagactgatcagtcatcagccacaattttgtgccgtttttgtgtttttttagtaccgttaccgctcttacaaatgaaaaaaaaccctcaggttatcgagggttattctaaaaaaaaatagaaaaaagaaaaccctgaagggcatgaccggtggccgatcaatcttgtccgtcgatcttcgatctcgtaaattttatttccctttcatttcttctcagtgcaaggcatatatcatatatgtcagatcaatcaactgaaaagagtagagaaagaagagaagagaaaactgaatcagatgagatcatatatttagcagcagtttgtcactgtcaaattgcaaatgtgccatcatgtgggtagcttaccgtagtatctggggaaattgcaccggaagcactcggttctgttagcgtagttctgcacgttgcattccattctgcaaaatcaccaaaacatgtaaatatgcatcagcactaacattccatatatatatatatatatatacttcttcagaacagatgataacattcacattcagaactattatcaatgctggtcgatcagttttttttaaacaaagcttgaggtgtcgtaattaaacatcttgatcagcagtggtagtaactaaaacaaggaatgcagaactgacacgtcaagaggtaatattccagttggcatgcagctccggattctgttgggcatagaatctttggactagacacatgcatgctttagtttagcgtttcctttttaaacacatataactaatactattaatgttcaaaaaaacaactaatactattttcacagagacatgctcgatcgtggcaaaagaacaatttgcacacttatgcatgcatctccgtgcaatctaattaaattaatcagctaatgtgattagccagaggcagagcatgctgcattcccaagcagccacctccgcctcttaaaataaaaaagaaatataagacgtattttgtttcgttaggacaagacttagacttgaacgagctaggaacaactaatgaagtatgaaattacctggggcagatccagtcgccgttcttccagccggcctgggaggcgacggagaagccccagccctgggcgacggcggcggcggagtcgttcttggcggcgccgcacttgaagcagctgccgcggctggcgtagttgttgacggcgcagcagcggcagcaccagtcgccgggcttcacctcccacccgccgcccatggcggcgtagtccgtccgctccaccccgagcttcgcctccccgcaccgctggcacgcctccctcttgcagaagttcacgtactggcacgacctgcagctccagtcccccggcttcctcatcgccatcgccgccgccttcgtctccatctctatctacctatctatctatctatctatctatcgagcaaatagaatgtacaagaagaagaagaagaagaagaagaagaagaagaagaagatgatggtcgttatcgagcaaagagcagagcagagagagctgagctagctggagcagactggaatgctgctcagcagctagctagcaagcttgcttgcttgagcttgagctctgatgaatggatggatggatggaggcttgggtttggaaggggaggtggcgcgggcttttatatagggtttggtgatgcactggagcttaggtgatgagctaggccagttgagttggggcccaagtaaagccgcgcaccgggggaagaagcatccattcgtccatctctgctagctgcatgttatgttgttgttggtagtaatattgtgcgtgcatgcatgcatgtcttgtctagctgcctgctggctataggctacatatgctcccttttgggctgagctagctagctctcccataactggggaatctccaggattgatgggacttgtgaattctctgccaattaacaagtgtgaataaatgaattattgaaaatgaataggagcctacaaggtcaggcctttgcctttccagctttgattatctttggttatgtgcatgcatgcatggctgtgtttatatattcatgtgagggatagaatttgtggttgttgacatggagtaaatttagtaaaacggcgcaaactttcacaaaactataaataaattaatcaagttatacttcctctgtttcaaaatgtaagatgcggttgttttggagtcaaacttaaaaaaactgacttacagcaaaaactaaaacatcttaaattttagaaaaggggatagcaatgttgaaaactatatatttagccataaatttagcaaaactcttgagatccatggaaataatggtggataaaatctctaattaagaccttagtatttgatcataaatgttcgctttaggtatatagtttggagtacacatttcactttgaactaaaaatatattgacaaatgttacacacaactaatggatcgatcaagtcgtgcccatgtttttacttaacaccaggttttctactttattgattggaccagagttcatgaataaaccccaccacgatggcttcagcgcaagtacgggcaaggtgtaggtgacttgtagcattgctccacccctgctaggtcatgagatcaatcaatcaatgttctaacctattccatcctctcttttgctctagctaccaccatgaaaaaaacgagtaggaattatgcgccattaatgatggctagagcaggaagttgggatgggggaggggttgggaaaaatagacatgcatggacacatgaatgaatagtctaggcatcttgcccatcagctatggtgatggtgctttgtctgaatttaggaactgaataatggttccaattcctttcaaaagtggagggttgcttgatcaaatactatctaagtacttcctccgcgtcctaaaatatagctacttgtagtgtttaaattttattttaaaatacagctacttctagagtaagaagagatatttgtagtgatgaaatgtcaaaaatacccttcttcttcaccataccgaccaatcaggacaattaatgaaggaaaatttagtctttttacctctttttttagttatctctatgaaaaactctagaaagtaaggtagatagtatgagatgattcttctaagctatatgtttaatgttatgatttatttatagaataaactaaattaatatgtgcttatatatccaacagtaataaatatttgtattggccaatactcatcccattcaaatcaacattgagatttaacttgcctttccacatctattatattggcgagtgatgcacaccatatataaaagaagtcacctcagcaatacgtgtcctatttttccttggtacattcaattttcctgacaacagtcctttaactctcgtaaccggggacatttgaccatgaaaagcggaaacgctgaattgcaaggtaaaaaagtacatgaaaaaaattttttttgcgagaaaaaagaaaaaaatgttttatggttatccgacacaggaaattacaagtctctaaaacctaagcagtgaattaactttcttgcgggcgattgtcaggaaatctggtaggaatcacagtacacttcgttgttggttaacagttgacaaagtaaaattcccccttgcaattgcagattatcctaatgattcatgcatgaggatttaccatatatatctagcaaaatgtttcatgatagagtgaactatatattaccatattttgcttcctcggtagatagaattgagagaagactctctgctacctcagtttttctatcttatggaaataaacttactatggttaattcagttttctattcctaccaacctactatatgtgtactttgaagttgcctaaaacaataattgacaatattgatcgaggaaggagacaccgtctttagagaggttatgatgtcaattccaataagaagtcattggctgtttgggacaaggtttgcaaacctaagacaaagggggttcttggggttatcaatcttacaatccagaacctccttctaaagtatctagacaagttctatgatagcaagaatttgccccgggtcaatcttatttgatcctcttattatagaaacggagtgcctcacttatccaccctcaaggggtcttttcggtggaaggatgtttgcaatttgatagatttcattggaggcattgccagatgtttaataggagatggagtttcatgctctttttggaatgatggacctcctctttctatccatatgccaagactgtcttcttttgttttgaatgcaaagatcccagtcacaattttctttcaatttagttggaagataattttcacttgcccctatctcaagaagcttatcttaacttgtagtctttgaaagttttgcttaaagaggtaagcttgtcacaggaaaatgatacatgggcatatatttggggtaatttgaagtacaggtcacagaagttttacattcttaattttagagttttgcaaccacctcagcatttcctttggttacggaagagtaagacaggtcaaagtgtttggttggttactactcatggaaagattaaatataaagtatatgctggatcataaacattgtgctcctccaaactgtgacctccaatgcgtgttttgttcaactcaatctttggaaatcttaatcatcttttttttttccaatgccctttctcagtgagattttggaatatcttagatattgtttgggacacctctttgacactagatagcatggtggtggaagccagagatagataccatggccattactttatggaaaaattcttatttgagacatgaaatatttggaagcaaaggaatgggtttatttttgaaaatactcatccttgtttgtcttcttggagataactccctaaggctgatctcctccttttgttgtttaggttgaatgagagagataagaatgtagttttgagttgaattagattgttgtaatttttttcttttttcctgtacttgttttctttctttaataaaaatctatttaacaacggggcctcctatgctgtaatttctttaaaaaaaactatatattgccatgaaggtctcactactagaaaaatcatttttcccaacgtgggagtcttattttcgcaggcagacatgacccttagagccaaatgaccgcctacaaaaatataaatcgagatgaaatttgatgtccgcctgcgaaaatattttcacaggcggaccacttaagcggcgcctgcgaatgattttcgcaggcgccgcatcattttcgtaggcgccacttaagtggtccgcctacgaaaaaaaacttgaatataaatagactcggcataggaggagattttttctaagtctccacacctcaccactcacggccggcaagcttatccattcaacccctcagtccctcagctctctcatcccctccccctcacctctcctcttctccccacctcaacggccggcctctcccctcccctgacctttccttctctcccggcggcggcggcgggcggtggcggcggagggcagtggcggcgcgcttccggccccttccttccagatctggcccgaaggggg

SEQ ID NO: 6934 - DNA, 5240 bp, Oryza sativa
  unsure (1)..(5240): unsure at all n locations
agatccgcgttgacgacggcgggccgtggccttgcggcggtggcgcggacgacggcgggccgcggcggacgacggcgcggcgcggacgtgcagcgccggcggatgatggctaggcggcggccatgatttcttgaatgtttttatttgctttcttctagaattgattcggtgattttggatgaaccgtggatgaattgattcggtgatttttggatgaactggatgaattgattggattggatggggaatgggtgggaactggattgggaacgggaagctaccgtcggaaacggcggtggctgcccattttttttagctctcgaagctattttcgcaggcagacctgttgcgcgcctgtgaaaatcaactattttcgcaggcgttgaggtgcaggcggatggcttgtccgcctgcgaaaatatgattcggccgactgggaaaagaatttttctagcagtgtctctccctctacaaataatgatctgtaagtctgtagtgcctcagtcaacttagaaactctagcttttccattctttaatatttaactagttttgattgtacaaacaacagttttaggtacactttcatatattctctgacttgccttgttaatttaattatacacggaactagaataagaataaccgaccatgcatgcatatatatatatatgcacaaaaaagttttccatgcgtccaaaaatgaacatatatccaaactgaattattacctatatatatatgtatgggctttcagctttctcgtgcatatatgtgctagctaggcatatgtatgcatgtgtttttcatggcacatgcgtgcgtcgcaaacaagcaaactaataacccgcagtttacacatgtaatgtaattaaaaaaaatatacacagcgcatatgcgtgcgtcgcaaacaagcaaactattaagctgcagtttatccacgtgtaactaaaagaaaaaaaaatcaaagcatgggatcgaatcacaccgtactagaaatatcagacatgaaaatatgcacgcagttcatgctagttctcaaccgatatatttataggggtaaacgaaatttgatgaaatatatttattttgaatgacttaagtattgtggatactgataagcattttcatatctttgatttagaaattttagattatatagatttgtgaatttcgttatagtatcttgccagatactaataatagggcatcatatttttgtacaccacactagtcacatcgtattttatatcaactcctgaattgggcaggatatttaaaattgttaactatattagggtatatcacctttataggatatgattagatgctttttggctatagctagaaaattgccttattctattcgtcgtatttagagcaccatatatcacgtaatttaaacggcaacatatcctatgcacacaggccctcacgtgtacacacgtgcacaccaactaaaaaatatcacaaaaaaatctagaaaaaatcatacacatactttcaattgtattacacctagggttaaaatcttaacatcaaattcattatattttagccgtaacaaaaaaaacaaaaaatctaacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacatggtgtgtacacgcgagggcctgtgtgtataggatacgctcccaacttaaacagctataaacttgggctccttgcctttagaacatatggattttaaataaattagatttgttcccataaaatttctgcaaattcatctattccaaagaggccttagggtgtattctacactcctattcccaagtcccaactctactccctcattttccatgcgcacgctttctgaaccgttaagggctcgttcggttcacaagatttttaaaacgtagaaataggaaaaacgtaggaatactataggaaatacatgtgtaaacctatggattgaaaaacacaagaatttttcctatgttgttgagcaagccaaccaaagaaatgcaaacattagattggagtggattattttttcctatgcttttccttcaaaaatgaaggaatagaaaactttcctatagttttcctatgttgcattcatatgaaatgaatggtagtttaaaacctatttctattcctatgtttttcctttgcaattcctttgaaacgaataagccctaaacggtatgtatttttttcaaaaaatttctataggaaatttgatttaaaatatcatatttatccattttccaagtttttagctaatatttaattaatcatgccctaatacattgttccattttgtatgccggggaaagagttcccaaccctcagcgcccaacagagcccaatgtttctctgtctccattgttgatttatgaaaggcatgatagtatcactacttagtgtatattgtgttgttaatatttatatacaatatgtttgctcgcatttataagataatggacataggaaaaacactttcaaatataaatacagtgatagtactttggttaaacagaacagatatacctttggaatagagaaatatatacacgtactaactagtcgactgtctgtcaggggtggacacacccactgggtagggtgggtcaactagcccagctacaaagggccggagctagaacgaaatagaggagggtatcacttgtttaatttactctactttaaattgagtttaaactgatgtaggtgtcaatgtttatattaaagagggtgcatacatggtgaaaatagatgagatatagctaaagtagggatacaaatatttatggaaattcatgaccaaataaatgagcattatttctatacaagtggtaccatttttgtcgttctgattttggccaaacataaaatttgatttttttttctctttctttagaactatattacagtctactaaatagttaatttggtaaatatatatataaaagtttattttactccccaaaactattttggcggagcacttaaccccctaaatactttttttggggggtttatttcacactcccaaactattcaaggtggatcaccttactctgtaacaatatttcttaatttctttaatctctctatgcaaatcgtatttgcactgaaattatgtaggattggtatatccattataacctacctcttgaaatcttattaagaaatttttatcactgtttacataggttggaagaactaattgtgaaaatattttgaaactttgataatggtgttatttatgagaaatgttgttaagcagtaaagtgaaccattattaatagtttaagggtaaaatgagaaaaaaaatacttaaggagttaaatgatccaatgaaatagtctgaaatagtcttggggagtaaaatagacttttcaaaatatgaatgttttgtaaatcatttctaaattaataatttttgggttcgaccattttcatccctaattctcaatatgaggcttccattgccatctcatcttcatgactacgctcattgcctcacctatctgacgcagacgtttgttcgactgttaatctttgttaacttgcttgatgttcgtgagatgcgcctccgtgccagtgccataagctggcgattatggcttgtgtgcgatgtgccatcatccaattagggctagcgccttgctagatatcgccccatctatatattttaaagctgtgtctgccactgctgcctgtagaatataaatattcaatgaatcaacagtaatcatctcttcgagagggatctcgttcttctttctatataggcttaatatttcgagagagctgttctaaaatttttattcatagcttgtagtataacttaactattctttgcagatataattaataaatttaaactgtgggggacttccaagcagtattttggtaaaaaaaaatcagcagtaataataactgccagttcacttgtgtgctaagtttacttatacaccggtagtgacgtagggtttatagattcttggttctaaagtaatgcaaacgtaatttgaacaacttatattgactttgaaaagttggaaacatgtctttgacagaaggtagtaacattataatctatttttatctccctccaatcctcaagaggacaaaaatccttgtcaattattagggattggcagcatatattgtccaccaaacccatctaggttgccaagtctcccagcgacagagatgtcgtaaaacacatgtggtatagtataatatttgatgctcctgggacaatgagccccgcaaattataccggtgactttatgtgattcccatgcatgactccctatcctttaatttgcacactttgttagaaagggccttgagagatggatgtgaagctgtaatgcaaaaaaaggcgaagaggatcgatggatgtggaggtgctggtgtactgtcagaatgttgtaatgcaaaagaaaagccatatatgtacaaaaatgagtatgcaaggaaggttttatgtgggggttgtatattctctttactcacaatcatgcagccaaggtccatggccaaggccagcccagccatccatccatccattgtggtttagatgccccttccatcttgcaatgtccacacaatccgctggctagtgtacatgtaagatacacgcatgcacacatttgaacgtgcttcatcggtcgatatctaagtttgtgttactatggattcatatcctttgccactataatcagataaaaatatcataatagtctataacaaaacctccggttaactaaaattgtactatatatatcatccaccctcattgattaatcgtaaggtgcagatataattgtgcggacttgtgaatttttcctacatagacagagcacacggtagctagataaccgtcaacatcatcaaatgccagtggaacaatgcacatgcttgctctactatagcaagccagagagctcggatagatggctgtctagggtcgccgggttctcaatccaccactgatgatattatatatatgctaatataatatgaatgtaaggttctctatataagtccggagaacttgggccgttgagttgtcgatcacatgacggtnnnnnnnnnnnnnnnnnnnnnnnnnnnnnnnnnnnnnnnnn

SEQ ID NO: 6935 - DNA, 1689 bp, Oryza sativa
ttgctgctggttcagagtttctgctgctcccccgaggccgccgccgcagttagttccggttacccgtggcgcccgaggtatctctggcccattgtatatatgggccacaagaagggccaacttaaatgggtctcatgtacgccaccgcgatccctttatggcccaataaacgcaggcccagttttgagcttttgttcttcccttcctcaaccgaaggccgcagcaaacgacgaaacaagatggcgtttttctaccgcgccgccgcgcgccagtcgagatctccggttacgagctcgttccaggcggcgaagcatccggtctctcctccccgcctccgcaggtcacgcccaaagtacctagatcctgactgtttcaggtccttcgtggcggtggcagcggcgctggcgagcgtggattctttgatgccgctgcacagcgcggtggcggcggcaaggctgcggtcgtgcatcgccgccgattcgtcctaccggagcggcctctcctaaggtcagggctctgcattcctttacctctgtactcaatgtgaaaactgctagtggttgtttggttttttttagataatggattaaaccggcctctgcacctaaaggatgtacatagccttacggaataggatcctctgacgtagagcaatctacgtcagagggacgtccgatgccactatgccgctcgatcgccatccaacggaggtaaacaagcacagcggacctactggcttcttttcagcccacgccgaccaaaatcaacccacgaaaatggaaggctcgctcccggccggccgcttctctcgtcatatgccgccgagttcttcaccaacggtgtcgcaggcccgcagcgcagcatcctgcggcggtgccgtccgcattgagtgtgtggttcgcctgcaccgacctcctgtcgttggggccagcgcttctggcggagccatgggccatggcagcctagctgcctccttgagctcacgctcagatggagcactgctgaatctcactcttctctgctgtggccaggacggtcagggcgcggaggcggccatggcggcgcgcggccatggcggcgcgcggccagggcggcgcggcgtggcagcggtcgggtcgaagcaggcggtgcggcgtgagcgcgacgacgtgggtggccgatgcggcggctgttcgggcggtgcggccctacggccgtgcagcgccgtgcgggacgcggctgacggctattgtgcggcgacacacggcacatcgccgtacggggcgacagccgtgcgggggcgcatggggcgcatggggcgcccggggtgaggccgtgtggaggcggcacgagtgtggcatcctcggcgtgggcgcatgcgcgcagcggtggtgctgctcgggtgcggctgccgtgctcacagaagaggatgcttgtttaccttcgttggatggcgatcgagcagtgtagcggcatctgacgtccctctgacgtagattagattgctctacgtcagaggatcatgttcccagccttactctgcacccaaaggatgtacatagccttagtggttggtgttacaagagaattgctttccttttgccttggctaatgtggaaatcggcttctttgacctgagataattgatttgtgttaaaattccttctttggcctctggctgatgaaagttgtagcccttgagatcattgc

SEQ ID NO: 6936 - DNA, 18760 bp, Oryza sativa
  unsure (1)..(18760): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggtggacatcaagtctaccgaggtggatccagacaatgtgattccaataaccatggacatgctaacatcagaacagaagcaagggtttgaagggatgataaatcaactgcaaaatcggtacttacattcatttgttctgactcgttcgggtacagtaattcaaagacacaaggtggatttgccaccggttgatgagaagcctgagtcaagctctgctaatgatgataaacttaaggaagtcaaagctgaaggactcaaacgggaggatgatggtgctccagagttcaacaatctacaagatcgatcagtgtggtcgtgacactgaaaattttgatttaaaatttgattccattttgctctgaaaaattcaatttgaataattgccacaaaattcaaacctaaatgcaatttctttaaaaaaattcaaacatgctttgttgcagaaatcaaattgatgaaaacaaatatgaggatacataccaatttacctattggcgagggcggcgtcgcttcaagtccgacgtgcaagaccgtacctccgacgttcatttcacggatttttcacccgtctccggaggtgatggagtgggcgttttctgcttcgcacgccataccttctttgttcttggtatgggcggcggcttcttctgagccagcttttcttccttcttggccggtgtcttgggttttaccggcgttttccaataacgggacctcatcctggatggttgaatttctagagatttcttcataaacacgatgaggctatccattttgggtggctccacttcgaccgtctgaatgttctacggggctggcccgtactttattcggaacatggagcattgttccgtccttggctggaactcgaacttctcctccttcccgttgatgcggaaacggatacttcccgttccgacatcaatgtttgcttccgcagtgctcaggaacggacgccccaggatgagcggtgtctccttgccagtgtctatgtctagcaccacgaagtcgaccgggataaagcaatctcgtatcttgaccggtacgtcttccgctatcccagctaggtagtgaaccgatgagtcagccaattgaaggcgcatcggtgttggtgtcaacaccgtgaagttgagcttgtcaaagacatccttgggcatgacacttacacttgccccaagatcgcagagcgccaggtcgaatttctatgtcccaattgagcaagtaattgtgggacacctcggatccttcggatccttcttcttctccgggagtttgtggaggatcacgttgctgcattcctccgtcagcttgaccacctcggttgttggtagtggtcgcttgttgttgaggatgtccttgagataacgtgcgtacgttggcacttgcatagcatccaacaacggcatgttgatgtggaatttctagatcacctcaacgaatcgagcgaactattccgcaactgacggtttcctgatcctctatgggaatggcagcaacctcgcgttgcagtagtcttgccgcacgggcttctcttgctgaatttcttcttcagccgttgtgttggatggtgagtcccgcgtgttgcttgtacctgcagtgttaggatatggcggatcgcgagtggacttacctcccctcgtcgtgatcaccttaacattttcaatggagggtttgggttgccccgggatccttccagtttcatttgcaagtactagagcggcaagttgcgccaactgggtttcaatcatcttattgaaactcaactggttttgaaatgcggaagcaaagccatctagtttcacatttatattttctaagatcttgtcattggcagccatctttttgttgagtgcgtcggtagttttggcttgcgcaaagacaagatcctttaaggaagacagattagaaaagctaccttggttattgcctccttggaaatacggacggggatggtttcacccctgacctccttgtgggtgatacccattgttgttattgttgttgttacccatgtacatcacctcctcatgggttttcgggcagtcgttcccagagtgacccgtgttgccacagacttcacacgtaacgtgtgagtccaaggccttgacggtgccttggggcttcttctcgtgttcgtccaatctcttcatgaggaggtcgagttttgcagtgaacatttccgtctccttgacggtgtgcattccttgctgatgggactagagtcgtacctcgctccaccccatattagagaccattttctctatcagatcgacggcccctctgaccgtcttagagaaaaaggctcctccagctgccgcgtctaggtggtcacgggacgtgggagtgagtccattataaaagttctacaggatcagccagtcgtccatctcatgatgaggacaggcggccacgtactcctgcagacgttcccatgcctctggaatggactcatcacgtgtctgctggaagctcgaaattctcccacgaagggcatttgtcttgcccatcggaaagaacttcgacaagaatactatcgagcatttgtcccaggtattgatcacggcacgattggcataaaaccactgcttcgctttcccgaggagggaaaacggaaacagccgcagcctgacgacgtcaggactgacgccctttacggtgtacgtgctgcagatctccaggaaccattgcatatgtgcattagcatcctcgttaggcttgccgcagaatgggctagcctgcgccatcgtaatgaggctggatttcaggtcaaagtccacgtctcccatgttgagttgcggcccagtggccacgttctcagaggagggagcagcgaactcgcggagggtcttgtcagccatagtcttgaaagttggtggcgctggtacggctggcttctttgtcggaagagtcttctgcgggggaacaacccgcggctttacgcttcggaagaagacttctggattttcttgaaaattttccggcaagtcgaaacctgtcatgcactaccctgttttcacaacaaaaggtgaaaacaacatggttagcctgcaaagcacagtgattatatagaggtaaatataagatattagttttagtaatctctttttacaaatcttccccgggaacggcgctagaaatgcttgttggtatttcttaacgacattactagaaatataattcccagcaatggcgccaaaaatagtcatggtatattatggttacagagtttatccacaagcgcatggatataccattgtagcatttcacccgagagtattccaagggtatcatatttgtttatcccatgggaagattataatagagagaaccaaactaatatttatatgttacttgtattaatcatgtctaagcaggggtaaatataattgcagggtagaatgacacacaagcataagctactcattcttatattaaatctcctaagctaagtggaaagagtatagaaaagaatctatttctatacttctagtatacatattatacatacatcctaggtatatgattaactagctaataccccctttccgatgccctcctggtactttgagaagccacccctgacagctgagttccttacgacagcccgtcataaccattcaaccagggctaaatacggaggagtaccctccccagggaattaacttaggactatatacacgcgcggaggaatacccatactgagctgtcgccatcagcggcccacctctcatccgcagcatataaccccaaataatgataccgagtaatctagataccatgcctaaactaccagatactactctagtatcatcgtcatgacatagagtaatttcatatgcaaacattatacccgtaccaatgcatctcccagataagctagcagtataatcataatatctcagacattgtaaagcttgtattcatataattggagagtattacaataccagagtcgtatacaaaagtatattctaaattaaatactagtcttacaaaagaagaaagtaaagctactagagccatacccgaactcttccgaagacttccggactttgactacaattttattccgactccactagcttgagagcactaaactaacttgagagaatatgagagctttgttgcttgaagtgtgtggagaaagtgagagggtgaggggtttatatagcctcccaatgacgattgtgatggttggaatggtcggaaataccctccaaccatcattgggggctaatctaagttgttcccccaaagcgctgcatccaacggcgatgaggagggttacctcaggccggcccaaccagcccaccttttatcctgcggcctccctgacttcatctctccgcagacttatgaattttgggcattttgggtcttctgaaattgatattttcagcccatcttcctttaagtctgattctcggcatcgtctgattgatcgatcgagtgttttgatgcctattcttctccatttattgcttattctctacaagaggttagtaaaccaagtaatagtggattttattttattctaacactatatgcattgtaagcatgactagttctccttttattccggtaatattgacgggcgaaattgatcgataacgaccgtcaacagcgggcggcgccagaggagatgttgccgccattgacggcggacgatttgtgattttgtggttttttagatgatttgtgaatttgtggatgattttgttgtttagtatgttcattcgatctgtgacgtcaatttgatgtggggatttgggaatgtcggcaattagcaaaataaaaaacaatgaaaaaaagaaaaagagaagacctttagtcctggttggtgaatctttagtcccagttatttcaaccgagacaaaagatagatatctttagtcctgctttcagagtcccagtttgtaacccgggactaaagaggttgtaaaccgggagcaaagagggtatacccaacagtgtatagtactaaccagtgggtttagttaagttgcccgcatctctttcgataaaactgacatccagaaagtaaggcaagtgggggtaagcgtaagccaaaaacaagttacgtcaaagaaccaaagaagcacggcggtatcttcttctgttcacgcacatgcatttatgcatttccaactcgaatgtgtgccagtgccactcgcatatatcaaatcaacatattggctcgtccctccaattcgagacaatactacaacatctagaaaacaactttaaacattattttttattataatatatatgaaaacaataacaaataaatgatattattaaaatactttttaagactactctatacatataatctccatatttctaagataaatattttagaaattattatagataaagattttaaagtttgatcttatattctcatttgtgttcaaaacgaccagtattatttgtccggatgagtagtataattacttttagagtttaaatttatcttaaaaaatatagttatttcttctttatcttctcattacagtgaataataacaatctctcattgaatttctatacctactttctatttttaacaaatcataaacttctaaaatttatacacctattttctatttttaaccaatcaaaaccttccaatttaaaagtatttaagaatacttaaattttagtactgaggggagtagtctggtacccacactacctgcatgaaaataataataataaaaaactgatgccaccacactaccacagcaagtctggtacccacgctaccaactttctctaacttctactctctcgttttttatgcacatgttttccaaactgctaaacggtgtgtgttttataaaagttttctatagaaaagttacattaaaaaaatcatattaatttatttttcaagtttttaagactaatacttaattaatcacgtgctaatggacaaccccattttccgtggaattcaacctcccgaacgtagccctagttaacataccatcaagatttcagatcatctatctttggatatttgatcaagtaagaggagcagctaaattttataattttttttataaaatttggtgaaaaaagacgaaaaatttgcactcaatctgcagggcctatgccaatgtccaaagcttcacctttttttttataaaccagcttgatgttttatcattcttgaaaatgtatcagaagaaaattgaagataccaacaagaaacgaaacttactcttaacttcatttaaaattattaggaaaatatacaaaatatgatacagcactttccgaggaaccagagttgtcagagtcatggtctcatggagcctaattgatttgccaaccaccaaggcaccaacttgttaaattagtagagttcttctcactacgctaactcgctatgtccttaagatcttgactggtctctccgagtggcgacctgctgattcttcgagtagtagttttcgtattggcagtattgtccggccgctgattctgctcaaagaccggccatggccgccggcgtcctcatgacaaaaccgttcatggctgccgcttctgctctagcctgcttgctcgtcatgctgcgctgcttgcctagcgtcgtcgctaccacggtatctttcaactactccaccttcagcaacgcgaagaacatcaccctccagggcagcgcggcgttcgccggcggggggtgcatcgagatcaccaccggaagcaacctgccgagcagcggcaccatgggacgcgtggcgtacacgccgccggtgcagctctgggacgccgccaccggcgaggttgccagcttcaccacgcgcttctccttcaacatcactccgacgaatttggacaacaagggcgacgggatggccttcttcctcgtcggctacccgtcaaggatgccggacaagggcgacggtggcgccctcggcctcaccagccggtactttgacaccgtccagcccggcgagaaccggttcgtcgccgtcgaattcgacacttatctaaaccgcgacttcgaccccaacgcaacctacgaccacatcggcatcgacgtcaactccatcagatcggtgcagaccgagtcgctgcccagcttcagcctcaccgggaacatgaccgccattgtcgactacaacagcagctcgagcatcctgtcggcccagctggtgaagacatggacgaatggctcgactacactttacaaccttagcaccaccgtcgatctcaagagcgccttgccggagaaggtctccgtcggcatcttggcggcgacgggcttatcccttgagctccatcagctgcattcttggtacttcaactcctcgttccagcagaatccaccaccggcggtgcaacattccccgaccacctcaggttccggacttgccggagttatagctggagccaccgttggtgcagcactgttcgtcgtgctcctctttgccatggtagttgtccttgtgcggcgacgtcggagcaagaagagaagggaggtagaagaggcagaggaggcgagacacgtagggttggccagagatgacgatgatgacgatgacggtgagcccatcgtggagatcgagatgggcatggggccaaggcaaatcccataccaagacctcatcgaggcgacgaacagctttgcggcggaggagaagcttgggcaaggcggcttcggtgccgtgtacaggggatacctgagagagcagggcctcgccgtcgccattaagaggtttgctaaggattcctccaagcaagggaagaaagagtataggtcggagatcaaggtgataagccggttgcgccaccgcaatctggtgcagctcattggctggtgccatggccgcgacgagctcctactcatctatgaactcgtccccaaccgcagcctcgacattcacctccatggcaatggcaccttcctaacatggccgatgaggttagtacctgttctctttaacttcatctaaacttcctttgtgatgttaaattaattggcgtgttaaactcagctaacttggtcttaacttgtcacagggttaagattgttcttgggcttggatcagcactattctatctccatgaggagtgggaacagtgtgtcgtgcaccgtgacatcaagccgagcaatgtcatgctggatgagtaattcaatgccaagctaggcgacttcgggcttgcaaggttcatcgaccatgccgtggggatgcagacgatgaccgccgtctctgggacaccaggctatgttgatcctgaatgcgtgatcaccggtagagcaagcttagagtctgatgtttatagcttcggcattgtcttattggaagtggcatgcggaaggaggccaatgagcctacaagataaccagaagaatggcatcttccggttggtcgagtgggcctgggacctgtacggacaaggagatgttgtctcagcggctgatgagcggctcaacggtgattacgacgtgtcagagatggagcgtgtcatcgttgtggggctttggtgtgcgcatccagacccaagcgcatgaccatctatccgagcagccatggccatgctccagtctagtgggcaattaccggtgttacctgctaagatgcctgtgccaacatatgcgccgccagtggcctcagtggaggggctcttcacatcgtccactggaatgtcgtcctcaagtgcagcacaatcatcatcgacgaccagtggctacatcactcacacctcgagttcctctaacacatccacttcagctggttcaaaggactcgtcttcgttgctcaaacatcaatacttatgatgttcaattcatttgctttgttactaattttgacttgatgcttgaatgggatgtacaactcgtgagccattgattttccatttagagtagtctaattgccaatgtgagtaatgcatgtgcatttatgccatgatttaaattttactcccattttagtttttctagatagatttatcctgccattttctcttcaatgtctgactactataaagtgcataccttgcatgttttaagtgaatatcctagtccttagagggctgaattgtcgaagttggaagaactttaaaatgaaaaaaaaaaccaccaagagaagagaactcttacatacttcacatagtttgcatgttttcacttttcagtgaataacgcaaaggtgtaaacaacatgaactaaatataataagctaaattcaatagagatggaacatggcctctacagactatagacaatagtacaaagactgcttattttcagtagttcttatgcaattgtctcaaatcgtggatatttatgttggatacttcggtggtggaatcaagaacatccaagcaaaattgttaacactacaaaatagtaccagcatagtagttcactcactatgacctgtagattttcagctggttgttttgccctgtttttcagcttttcaaccaaaaggttgttctccccaaatcttaacgaaaattcgggcagcgctctttgtcagcctggcaaaacaaataataataaattagacattcatgcaagaaacatgtcatccaggattgacaactctgctacctcacggatcgatcaagtcaaatttggaaataaaagagttggttatgataggttcagcaatgggtttgctgctgcaaaattctcaacagaatctgatagaacaacccattggaccctactccttccagaagaaaggaaagatctggaaacattatatgatggcacagtagctagtgacccattctctttcacattatgtccttagccatgatcaaacgcgcttggtcaaaccaaccagtaccaggatgattgacagaagagtaacgagaacgaattttgacaaagagaaacagctccagtgatttacgcattcgaaattaaaaactacaatagttacagcaatttttcatctataaaagtccatgcatagcctcttttgaatgtccaagttagctattcaacattgatgcaggattgtgcttacctaaaattaagttgaagcccttacattcttttgttgaagggacatcagaaaacgttaagaggctaaactaataaatacgaagatacccaaccttagaggaaagttagtgttggacaccaaattgggcatttatcacatctaaattatctcacgaaaaaacaatttttttcacattggacaaaacaaaaaaacagcagtactattgtgaccaatcaaccacaagcatttttcacattaagttgaggttatgaggtaacggatgcaaaaccctcatctagtcacctattggaagaggaagctccggtagggacagtcggcggcgatgcactgtcgcagcctagcgtcctccgccgggcggtgcagcatcgtcagagaatccgctctcaccgccggcgtgaagtgcctgacaaggtcccgccattttggaattaggatagttcccttccagacctagctagcagcaacaacacctgcggaggcgggaggcgtggaggagctacaggatacttcgccaaccggaacttgctcatcaccggagatctcggtcggcgcgcggccgacgaccagagctatgcggcagcggcggcgacgcggtagaatacgcttcagttgcggaaagaagaaaaagcttaaaccgaggatggctatagttgggccgtgcaacgtccggataacattttattggggaataagtccaccggaggcgagactttttgagatcccttaaccacaaaaccagaaatgtgtatccctaaactcacacaaaccgtgcactcaaggtcctatggcagtatatatgggtggtttcgctgacgtggcatcctagtcagcaaaaaaaattaaaaaagtacgtggagcccacatgctagctacacatttttttttcttctcttttcttcttcttcttcttcagtaaggaaggccggcgggcggctgccctgcgtggcagtggagcggcgccgagatgcgggcagagcggcaatgagcggcggtgggcgagcagaagagcatgacgacagtgtggccgccgtgcgcgatgttgatgctgttgatgtggtagtagtcggagatggtggacttcatggtggtctcacagaagatgttctcgctgcggcgggcgcccttgccggacttcatgtggaggaggtgcgggcccgccgccgcccatcaccgcttcccccgccgcggcgctcgcctgctgcccgcccatcgccgctccgcccgccgcccgctggcctccctcactgaagaagaagagaagagagaagagagaagagagaaaaaagaagagaagaagaagaaaagataagaaaaaagatgtgcagatgacatgtggcccctacataccttttttaatttttttttgctgactaggattccacgtcagcgaaaccacccatatatactgtcataggaccttgagtgcatggtttgtgtgagtttaggctatatatttctggttttgtggttaagggacctcaaaaaaatctcgctgttaagttgagggacctccggtgaacttattccttttattggactaactcaagtcctaaaatgggcttaggccaaagtttttgaagagcgggggagtatgttgggacccccgtgggggtgggacaagtctattttttgtcggagccatgtagctcggaggcaccgttggatctggcatgggaggatgacgatgcagaggaatggggaaggggagagtgaactggggaggcctcaggtgagcattgctgcctccttcttgtggatgagctaatgtggtaaggttgggatgacggatcggtggtggagctcacggaggaggagcaaggcaacagtgcagctctccgatgatcgcaccagtgttgttgtccccatcttcgttgtgaggatggcatctcatccttgcccacgttggctcgagtgctggccatctcgagctcgctacagagggcggtttcagtgatgtggatatggggaaacaacacacggcatcgctcgagacccctatgtcatgggcctattgggtccactaggttttttgtttttaaaatttttcaactcaatgacatgcgggtcccattaagtttttattctattattttagtgccatgtaggatgaacaattccacatagacacatgtgatcttcgctaccgccgttgtgtcatcgccaccgaagcctcggaactcccgaggccgacattgccatcgacgagctcccaagtgccagatccatgtctttgtcatcactgccgaggtcccaagcgccggatccgacgccgttgtcggcatcgctgccagatgtccctacagctcccgaggccagcactgccagggagctcctgagcgccagattcattgttgttgtcatcgctgccgaggttccgagcgctagatttgcctccgctgagtttctgagcgccggatccgccagttcccaagctcctagctcgcacctgccgtcgccgctgccagaagctcatcaacgcctttgcaagcccgtcaccccgctccggccatagtcatcttcgccggcggatctagagggggagaagtagatgcggagaaaagctaagtgagagagggagagagaaggaaaggagagtggatcggggtaggggaatggttataaagaagagggttggctagaaagttgtttttgcattcaggtctcttaagtggctcgcatttgataatcgatttcttcatgtgggtctcaaccaaatagcatccaaatatttttatatgcggatgttttcttggcccgcttgaaactaagggcccctttgatttggaggaaaaacataggaattttagaggatttcaattttatcggaaaattttctatgaagccctttaaaacaaatgattgaatcctatccaatcctctgaaatttctatagaatggacaatcctatagagattttggaggaaatttagcaagagcttcaacctcttggtaactttcctttgagtctacatctctcattcaattcctacgtttttcctgcggttcattcaaacggtcattcctgtgtttttcctgcgttttgcaatcctctgttttacacttacattcctatcaaaatcttacgttttttctatttctacgttttctcaatcctacgattcaaaggggccctaaatagggggtgcctcaataaaagtcattttcgtagtagtgaacctttccgtcttcaagtgattttctcttcagtttcctaagtaacccagattatcatgtagattcaaaggcacataaattacagaattcagaaaatgaagcagagtagctttaagattctcactagctaaagctgcttcttaaacctccagctctttaaacagagccattgacttggtgctccaagctagagctcagcatttcggtcttcagtcccatatgaccaacaaacaatcgatcgttgactcaacgcaatctcttctgaccccgacggtcgaaaactatggccggagcacagaaagaagtaattcaatgccaatttggcacaattaatacaagtggaagaacaaatattaccaataaatcaacggcaagattgtgttacaattccttgttagaccgagccggcttctcgagtctctgtttgctagtggtggctggcaccagctgctcgagtgatatcgtggacatcagttgaacaggctaatgggtagtagaggtgatccatccacctgtgtattaattactaaaaccattggattgttacccattttatcctttatttaatgagaaagttcttgaccatttatgtcaaaacgaagtccatgacgaacattattaaataaaaagagattaattatgtggcatcacttgtagtgttgctgttaggctcattgttttgtgagtagcaattcttgttaccatttcttcaaactagttttgatgtcacatgagaatgatattgccaatttatttaagttttaatttttttactatcatccttcagtagcaccactaccaccatatagttgttttgtgatacatctcggtctctcaactcttagaggcatgtggcaatgtttcttgaatgttatcgaaaaagttaagaaaaacaaaagctgacaacgtagattaggtttctatcaataacacacaaaaaaaagcagaccataaaaaatacaattggatttggattcacgcactaagggcaaaacaacatcggtggaagggagaggaggaggacgcgacaaagagccactagcaggttcgccaaagattcctccaagcaagggaagaaagagtatatgtcggagatcaaggtgataagccggttgtgctaccacaatctagtgcagctcatcgggtggtgccatggccgcgacgagctcctactcgtctacgaactcgtccccaaccgcagcctcgacatccagctccatggcaatggcaccttcctgacatggccaatgaggttagtaactgtcctctctaacttcatctcaacttcctttgtgatgttaaattaatcggtgtattaactcagctaagatggttttaacttgtcacagggttaagattgttcttgggcttggatcagcactgttcaatctccatgaggagtgggaacattgcgttgtgcatcgcgacatcaagccgagcaatgtcatactggatgagtctttcaatgccaagctaggcgacttcgggcttgcaaggttcatcgaccatgccatggggatgcagacgatgaccgccgtctttgggacaccaggctatgctgatcctgaatgcgtgatcaccggtagagcaacctcagagtctgatgtttatagctttggctttgtcctattggaagtggcatgcggaaggaggccaatgagcctacaagataaccaaaagaatggcatcttctggttggtcgagtgggcatgggacctgtatggacaaggagatgttgtctcagcggctgatgagcggctcaacggtggttacgacgtgtcggagttggagcatgtcatcattgtggggctttggtgtgtgcatccagacccaagcgcacgaccatctatcagaaccgccatggccatgttccagtctagtgggcaactactggtgttacctgctaagatgcttgtgccaacatatttttagataatagaatttaacattccgacctttgcttaaaaagagctacaaccaattattacaaagtagcactctagaaaagagtgtaggggaggggctcagtggaggggctcttcacatcgtccactaggcgctgccggtgaccttagtggaggggctcttcacatcatccactagaatgtcgtcctcaagtacatgcaacacaatcatcatcaacgaccagtggctacatcactcacacctcgagttcttataacacatccacttcagctggttcaaaggactcgtcttcgttgctcaaacatcaatacttatgatgttcaattcatttgatttgttactaattttgacttgatgcttgaatggatgtacaacgcatgaaccattgattttccttttagagtagtctaattgccaacgtgagtaatgtatgtgcatttatgccatgatttaaattttactcctattttagtttttctagacagatccattgacttggtgctccaaactagagctcagcactttggtcttcggttccatatgaccaacaacacaaaaatagcaactcgtattgataacaatcgatcgttgactcaacgcaatctcttctgaccccgacggtcgaaaactatggccggaatacagaagaagcaaatcaatgctaatttggcacaattactatacgtggaagaactaaataatactccctccttccctaaattttgacgttgttgatttttttaaatatgtttgaccgttcatcttattcaaaaacttttgtgaaatatgtaaaactatatgtatacataaaaatatatttaacaataaatcaaatcataggaaaagaattaataattacttaaattttttgaataagacgaacgatcaaacatactacctatatattttaatgtatgacaccgttgactttttaaccaacgtttgaccattcgtcttattcaaaaaatttatgtaatcatcatttattttactgtgacttgatttatcatcacatattctttaagcatgacctaaatattttatatttgcataaaaattttgaataagacgaatggtcaaatgttattcgaaaagtcaatggcgtcatacattaaaatacggagggagtatttaaaaaagtaaacggcgtcaaacattttgagatggatggagtataaccaataaatgaatggcaagcgtgtgctacaattctttgttagacgagccggccgtcttctcgagtctctgtgtgctagtggtggcatcagctgctcgagtgagttatcgtggacatcagctaaataggggtgatctgtccacctgtgtattaataattaaaaccattggattgttacccattttaagttcttgaccatttatctcaaaacgaagtacttgacgaaagagagattaattatgtggcatcacttgtagcgttgttgtcagtctcattgtttagtgagtggcaattcttatgaccatttgttcaaactatttttgatgtcacaaggttggagacctatttctggacatcaccttaccgggggaatgagaatgctattgccaatttatttacgtttttaactatcgtgcttgataggcaccactaccacaataacgtttctagcttgaatgtgatcgaaatagttaagaaaaacaaaagctgacaacgtagattcactagaacgggattggatatctctaacgggcttaaagcatcatctctttcgggcagggagcaaaggtcagtaataagaaaatatctcaatcgggcatccggccgtcacggatgacacatctcaatcaagccaacataaaagcccgtcatggatgactctcatctctaacgggcctagattatagcccgtcacggatgactctcatctctaacgggtctagattatagcccgtcacagatgagtataattcaaaaaaaaataaattttgtttttttgttagcctaaggcctttgccctcactagtgtgccttcctggtcggtcaccaatccagactcgtgtgcacccaggatgaattttccagtcggtcacccatcccgtttaacctcacagttctttggagattggcttccgagaaagaaattgtaatttgttggtatgagtattctattaatcctattaagcactgggccaggatgtcacaccctagcatcgcctattcatatacattcattcacataacacaaccacattcacataacatccattttgatcacatatttcaccagcgaatctgagttaattggatcaaatatatatttagcaagtattatcatgagtaggaggcaaatcagacttttaagaaaaaatgaatttcgaattgaattttatgatactaaatgaactcatatgaaaaagctatcaaaaacaaagttgtagaacacattgagatctaccatttttattttggtcatttcaccatccgggtttgattgaactatataaattttgtattttaaaatataagaaattcaaatattttttcgggtagtaaatgatttcaaatggaaaaattgtcaacaacaaagttgtataactcatcaagatctataacttttattttggttatttttctatataacgtctttttaacagtttgaatttgaatttaaaaatatgacaacttcaaataatattttcaaataataaatgatttcaactgaaaaagtcatcaacaacaaagttgtataactcatcaatatctataacttttattttgttcatttttctatacaacatttttttaacagtttgaatttgaatttgaaaatatgacaaactcaaacaacattttcaaatactaaatgatttcaactgaaaaagtcatcaacaacaaagttgtataactcaccaaaatctataacttttattttggtcattttttcatccgacaaagtgatagtaacattgttcacaaaattcacatatctctcatctagttttataaactataatacagatatgtaaattttgtaaacaatcttactaacactttatcggatgaagaaatgttaaaaataaaagttatagatcttgatgagttatacaactttgttgttgatgattttttcagttgaaatcatttagtatttaaaaatgttgtttgaagttgtcatattttcaaatttaaattcaaactgttcaaaaaatgttatatagaaaaatgagcaaaataaaagttatagatcttgatgagttatataactttgttgttgatgaccttttcagttgaaatcattaagtatttgaaaatgttgtttgaagttgtcatattttcaaatttaaattcaaattcaaactgttaaaaatatgttatattgaaaaatgaccaaaataaaagttatctctaacaggcatcaacaaaagcccgacaccgatatgagtcatcggtgacgggctttaaaatcatctcaatcgggccatatttggagcccgtcaccgatgac

SEQ ID NO: 6937 - DNA, 18837 bp, Oryza sativa
  unsure (1)..(18837): unsure at all n locations
acatttatcctaggataatataattatgcggctcgccgtatgatggtctagttttgcgtctctttgtcaagacacactttagcctttgttttgacatatactcttcaaatgaatttctaaaagaagagattgccctaagacctaccaggcaggcctgagggcagtttcatcttttcaaaagttttctcttcccaattgaagaggataggttaaaagaagtggctatatatctaacttttgacagataactatgtaacacctatgtaaattaaaacttgcgttgtaacacaatcggagaggtggagagcatatgccccctagctggcatggcatcacgatttcgacgcctggtcacagagcactccatcaactttttattcctgatcatgcgcacaaatctccaggccaatccaacggaagaaaatttgaaagtttttcctccacttttcttaacatagtaaaatagtaagttcttttggcaaaagaccacaagtccataaaacaaagtgtattttggcaaaagaccacaatcccgtgacaaccgtaaactatagtgccttagaacaaattttgccttaggctataagccaactaactatatctaaatgtggagcagagagatgaaaaaaagtgttagctctcatgtaagagctagctctacacagtacacagctataagataaacacattaaatatataatgagacaaagaaaggataagaaaagcatagataataaaataacttgtctatttatatatgttaggtctaatactattttaagatggacttacttagcttatgactttgtatcataaggaccaaacgagtattacatagcttaatatccacatcatctgcttacctctttgttttgacgtactcttctttcgtcacgtatttacaggctgttaccctagcgcgagcggatccaaatccgtccaaagtcattggttaagttcgatcaccagcgagtaaatagttccatcaacttcgcttgtatcatcgtgattaaactttctcggataagtatgatattttattaaggttgatgtaagcgatacctatatgatatattgattctatttttaactgcatcactatttagagtcgtattggcttagttaggactttctcggtttttatgcaatgtttcatcggagttctagtcgatgagttatcttgttactacttctaaatgttggattggcttatactcaaactcgcataatcactagttaaatctctttntatgaactttacccttatactatttcggnttggtctgatctatcaagattgtttttataaagaacagtttattcataattatgcatagtttagttatggccaattatatcacgaattttatgggttgtctgattattattgtgaatctcaattgagcctatagctgattgatcaaaaccctatcatatcggctggcctagccacatcccattggcttactggctaattggcaccttgatcatcgatctattcaaactaactggcacatccttaactcgattgataggaccggcactggacctaagcagatctctcaggtctttgttgttgggaatagtcccacattgcttatctagggggagttgaaccaacttaaaaatggggggagtccttcacctcttgagctagcttttggggtgtagcaaggctttctcctggttgggccaacgtctcccggttttgggccaacaagtggtatcagagccaaacccacaatctctagtgcttgtgcacactcagggtggtgtaagcccaaagcccagtggaccgcgggtgtgaggcccgtatgtgcctgtgtgtggggccggtcagggctaaagggcaccaatgtgtgaccacaatctctagtgcttgtgcacactcagggtggtgtaagcctaaagcccagtggaccgcgggtgtgaggcccgtatgtgcctgtgtgtggggccggtcagggctaaggggcaccaatgtgtgatgggggagattgttgggaatagtcccacattgcttatctagggggagttgaaccaacttaaaagtggggggaacccttcacctcttgagctagctttttgggtgtagcaagactttctccccgttgggccaacgtctcccagttttgggccaacatttgtgtgtgcaacagttagctagcccatgcatcgtagcggcatgagccaactcatgtgtttgaacccccccccctccccccaaagcgcatgatgcaattttttttaaaaaagaattagcaaatccttaaaataatagctaaagtgtgttttgacaaatgatcacaatcaaataaggagtgttatctctcattcaaaaggtagctctacaaatatataggatgaatgcattaaatacataactgagacaaagagagaataagaaaagtagagacttgtctgttacgtactcccttcgtcccaaaataagccaatctcgaactatatatatgtctagattcagtatagtccgatatatgtactttgaggttggcttattttggaatggaggaggtatgttagatctaatgctatttttagatgaacttagttagcttatgactttgtatcataccacatcatctgcttacctgtgttttgtcgtactcttcttttgtcatgtatttactggctggcgcaagcgcgggtccaatccgtccaaaggtaaaaatggcggggggctgatcggttactttaaatccgtactccagactgcattgtcacgtaggaaggctcccgagcattgtctctcatttctccccagctagtcacgccgatcagtactggtagtctatcactagctagctatatcgttgtcacccttgcgcgccgatcgacgccggcggtgatggccggcttttctttgatcagttgcgctgtgggtatcatcttcttctccgtttgctacctgcctgcggctcctgccgccgccttgtccttcaactactccaccttcagctcggacaaccaggaggacttcacattcgaaggcaacgcctccatccacgacgggtgtattgatttcgttgcgaacgggacctggggcaggggctacaggccctacagcaccggacgggtgtcctacaaattgccggtgcggctctgggacgctgccaccggcgaggtggccagcttcaccacaaccttctccttcaacatcacgccgatgaatattagcgacaagggcgatggcatggccttctttctcgtcagctatccatcaaggatgccgctgaccgccgacggcgacactctcggcctcgtgagcaacaaacccgaaaacgctccggccggcggcgaccaattcgtcgccgtcgagtttgacacctacccaaaccccggcttggaccctaacgctaccggtgaccacatcggcatcgacatcaactcagtccgatcgttgacgaccgaacccttgaccaactccagcctcatcggtaacatgaccgccatcgtccactacgatagcagttcgagcatcctgtcggtgaagctgtggataaatgacacgacgaagccgccttacaaccttagctacgaaattgttgatctcaagaaaaaattgccggagaacgtcaccatcggcttctcggcggcaacgggcgcatcagatgagctacaccagctgacttcttggtacttcaactcgagctcgtcgttcgagcataagcatggacgtgccggggttgtagcgggagccaccgtcggcgcgacgttgttcgttgtgctgctcttcactgctgcagctatcctcatacggcgacgtcggatcaaaaacaggaaggaggcagaggatgagcaggacataagctcggacagcgaagacaatgacggcgagcccatcgtggagattgagatggggactgcgccaaggcgattgccatactatgagctcgtcgaggcgaccaagaacttcgcggtggaggagaagctcgggcaaggcggcttcggttcggtgtaccgaggctacctaagagagcagggcctcgccgtcgccattaaacgcttcgccaaagattcctccaagcaagggaggaaggagtataagtcggagatcaaggtgataagccggctgcgccaccgcaatctcgtgcagctcgtcggctggtgccatggacgcaacgagctcctccttgtctatgagctcgtccccaaccgcagtcttgacgtccatctccatggcaatggcaccttccttacttggccaatgaggttattaattatccgtgctaactttctcatctcaactgcttcgatgagtgtcaaatctaattctatttttatcttgcttaattggttgtttccacaggatcaagattgttctcgggctcggatcagcactactctacctccaccaagagtgggaacaatgtgtcgtgcaccgtgacatcaaaccaagcaacgtcatgttggatgaatccttcagtgccaagctaggtgacttcgggctcgcgaggctcatcgaccacaccatcggtataaagacaatgaccgccatgtcaggaacaccgggctaccttgaccctgaatgtgtgatcaccggtagagcgagtgccgagtcctacgtttacagtttcggcattgtcctactggaggtggcatgcgggaggagaccgatgagcctactagacagccagaataacggcgtcttccgactggttgagtgggcctgggatttgtatggcaagggagatgttctcatggccgccgacaagcgtctcgacggcgactacgattctgcggagatggagcgtgtcatcgctctcgggctctggtgcgtgcaccctgacccaagtgtgcgaccgtctatcagagacgccatggccatactccagtcgagtggaggccaactgccagtgctatcggccaagatgcccgtgccaatgtacgcgccgccgatggcctcgtttgacgggctagctgtttgcgtcatctacagggatgtcgtcgtcctcaggtgtgacgcagtcgtcgtccacatcgacgacgagcggccatgctattcacacctcgtgttcctcggtttcctccgattcaaccggttcgaaggactcgtcttcattgctcaagcatcagtgctagtgtttagtgtttgttttttaatttgcttgttcttagtttagagttgatttggtctttggtgttgcctaattgccgatttgagtaatgtatgtgtatttaggccatgatttgagtaatgtatgtgtacttatgccatgaatcttatggcactgtagtttctctagaaagatctgtccggccattttctgttccagcattagaataagtcgagtgagggacatgggcaacgatagtagctactgcagcagcactacaattgaggcgaatcaaacgatcggcccattacaattgaaggggtggtcgccatcctcctcatgggccattgcctacagaacgaattgggttgggacacagccgctaggaaaagcctgatctacatgcctatccccaatgcattaaatcaactttacatcccttatgtttccatcgagtttaaatcgcatctctgaaccgcaatacaagaagtctagacccacaacttgtaaaactaacttaaattaggttcttcggcgatatagataggtgatttcgctgataaatataaaaaaatgcatacctaactctaaggctataaatagacccctccaagagaacatatattgtaagtgagtttcaataaatatatttactttctttgtgtacacttagaaaccactgtttgtcctcttagacaacaccatgaaaattcagaaaatgtgcaatattgtatttttatcaatcctaatttcagaaaaatcctttatcaagaaaatgttggaattaatggatgggccttagcccactcgaagattaattctttggaaaatcacaaaagctcacctcatgagatggcatgcgtgtggagtttagtaccaccttgcttattttaggagaaggggaccttcttaaaagggaggatgccctcctagccacttgaagcatgtgtggtggagagaagagggggaacacacgcgcgcgctcgctcgccgggcagggcaggcggcgcgcgtgcacgacgtacgcgtcgaatggtccgcaaaattggctcctcacccttgcgcagatgcagcctccttttgcagttttgttttgctgcaagaaaattcggatttgttttgttgtaggaaacattccgaaaaatccggtgcgtgaaaacggcgtggagtccagataagttacgcgcgacttatccggttcggttacgcggagtggagatcgtgcgggcgccctgatcaagcgacctatctctatataaaccgagccgctgccttcacgcaacacacgtgaaatcaatctagggtttgcctcctcctctgtgttgtgccgtcgctcgtagactactccatcccgatcgtcagcgtgcaccggcaatcgggagagcaggtctccggaacctctgccttcgacgtcctgcaccgggagaaggcggcaataaggtttttgggaagcgctccgcgcgactgctctctgtttgttcgcgacggctcgccttcctctccgctcgcgtgctgcacgccttcgtcgacgctcgcaacagcgagtagttcctgccgagcaaccggtctttccgccacctcggtacgtgttcgacatgttgcgcatatttgatctgttcatgttttactgcttagtttacatgtgtagatctaatgatgtgttactgctagtatacatctgcaatgttatgatttatttatggaatatattaaatcattatatgcctatattctcaacaatccaaaaaccttattataggcgctgtgattttactatggctggttttgccgatgcactgaggccggataaattcaccggtgtgcactttaagagatggcagatcagggtcgctttgtggctgacagctatgaaatgcttctgggtgagtactggtaaacctgaaggaattcttgctgctgatcagcataagcaattcgagaaagccactactctctttgtgggatgcattcttagcgttcttggcaatcgtctggtcgaggtgtatatgcacatgaccaacgctaaggagttgtgggatgcactgaatactaaattcggtgctactgatgctagcaatgatctgtacatcatggagcagtttcatgactacaggatggctgacaaccgttctgtagtcgaacaggctcatgaggtacaaaccatggctaaggaactcgaactccttaagtgtgtcttacccgacaaatttgtggccgggtgcattattgcgaaactacctctatcttggagaagtttcggtactgcactcaaatacaagagacaggaatactccgttgaggggttgatagtgtctcttgatgttgaggagaaagctcgggaaaaggacgccgcgtctaagggcgacggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtagccaacctagtcatctggctaggaagtgtccacagcgcaaggggatgaaggcacctgcagggcagacttctaagtctgctaatgtgaccattggcaacactggagatggaagcgggtatggtaatttacctacagttttttcagttaatcaatctactaattagtgggttgatactggggctaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgataggaatcttgttagtggctcccgtctgactagagacggatttaagttggtttttgagtctaataaagtagtcgtgtctaaacatggatattttattggtaaaggttatgagtgcggaggcttgttccgtttttccctttctgatttctgcaataagtctgtgaatcatatttgtggcagtgtggatgatgaggctaatgtatggcactcacgtttatgtcatattaattttggcttgatgtctcggctttccagcatgtgtttaattcctaagttttccattgtcaaaggttctaagtgccatagttgtgtgcaatcaaagcaacctcgcaagcctcacaaggctgctgaggagagaaacttggcacctctagaactcctacattcagatctttgtgaaatgaatggggtgttgacaaagggtggaaaatgatatttcatgacgttgattgatgatgctactagatttttctatgtgtacttgttgaaaacgaaagacgaggctctagactattttaaaacttataaggcagaagttgaaaatcaacttgacagaaagataaaaagacttaggtctgatcgtggtggagagtttttctcaaacgagtttgacttattctgtgaggaacatggcattatacatgagaggacgcctccctattctcccgagtctaatgggattgccgaaaggaataaccgcacactgactgacttggtgaatgccatgttggacaccgcgggactacctaaggcatggtggggggaggcattgttgacctcgaatcatgtgttaaacagagttcctaacagaaataaggacaacaccccatatgagatatggattgggaaaaaaccatcactttcttacttgcgcacatgggggtgcttggcgaaagtcaatgtactaataacgaagaagcgcagacttggacctaagactgtggactgtgtctttctggaatatgctcatcacaacattgcctatagatttttaatagttaaatctgaggtaccagacatgcatgttggtacaattatggagtctcgtgatgctaccttctttgagagttttttcccaatgaaggatacacatagtagttctagccaaccctgtgaaataattcccagttcaatcacaccaccagaacaaactgaacatacacatgaacatgtcactgaggaggatgacagtgaagctcctcgaaggagcaaaagacaaaggacggctaagtcttttggtgatgatttcactgtgtacctcgtggatgacactcctaagtcaatttcagaagtatatgcatctcctgatgcagactactggaaggaggctgtccgtagtgaaatggattccattatcgctaatggaacttgggaggtgacagagcgaccctatgggtgtaaacctgtggggtgcaagtgggtgttcaaaaagaagctgaggcctgatggtaccattgaaaagtacaaggctcggcttgttgctaagggctatacttagaaagaaggcgaagatttctttgacacttactcacctgttgtcagattgaccacaattcgtgtgctactttccctagcagcctcacatggtcttctcgttcatcaaatggacgttaagacaacttttcttaatggagagctggatgaggagatctatatggatcaacctgataggtttgtagttgaaggtcaagaagacaaggtgtgcaaattgttgaagtctttgtatggtctgaaacaagctcctaagcaatgccatgagaaatttgatagaacattgacatctgtaggcttcgcagtcaatgaggcagataaatgtgtatactatcgccatggtgggggtgaaggagttattctgtgcttgtatgttgatgacatactgatatttgggacaaactttgaggtgataaatgaggttaaatcattcttgtctcaaaaatttgatatgaaggatttgggagtagctgatgttatcctaaacattaagctaattagaggtgagaatgggattacactcttgcagtcccattatgtggagaagatcttgaatcgttttggctacattgacagtaagccttctccaatatcttatgatcctagcttgttgcttcgcaagaacaagagaattgctaggaatcaattggaatactcccaaatcattggctcgctgatgtacctggctagtgcaactagcctgatatctcctttgctgtgagcaagttgagccggtttacctctaatccaggagatgatcactggcgtgcgcttgagcgagtaatgcgctatctgaaacgtactatggaattggggcttcactattctgggtatcctgcggtactggaaggatatagtgattctaactggatctctgatgtggatgagatcaaagccactagtggatatgtcttcacactaggtggtggtgctgtttcgtggaggtcttgcaagcagaccattttgacgaggtcaaccatggaagcagagctgacgtgtcacaccctgaaaattcaaaatttataaattgttgtttaattggaatttttagaaataattttaaaagcctagaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaaccgctctctctctctccctcggcccaagccggcccagtccgtccgcgcgcgcgccctcgctgccgctgacaggtggggcccacctgtcaggcccgtcgtcttcctccggccgaaaccctagcgcgccgccgccgccgccgctttccaatccggccgttcctttccttctccggtcgaattgattgaggggaaacaatctccgggatctcctctaccttttctcctttggaatctttggctaaatcgttttggaaagcgttggattcgagtttgtctcggattcattcttcccgatctttccttcctcgtcgtcggccgccgtgggcctttgccgccgcctccgagcccctttaaaagcctccccggtgtctcctctacccgccgccacccttgccttcgcctctcgtcgtctgaatcgttctagcgccgtgtgccctagctttgccgtcgccgccgccgctccagccgtgcgccgccgttgtttcagccatcgccgtcgctcgggaagaccgccgtcgtggtcgccaagtcgtcgccgtcctcgtccgccccttcgctgtcgccggagatcgccggagcttcatcgccgccgtcgacccgaaggtttcctccgtttcctcctcgtcgccgtcgccgtccgttgatcttccgccgccgttttggtcaccggtgagttcgccgtgtcgtcctctacgtgctggtggcctccgtttgcgtcctagtgccgccgttcgccggcgagcgtgcgccgcccgagctgtccgctccgccgagcccccgccgctgtcggtgacgtcattgccgacgtcatcggggtcgtccgccgtgagccggtcgtggaccgttcgatctcggccgtccgttttggattggatcgatctcggccgtccgtccgcgtgaaccgccgcccgtgcgcccggtccaccgaaaccctagcccgctgacgcaataaaccttcttttccttttcaaaaataattcattattgcgtcataattcaatttaaaccgatataagtgtccttttcaaaaatatccacatgtactgttcatgcttatttatgtgttgttttggtgattttgctcttttctgtttagattccgtcgtttcccggagagtccgttttcgcccggagaagaaatttgaagagttccaaggccagcaaggcaagtcacacatatcccaaacaaccctttgagcatgttgatcctatttaaagctattgtttcttttcaactattgcatttattttcgaatgtcattgggtggaattaacctattgtttgttatagcccttttgttcttgattactttattccttgataccttgggttataataatttgactggttgaactttatttatattggttcaactagatattagaaataattgcttagccctgcttagaaacattagcacactattgggataactcatgattcactattatttcgtgatggcttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcatgggcaacggctttatcttttgtatagcatagttcattgcggggcaccagactgagaagtggcggagataagcccacgggggtcgctggggagtccatgccttgtttataaggggtgattatgatctaggaaggtgcactgcagtggattgtgttgtatgcggggtattgtcacaactcctttccgaggtatcgtggtggtattgaggcacatggtgacatgatgtggggttgtgtcttgtgggtacagtggtacacctctgatcagagtaaaactattcgaatagccgtgcccgcggttatgggcgggtctaacaatgtctttcatgattagtttcacacttctcaccatagtaaatgatgctttaactggtaataatttgattagctcctggtttggaatggtatattcctggtttggagatagaactgtgcagccgggatggttgttcagaatggttgggcctatacaacagggtatgttgtatagcgttggattaatattgttttattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggagtagccttggtcaagctgcctgtggagtggagccgtctgcgccgtttatttcattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacatgacggcactggatactgctactgttgaggcagaatggctgcgtgatcttttaatggatctgcctattgttaaaaaaccggtgccggctatccttatgaactgtgacaatcaaacggtaattgtcaaagtgaatagttctaaggataatatgaaatcgtctagaaccgtgaaaagacgattgaagtctgtcaggaaattgagaaactccggggttataacgttggattacatccaaacagctagaaacctggcagatcccttcacgaagggactatcacgaaatgtggagtccagataagttacgcgcgacttatccggttcggttacgcggagtggagatcgtgcgggcgccctgatcaagcgacctatctctatataaaccgagccgccgccttcacgcaacacacgtgaaatcaatctagggtttgcctcctcctctgtgttgcaccgtcgctcgtagactactccatcccgatcgtcagcgtgcaccggcgatcgggagagcaggtctctggaacctctgccttcgacgtcctgcaccaggagaaggcggcaataaggtttttgggaagcgctccgcgcgactgctctctgtttgttcgcgacggctcgccttcctctccactcgcgtgctgcgcgccttcatcgacgctcgcaacagcgagtagttcctgccgagcaaccggtctttccgccacctcggtacgtgttcgacatgttgcgcatatttgatctgttcatgttttactgcttagtttacatgtgtaaatctaatgatgcgttactgctagtatacatctgcaacgttatgatttatttatggaatatattaaatcattatatgcctatattctcaacagaaaaatactaaaaaagtaagacatcataacaagtacaactcagtattattaatttaaagctttatattatttaaaaacaacattatattcagtaatttcgaagtgtatattaacttaaggaaatactagaaagaaagtaagggattaaaagtattagattttattctgtatacctatgatattgtaattaccaatttcaaaaattcaaaactatcggtttcattcttaagcacttaaaagcaaagtataaacacttatgcagaacatacatataatactgttgcaaatatatgtactaaccagtgggtttagttaaggccttgtttagttcccaatttttttccctatagaatagctaatatggtccctaaaatttcgttcctgggtcattttagtccttaatcttttatattattcaaacaagtcctttaaatttgtcacgtgggctgatatagtcctcggtcccacaaaaaattgccacatggacataccatgttaccctcctatgcaaaatctgtatgatttgtccaatttatccttatatatatcataggagaataaaaaaaggaaaaaaagtttatatatatatatatataccccatatatatatatatatatatggggtatatgtaagagaaaaatatacgtcaaaagggtgaaaaaaatggaaaagtatttttttcctatggttatgtctaattcacccttacatttatttttctatgatatacgtaagggtaaattggacaattcatcatagattttgcatgaatgatgacatggcattccatatgatgattttggtggacccaaggattattctaggccttatgacaaagtttaagggtttctttggaccatttaaaaggttagagattaaactgatcttacagagaaactttagggactatagtagctattctccctttttttttcccaaaacatcacattgaatctttggacacatgtatggagcattaaatatagataaaatgaaaaactaattgcacagtttgcatggaaatcgcgagacgaatcttttgagcctaattagtccatgattagccataagtgctatagtaacccacatgtgctaataacggattaattagtattaataaattcatctcgcggtttccaggcgagttatgaaattaatttttttattcttatccaaaacctcttccaatattcagtcaaactttcgatgtggcatccaaaaattttatctatatataacactaacacccagaaagtaaggcaagtggggtaagcgtaagccaaaacaagtcacgtcaaagaacctaagaagcacggcagtaccttcttctgttcatgcagatgcatttatgcatttccaactcgaatgtgtgccactgccagtgccactagcatatatcaaatcaacatattggctcgttcctcgaattcgagacaatcattgtactccaatcgctagaaaacaactttaaacactatttttattataatatatatatatataaacaataacaagtacattttaagactactctctatatatagtcccatatttttaagataaatattttagaaattattatagttgaagattctaaagtttgatctctttcatgtaaaaaacgacaagtattattaccccggatgagtagtataattacttttagagtttaaatttatcttaaaaattatagttatttcttttttttatcttctcatctcaacgaataataacagtctctcattgaatttgtatacctactttctatttttaacaaatcataaacttccaaaatttgtacacctattttctaatttctaccaataaaaaacttccaataatttatttaaaagtatttaagaatacttatattttactactgagagagtagtctgctacccacactacctgcctgaaaataataataataataataaaactgataccaccaccactaccaacatagcccctggtttttaccctcaaattgaaaaacgtggaataacaaggagaatttggtatcattaaattaaggaacaacgtaatttacttacatctccgaacctggtatcgataaattaaaggtggaacattatttttccatgtatttaacccagtaatccgatctaacacatgatcaattaggattactctccgagttaagatctaacgcgaaataactaaagatcatttcctattttgtgagaaattcccaacacaatctttcttttagaattacacagtacaacgcagacactcacaacgcacacgtactcacccatataaacatacgcacgcaaaccctacccctatgagcatcttcgaagactggccggcaaattctggagagattgacgaagtcaccacaggcgcctcgctgtcgacgggtacgtcgcctaccactgaaagcacaacgccgttaaatcctagaaaattcgctcccacggggagtcgaacccaggacctcaggtgctactgagactcttgtaaccattaggctacatgccctttcgcaatcttatttatactagcaacatatactacttatattgtacctaaaagtccccttttttatacattgtttagctatagtcctcctaggctgttcctttcccaactttctcaacttctactctttcgtttttcatacgcacgcttttctaaactgctaaacggtgtgtgtttttgcaaaagttttctatagaaaagttacattaaaaaattatattaattcatttttcaagtttttaagactaatacttaattaatcacgcgctaatggaatacaaccctattatccgtggaactccacctcccgaacgtagccctagtcaactatgcaaaataccatcaagattttagatcttctgtctatggatatttgatcaagaggagcaggtaaattttatacatttttttataagattaggtgaaaaacgacgaaaaaattgcaatcaatccgcaggcctaggccaatgacgtccaaagcttcacctttttttttatatataaaccagcttgatgtatatataaaaaaaggattttatcattcttgaaaatgtatcagaagaaaaagtgaagataccaacaagaaacggaacttacgcttaacttcgtcatttaaaattattaggaaaatagacaaaatatgatacatttcagcaccttccgaggagccagagctgtcagagtcatggtctcatggagcctagttgatttgccaagcaccaacttgttaaattagcagagggagatctcgactggtctctctgagtggcgactggccacctgctgatttgaatactactagtagttttccgtttttggcattggcagtattgtccggccgctgattctgctcacagaccggccatggccgccggcgtcctcatgacaaaaccgttcatggctgctgcggctgctgctctagtcagcttgctcgtcatgctgcgctgcttgcctagcgtcgtcgctaccactgtatctttcaactactccagcttcagcaacgcgagcaagaacatcaccctccagggcagcgcggcgctcgccggcgccgaatggatcgagctcaccaaaggcaaagggaacaacctgtcgagcggcggcaccatgggccggatggtgtacacgccgccggtgcagctatgggacgccgccaccggcgaggttgccagcttcaccacgcgcttctccttcaacatcaccccgaaaaacaagagcaacaagggcgacgggatgaccttcttcctcgtcagctacccgtcgaggatgccgtacatgggctacggcggcgccctcggcctcaccagccagaccttcgacaacgccaccgccggcgaccggttcgtcgccgtcgagttcgacacctacaacaactccttcctagaccccgacgccacctacgaccacatcggcatcgacgtcaacgccctccggtcagtgaagaccgaatccctgcctagctacatcctcatcggcaacatgaccgccatcgtcgactacaacagcaattcgagcatcatgtcggtgaagctatgggcaaatggctcaacgacgccttacaacctcagctccaaggttgatctcaagagcgccttgccggagaaggtcgccgttggcttctcggcggcgacgggttcatcctttgagcagcatcagctgcgttcttggtacttcaacttgacgttggagcagaagcagccaacaggacaacattcgcgtggcggagttgtagcgggagccaccgtcggtgcaattctgttcatcgtgctcctcttcaccatggtagcaatcctcgtacgacgacgtcagagaaagaagatgagggaggaagaggaggacgactcggaaggcgatcccatcgtggagatcgagatggggacggggccgaggcggttcccgtaccacatacttgtcaacgcgacaaagagctttgcggcggaggagaagcttgggcaaggcggtttcggcgcggtgtaccgtggcaatctgagagagctcggcctagacgttgccataaagaggttcgccaaagactcctccaagcaagggaggaaggagtacaagtcggagatcaaggtgataagtcggctgcgtcaccgtaatctcgtgcagctcatcggctggtgccacggccgtaacgagctcct

SEQ ID NO: 6938 - DNA, 1045 bp, Oryza sativa
tagctatgaatctggattttgggacggaggtagtatatcagaatctatttttttccaatgtgcaatcaacaaatgtcaattgaaattcaactgatcaactagcttggatattatcataggatcaacattgttcttgggcttgggaatgctctgctctacctccatgaggagtgggagcaatgtgtcgtgcaccgtgacatcaaaccgagcaacatcatgctggatgaatctttcaatgcaaagttaggcgactttggtcttgcaaggcttattgaccataacgttggggtacaaacaatgacccacccctcagggacgccaggctatcttgatcctgaatgtgtgatcacaggtaaagcaagcgctgagtctgatgtctatagttttggcgttgttttgttggaagtggcatgtgggaggagaccaatgagcctactggacaaccagaacaatagcctcttccgactggtggaatgggtctgggacctatatggccagggagtcgttctcaaggcagcagacgagcggctcaacaatgactatgatgcaaccagcatggagtgtgtcatggctgttgggctctggtgtgcgcatccggaccgatacgcacgtccatctatcagagctgccatgacggtcctccaatccaatggaccactaccagtgttaccatctaagatgcccgtgccaatatatgcaccgccgatggcctcgtcagaggggcaactttcatcatcgacaggaatgtcatcctcaagtttgacaataacatcaattacacctcgctagggtggcaagttttctcactcataggatatgtatagcaagacaacttttgtcatatctagatttttatccatacccacaagtcgaactacctgcatccctacacctcagttcctttcgcatactttagccggtttgaagggctcatcttcgttaattgctccgtacagtagtattagccatgtttggttcattttacatgttgtacatttacaaattgccgcttgaataggatgtacagctcgtgaggcaattggtt

SEQ ID NO: 6939 - DNA, 15196 bp, Oryza sativa
gtcagatttaagacataagagattcatgcagcaagcatatcgtccaagattgacatctctgctacttcacagagtgatcaagccaaaatttgaaagagaagagagttggttctgatagggtcagcagtggctttactgctgcaatttcctcaacaaaatctgataggcttttacggtgtttgcattccaaaaaaaggtatagatccaacgctccataatcataggtatcatgtaaaaggtatttaaccattggtattggtgcttaagtactaagggtaaaaatataattttactagtagagaaaaagggtagaattgtctcccaaattagaatcggtaccgcgtaggtactaccatacgaagttaacatttcccctttaccagctttacaggttattatttgcgtattttctcttttgcatggttttatctagatttacgttgtgtttgagttaagtcatttagccagcactagcattacaggttcttaagttgcatcattttatctagagttactccgttctttgatgttctcatttacgtggttttctctatatttatgttgtgttcttataacctgtacatgtcaatcagatcttgcctcctgttcaaatgctcgaccatgccagatcttcttcctcgaccgtgtctcctcatgggtgcgcccgttcgaacactagaaaaacaccataggaggagatctcgtttactatcccacaaaaattccagtcccttatataaggagtttatgaactacatgaataactaatcaactatgtgaataagcataggataactttcagatgcgctagattgagcctagtcatcgaccgggctatcgcattgtcgacgtttgatgtctcgactacggtgtttgggcaatatggagatcgtcggtgctagggtatacgcaagactgaggtaaaagagatggagacagggatttttatacaggttcgggcccctgagctatcaggtaatagccctacatcctgttggccggagccgatgttgctttttattcatgataatcacaccagtacatggtttgggtagcccatctaactgttgtcgacatggcgttctgcgattttgactcgtagtgaccaacagggtagccttcttcctggaatccgtgccggcgagatcagagatagtgctttcgtctctccttacagtatccggagacacggtagggtactagcggtgtttatccctgaagtcgatatccggcgggcgtgtcttagcgtatgtaggcttctatgttgtggcttctatgtcgattgtgttaggtgttgatcccttcatggtgggtgtatgttgattgtgttggttctccctggcgggtgtccccctgtcctcctaggggggcttgtatttatacccataggtgtccccttgtccaagtagaactagggaaaccaatatggatacaatccgagtagtccttgtcgtttccatgtagaactctggttatctttccttattcagaactccctcgaggttagtttccatataagacatggtatgtggtggatcctgccgagatttagtcaactactattaggtatgtggtatccataaccctgacacgcatctcctcaaccctcaaccatgcagacgcttttttctctgtctccttctagtgaatgttcaaaccctagaacaagaacgaagcgaaaggagagaagaatggagatgcgatctttctgtttattttggtacagatcgaattgatcgctgctaaatcaacagtgtatctgtgatttactttttttcctcacgacgtatcaatctgcataatgatatactgatcgatggatataggtattcaattcacgtataatgcccatgttttactagttaattacgtcatcatattataataactaggaagaaagcccgcgcagatgcgcgggcagttttatgaagacaattttttaaaaaggttatatctcaccatttataagccgagaaatatattgcatactttaatatatttaagtaataaggttatctcctagattaaataaaatcactttgcctctggttacatataaattttcttgttgtcacttcaacctattatcactgtttaaaagccaagtacctattcatagatgaactacgtaatgtatcaataaaataagcctaatatatcattaatacattgaaatatccactacacgtaagtgtttcgtgcctcaccaattttcaaaactatatataaatattgtaaaaataccacttgtacaaattaatagaataacatcaagttatatataaatgcttctctaatgcgtgaagccgattgcagtggcgagactttctttgtccgttgccttgaaacataggtcccatatcgatgtagttgtgcacctccagactaacctggagcacaattttaatgcctaatttactatcacacccttatcgagttgtgcatcggtaagtagtaagttgagcactattggtgactgtggtctccactgggaccgccttaactcccatatgtacatccctgttatacttatagcaacgtagcaaactatgttattcatgcttatgcccttcatgaaaggaaaaagagaagatggaggtgatcaaaagaatgttttttttatgttttgagagtagattcatggtatagagtaggcaccacgtgtttatggtgttaaacattatgcaatttgaaaatgagcgaagttgtaatttgacggtactaaaagagaagatggaggtgatcaaaagaattttttttttaagttttgagtagattcctggtatagagtagacaccatgtgtgtttatggtgttaaatatttatattttgacaaacatctatagtttagcgcttggtttattttcaatacttattgttgataatgacatgagacacctttactaattcgaagaatatatttattttttttaaatttattaataataactaatgcgtgggagtatatgggagttttttattttttttgtatgatactatatacgtatattttttttggttctatctttttttgacacgatggctttattcttttaccgtacgtatgtaggttttattgttccttttcaatcttacgtacttactttttttttggcgaacctattctctctcgtatgtataggtggaaagtattagtattagagatatatatctaatctaatgatctaaataacggatccatcaatttaagtgaaaatcaacggtatagatatagatataatctaatggtctaaaataacgggtccaccaatttaaatgaaaatcgacggtgagattaaacagtgccacgtggcggtttaggagcgtttataagaatgccacgtgtcgtcttgagagtgtttgtaggacgtttaatggacttttagtatataatagatagatagatatattttgttccctaccttgcccctctcttgattaacggtacacattattccatctccaggtacctctaagtacctcgcaaacggtgtaaaaagtctcgaaaagtaattgaaagctcatactgtcagtagagagttcactgtctttttcaacacggtgacggtcgtgcgtgtatgctgcaggctggaactcaggacttaattcggtcttcgatcggttgtactagatgacatcaaagctcaaatttgcggagactctttactccacggccaaaggggagtctttaaagtctttctgcgatccggatcgaattcggatcctctgcggtggaggagaaaattcagaggttgctacagtacccagcattaggagtactgtgggccgtccgatcaagaacggacggatcagaccgttcgctacagtaaaacagtgcattgatgcacagtactttcatccctgtagatacagtaaatcatcactgtagcggtactgttctgtgcattgaaacactgtccccctcacatatcactgtggccacagtgcctctctgcggtaatgcagaggatccgaatccatccggatcactctccatcgatcgatcagtggagttggcacaatatagtttcagataagctgggccattgactgacctctgggctcttgttctgcgtcaaacgactgcatgaggcaaccctgaatatctctcaagtctgaacattacgatttacttacaattatgcatgtttctccgtctctccgatggatcatggagattgtagcagcatcgttaattttggggtattgttcttttcagctcggcatggacaattattgtagtccagctaggaaccgacgctgataaaccgacaattattagttaagtcatcgcaatgatcatttccggtgcgcaatccttttccgtattaaaaaaaaaaatccttccaagttccgacccctgcgaaccaacaagtacagaacaagcaattcaataccaatttggcacagttaaaccatacggaagaactaatagcatttatatgccgtgttaacaccagctgtgttacaatgccttgttagaccaaactgtgttgagtctctctgtgctgctcattgtacttgaggaaaaggtctttattttcttacgtcccttgagttaatccctctcattagagaaatgaaaacgaattatgaaacattaatttcacacctgtcaatccccatctcatgtggattaatcgagcaatgtctttaatgagatgacactcgttttcttacatgccatcaaatagttgtaaaattgtttttataaaaaaatatcataatgcgatatatttgttggattctaccttttcagattgaaaaacaacaaattttgtttcatcttgcatatttgtaaaatgatatcacacatttatctatgttgttgaatcttttaaagatttttctatgaatattgagacaacatatataaaagagtaaaatacacggccggtccttaaagttgagcgcgggtgtcacttaggtccataatcttgtaaattgcacatctaggtccaccatcttgtttaagtgactcattgaggtctaaaagacctctgaccaggttgactggcttacgtggcggtgcagcgtggcaacatatttgcattttgccccctttttgattccccgtgtccgatccaatcccttctttgcgtggcgcacgcaggaacgcgccgacggcaacgtgcgccagcacgcacacctgtggcacccacctgtctcaaccacgctgcgcccgctgacgtgcctcgtacccctctggcagccgctcgccggtgttgcgcagcgcccagagaaaccgcacaccgtcgtcgacgggaaggagaaggagcaggggaaggggaaggcccccgctctagccagccgtgggtgcacgcgacaagtggctgcggcagctgctcaagtcaagcttgccctgccgccatggagctcgcacccgcccagctcgcgccgaactcgccgacgcctcacccacacacgcggccgcggtaggcgacccctcctcccaggcgtggccggcgacacctcccccgcgcgcgccaagctcaccgacgcctctagcaccaacgaccagcgggaagggagaccgatggatctggctgtcagtgaggcgtgagcgccaccggcacgctagctacgaagactgtcacaccctgaaaattcaaaatatataaattgttgtttaattggaatttttagaaataattttaaaaagtcttgaaaagaagatctaatttttaattaataaatttcaatataaaatgggcccagataaaatttccttaaatactttgcttaattctataattcctagatttttctgggatttatttgagctaagaaagtatttttaataaatggaattgcatttaagaaataatttaaattgaaaaaaggttttaaaaagtcttcttttggctttgggccgaaagtcggcccaaaacctctcttctctctcctcggcccagccggcccagtccgccgcagccgcgcgcgccctcgctgtcgctgacaggtggggcccacctgtcagtcgtcgtctacctttggccgccgccgccgaaaccctagtttcgcgccgccgccgtttccttccaaatccggccgcccctttccttctccggccgaatcaatagaggggaaacaatctccgggatctcctctaccttttctcctttggaatcttcggctaaatcggtttggaatgagttggattcgagttcgtctcggattcgttcttcccgatctttccttcctcgtcgccggtcgccgtgggccttcgccgccgcctccgagcccctttaaaaggacccccggtgtttcctctacccgtcgccaccttcgccttcgcctctcgtcgtcggaatcactctagcgccgtgtgccctagcttcgccgtctccgccgccgctccagccgtgctccgccgccgttccagacgtcgccgtcgctcgggaagaccgttgtcgtggtcgccaagtcgtcgccgtcctcgtccgccccttcgccgtcgctggagatcgtcggagcttcgtcgcggtcgacaacccgaaggtttccgccgtttcctcctcgtcgccgtcgtcgttcgttgtttttccgccgccgttttggtcaccggtgtgttcgccgcgtcgtcctctacgtgctggtgccctccgtttgcgtcctcgcgccgccgttcgccggcgagcgtgcgccgcccgagccgtccgctccgccgagccgccgccgctgtcggtgacgtcattgctgacgtcatcggggtcgtccgccgtgagccggtcgtggaccgttcgatctcggccgtccgttttggattggatcaatctcggccgtccgttcgcgtgaaccgccacccgtgcgcccggtccaccgaaaccctagccgctgacgcaataatccctcttttccttttcaaaaataattcattattgcgtcataattcaattttaaccgatttaagtgttttaatccgatttaatcttcaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccatcgtttccgaagagtccgttttcgccggagaagagcttgaagagttccaaggccagcaaggcaagtcacacagatcccaaacaaccctttgagcatgttgatcatatttaaagctattgtttcttttcaactattgcatttattttcgaatgtcattgggtggaattaacctattgtttgttatagcccttttgttcttgattactttattccttgataccttgggttataatttgactagttgagctttatttatattggttcaactaaatattagatataattgcttagccctgcttagaaaccttagcacatttatgggataacttatgattcactattatttcatgatggcttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcatgggcaacggctttatcttttgtatagcatggttcgttgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttattttccgctgcttagatctctattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagccccttgaccctaggttatgccaaatggttacccatagaagccctctaaaaatattggaaaaagtagaactgttctcctccctttctcttttaattaaaccaaaataatggcacatgcatttcagcaaaatttcataatctcttttaatggttctcattcaaaatttattccagtgttattattactgtacatctattactgtactaatggctcatttaccagcaaaagttttacaatgttgttttatttaatcttgctgcaataaaataaatttagcatgttgattttataactttccttttatttcttttgaaacctgttattcaaaagcacaaaatttgtaaccttgttttcaactatttcaaattatcttgcaagtttggtttaccttatttacttaccttttactttgattttcaaattttattcaagttaatccaaaaacttgtgctgttaattggatagatgtcttaactctctcctttcacttgtctttagatgccgcgctacaagcctgagtacctgtttggtgttgagggttttgtccaggagttgcgtacgatgtcctttgccattggatttgggactgcccctttttatgcccagattcctcatgatcgtcatgaagagaagtgccgagtcaaagtcaccttaaacagcaatagtgaagatgtcccctcagtgatgttcgaagctggaggaagaaactacatccatgcatgtcaggaagtggcaaggatcgccataggagagctccgtgatcgctacagtgatcagttggccgatactgagtatcgctaccatcctcgtcaaccccagggaagtgaccgtggcagttaccttgagactgaaggaattgagaatgatgctaccacaaggcatttggttgagatgttgtgggctatggatgaaagtcgtgcggagactgtgttagcggctcaagatcgtgaagaccggaatcgtggtaagatttgcaagttagaggacaaggtggatcgtttggagaaggaactcgccgcattgaagggagaagcaccgccgcagaaggccaggattcgtctcaccgcaaggaagagagctctatttgtccctcgctatcaattggcgccaaaggttcgtgtggtggagaaagaagttgccccagctcaagcggatcctccggtcatcatcataagtgatgaagaagaagaatccaagcgcacccgttccaagattgagtgggtagcaactcaagatgatgaagacgagccgaacgagcctacaatcgacctccgatgcttggaagaactagagtgacttgttaagtcgttgtcttagatcgttgtgttagtttgcttgctttaagtttgcttgtgtgtgtctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctatcctaagtagttccccggtttctcttcttgtgccctgttcctgccagatggtgaatactcgcagcaacgggaatggtcccaacaaccccaataacaataacaatggagagaacccaactctggcccaagttcttcctcaacagacacagcttatgaacatgatgatgcagcaattccagaatcagcagaaccaaggaaataaccatgtacctccccagaataagttagcagaatttcttcgtgtgaggccacctgttttctttagtaccactaatcctattgaagctggtgattggctgcatgccatagagaagaagttggatttacttcagtgcactgatccggagaaggtatcttttgcatcacatcagttgcatggctctgcctctgaatggtgggatcacttccgcctgaataggactactgctgaacctatcacttggcttgaattcaccgctgctttccggaagacgcatataccatcaggagtagtgtctctcaagaagaaggagttcaggtcgcttactcagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattattctgatttccagaaattagtggataaggctatacgtcaggaggacaagtacaattgcatggaacagaggaaacgtcggattgctcacttcaaggcacaacaggggagtaatcagaagccgcgtcttactttaggaccccagtctatgccacagggaggttcttcgtctgttgttcgtccgccgcgtcagttcttcaacaacaatgctggcaataacatccgcaatcaaactccacgtcctgttgcagctccaacacagcaacagcctgccaagagggagcaaggcagcaagcccgtggtgtgtttcaactgtggagacccaggacattatgctgacaagtgtccgaagccccgtcgcgtgtaggttgtccctgcccagagtaactctgctgtaccagcatcaaaggcccgtgtcaatcatgttgctgctgcagaagctcaagattctccagatgtgattttgggtacgttccctgttaactcagttcctgcaacagtacttttcgattcaggtgctacacattcattcttatctatgagttttgcgggaaatcatgggatggaagtagaagatcttagacatcctttgatggttagtaccccaagtaatcaagcactctctttgcaacgtagcccctcggtcagaatagaaattaaaggagtaccatttctggccaatcttatcttgttagaatccaaagaccttgatgtcatcctagggatggactggttagccagacatagaggtgtgatagactgtgccaacagaaaagtaactctcaccagcaatgatggtcgagttgtgactgttcatgcattgtcttctgagtctttaaggtcaagactgaaccagataactttggaagagattcctatagtccgggagtatcccgatgtgttcccagatgatttacctggtatgccgcccaaaagggatatagagttcagaatagatctggtaccaggaacaactccaatccataagagaccttatcgaatggcagccaatgagttggcagaagtcaagaggcaagtggacgatttgcttcagaaaggatacatcagaccgagttcatcaccatggggagctccggttatttttgtggaaaagaaagaccatacccagagaatgtgtgtggactatcgtgcgttaaacgatgtgactatcaagaataagtatccgctgcccagaattgatgatttgtttgatcagcttaaaggtgctaccgttttctccaagatagatcttcgatcagggtatcaccagttgagaatcaaagaggaagatatacctaagacagcttttaccactaggtatggattgttcgaatgtacggttatgtcttttggacttaccaatgcccctgctttcttcatgaacttgatgaataaggtgtttatggaatacctagacaagttcgtagtggtctttatagatgacattcttatctactctcgaaccaaagaagagcatgaagaacatcttcgccttgcattggagaagctacgagagcatcaactgtatgctaagtttagcaagtgtgaattttggttgtctgaagtgaagttccttggtcacgtcatctcagcaggaggagttgccgttgatcctagtaatgtggaacccgtaaccaactggaaacaaccgaagacagtttcagagattcgcagttttctaggcctcgcaggatattaccagaggtttatagagaatttttccaagattgctaagcccatgacacgattgcttcagaaagatgtgaagtacaagtggtcggaagaatgtgagcagagttttcaagagttgaaaaatcgcttaatatcagctcctattttgattttacctgatccaaagaaaggtttccaagtgtattgcgatgcatccaaacttgggttaggttgtgttttgatgcaagatgggaaggtggttgcctatgcatctcgtcagttacgtccgcatgagaagaactaccctactcatgatcttgagttagctgcagtagttcatgcgttgaagatttggcgtcattatcttttcggtactcgtacggagatgtacaccgatcacaagagtttaaagtatatttttactcagccggatctgaacatgagacaacggagatggttggaattaattaaggattatgacatgggaattcattatcacccgggaaaggctaatgttgtagcagacgctcttagcaggaaaggctattgcaatgctaccgaaggacgacagttgccattggaattatgcaaggaatttgaaagattaaatttgggaattgtcagtagaggtttcgttgcagctttagaagcgaagcccactctaattgatcaagtcagagaagcccaaattaatgatccggatattcaagaaatcaagaagaatatgagaagaggaaaagctatcggtttcttggaggatgagcaaggaactgtatggttgggtgaaagaatttgtgttcccgacaacaaagacttaaaagatgcaattctgaaagaagctcatgatactttatactccattcaccctggtagtactaaaatgtaccaggatctcaaggaaagattttggtgggcaagtatgaagcgtgaaatcgcagaatatgtagcagtatgtgatgtttgtcagcgagtcaaggcagaacatcagaaacctgccggtttgctacagcctttgaagattcctgaatggaagtgggaagaaatcggtatggattttatcactggtttacccagaacgtcatcaggccattactctatttgggtaatagtcgacagacttaccaaagtggctcatttcattccggtaaagacaacttattctggaagtcgattggcggaattgtatatggcaaggattgtgtgtttgcatggcgtccctaagaagatagtgtctgatcgaggcagtcagtttacttcaaatttttggaagaaacttcaggaagagatgggttctaagctgaattttagtactgcttatcatccgcagacagacggacaaaccgaaagggtgaatcagattttggaagacatgttgagagcttgtgctttagacttcggtggaagttgggataagaatctaccctatgtagaattttcgtacaacaacagttatcaagctagtcttcagatggctccttacgaagcactgtatggtcggaagtgtcgcactccgcttctgtgggagcaaacgggagaacgtcaggttttcgagacggatatcctaagggaagcagaagaaaaggtgaaaatcattcaggaaagattgcgagtggctcagtctcgtcataagagttatgccgacaatcgccgtagagatttgagttttgaagaaggagattatgtgtatcttcgtgtcacgccttttcgaggagttcatcgttttcacaccaaaggaaaattggcaccgcgttttgtgggaccctataagattgtcagtagaagaggagaggttgcttatcagttggagttacctcaatctttggcaggagtccataatgtgttccatgtttcgcaattgaaaaagtgtttaagggtacctaccgaagaagctaatcttgaacagatagaagtccaagaggatctgacctatgttgagaaaccaatccgtatcttggaaataaatgagagaagaaccagaaatcgagttatccgtttttgcaaagtccaatggagtaatcactcggaagaagaatcaacttgggaacgagaagatgaattgaagtcagctcatccacatctgttcgccagttcttccgaatctcgaggacgagattctgtttaaggggggtaggtttgtcacaccctgaaaattcaaaatatataaattgttgtttaattggaatttttagaaataattttaaaaagtcttgaaaagaagatctaatttttaattaataaatttcaacataaaatgggcccagataaaatttccttaaatactttgcttaattctataattcctagatttttctgggatttatttgagctaagaaagtatttttaataaatggaattgcatttaagaaataatttaaattgaaaaaaggttttaaaaagtcttcttttggctttgggccgaaagtcggcccaaaacctctcttctctctcctcggcccagccggcccagtccgccgcagccgcgcgcgccctcgctgtcgctgacaggtggggcccacctgtcagtcgtcgtctaccttcggccgccgccaccgaaaccctagtttcgcgccgccgccgtttccttccaaatccggccgcccctttccttctccggccgaatcaatagaggggaaacaatctccgggatctcctctaccttttctcctttggaatcttcggctaaatcggtttggaatgagttggattcgagttcgtctcggattcgttcttcccgatctttcctt

SEQ ID NO: 6940 - DNA, 10875 bp, Oryza sativa
ccgcggttatgggcgggtctaacaatgtctttcatgattagtctcacacttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttattttccgctgcttagatctctattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaaagacagtgacggcgctccgcaagctctcctctagttccctccgtgtcacgcccagaaattcacgaaccagaatttctaagctgaatgtgtattaaacccctgtccaggaccagccagggtacacaaatgacaattgttgacatacatatccacgttttacaaaaatataagagattacaaatgcagcggaaaagataaaagcgagctaagcctgaagacttgactcctgcagcggacgactccattccacaggcatccttgacggcagcgacgaaaccaacctcttcgagacatcttcaactgagaaggacttcaactctggtgtgggggaaaagagagcaagactgagtattacccactgtactcagcaagtcataccggaagaggaggtatgatgcagggtatatccaagggaggctaaaggttcttttgcatgaagctagcatttaaaagcagttgttgaaagcagtaaaacaattgcgttaattaatcaatattaaccaatcactgctcaacgctacaccacgttgagacaggcccaaaccaccacctgaactaaccagttccaaaagataactaggggtgagactaatcacggtgaatctggtcgaccgcccataaccgcgggcacggctattcgaatagttttactctgatcagaggtgtacaactgtacccacaagacacagccccacgacacgttcctgtgcgccgacatgccaccacaacataccggaaagaggccgtgacaggacccttcgcataaccccctctaaccgatcgcaccacaccttagggttcgcccccgtccccagcaggcaacgggcagcccccctttcgtgcctcggtgaatccggaagccgatcaaccggacaccccggccgacccaactccatcacatccaccctcgcctgggtacgtcggctagagaaaagctacactacaagcccagccgttgcccacgctggcttgtggtaagtacgataagttcttccagggcatcccgtgaaccggtccttaattgccatgggcacgactagcaaaaccatgcacccacagcccaccatgacgtgtattttaattaaccaataccattacggtggcaccaaaccaaagctatgccgataatcaaagtctatgctttaatgtgattccctttttgtgtactagtagaactaagcatggctaagcatttcctaaaccaacatctagtcattttaatacccaagttatcaatggcgtaagggaaacaacataaagctgagtaataggacccatcccacatgatattgtaaaacgatgcaatatttaatagaaatacaggacatttgtaaattgggtacaatatgctcaattgtaatgtatgacttgccttgctctcgcactgatgagaccacagcaacgtcttcgagaaaccgcgaatcgacgaaacggccgaaatctacgcgacaaacaaagcacaccagcaaaacatgctataagactactgaaacaggaaacaaaaccatttttaatggattctacacatttttatgaatttactgagacttgaatggacttaatcggagctcggatgaattagttatgatttttagaagattatctgtgtttttactataaaagaaaaacccttaatcaatttattgcgcaataattcctcccagggctgacgtcagcaaggggtggggcggcgccgacatgcgggccccactggacagaggcacaagagagagggagagggggcggctggcaggcgggacccaccgggcggcggctcagggggggagacgcccggtcggctcggctcggcctcaaaccggccgaccggttatggcgagggcggcggcgctcgagcacggtcgccggcgacggcaaccggcggcgggaggcggcggcagacggctcaaaggcggcggcggcggcgcgcgcacggaggcagcggcgatagggagctcgggagcggacggcgaaagagggaaaaaggtggagagaggcgcggtggtcggttatatagaggtggggaggctggacgtggccgggagcggcggttccccggcgactacgtggagaggtggaggaggagagagagggggagaggattcaaatcgaatcccgtccgtgcgggcgcgcgcatggacgggagagggcagggcgtggggcggcgacgtggggacgtgtgggcgcggagtggggcgcggatgcggaggaagcggcggcgtgggcggcggtttcagcagcggatggtggcggctgccggaggttagggacgaccgacaggtgggccccacctgtcggcgcccgggaggagaggggaggtgggctggacttcggggaggggaggtgaagcgggccggcgcgggagggaatgggccgggctcaagaaaaaggaaaaaggagggaaaagaaaagataaaaaggaaaaaggattttcccagggatttatatattgcacatgctcatttttaattggttaaaattatttccaatgctctgaaaattccgctaaaaatcctgttagcgtattttgacatgtagaatccaagaaaaattccacatgccgaatccgattattatttgcatttattaatttagggtttctctcttgcctttaaacaaataatttcttccaaccatttattaattgaatttttgctagggaaataacttctgggcgcccgtcgccgctccgctcgcaccccgccgccgcgcttgccctccaccgttccgcccgccgcccattcgtcaagaaggatttgaggtccacgacggcgcgacgtcctgatcttcgagctcgtccgccgctcgcttcatcccctctaatactgcgtcgttggcaatcatgcgtcgcttcgtcgaggtccacgatagcggcggcggaggacactgatgttggcgaggcgaggccggagaacgtgacaagcgaggcggtgcagccgtggtgtgcgactaggcgctgcaacagctcatccatcggtatgacatggccggcgaaggggctgacgatgaggatgacgtgcggcggcggtgggcgatgtgacgacggaggcagctgagggatttgggggttctttttggtgcccagggctctactgaatgcaatgtagatggttagcttcggtcaaaccgggtatggaccttaatgagtcacttaaacaagatggtggacctagatgtgcaatttacaagattatggacctaagtgacacccgcgcacaactttaaggaatggtagtgtattttactctatataaaaaaagaggggcgatcctaaacgtagaaaaaaccacctcctcctattatgctatgaattatcttaagaaagataattcatagaaaaaaagctgctcatgagaatatagaaaaacatgctttttctatcttgtggcttctaacacattattttaatttcatagttatattgatgggaatttaggtgaaaaatttctaccgtctagagagccataaattatggaaaatgttgtattactataaactctcccgaacaaggacgaaggagtgcaagcagcttaaaatccacataacttccttaacgcctcgttattttctgattaagttacagatcttacccactactacaaaacattaaataggtgttgccactatagatactgaaagtactaaaaccagcacctataggccttttccaatttccgcgggttgaaattgcaaaaaccggcacctttaagcaattataagtgccggttctaaataagaaccgacacctattctataggtgtcggaccgacacctataatatattataggtgccggttttttaaaaaacgacacccacagaaatctagccgaggcggcatcggatgagccaaccagcgggccccaccacaacgaggcgaggaggagataaggttcgctctcgcgtcatctcgctctcttctctctctccctcccttctctctcatctctatcttctctctctccctcccttctctcccgctaccggcggaggcggcagcggcgaccgcgcccttccctcgctagatctagcgggaggggaggtggcggtggcaggaagggaggcggtagcagggatcttgaggggagcccgtggtggcccgacggccaggggggaggcggcggcaacgccttcccctccgctagatccggctggaggggaggcagcggcgcctccgctccaccagatctggccgggaggggagtcagcaacggctcggcggcggcgggaggggcggcagcagcaagtggcgtggctcacaggcatcggcggcggcgacctcccatctgccaaatccggcgggagggaaggcagcagcggcggcggagccccccctccgccagatccggcggggtaggcagcggcaacgacagtggcgggctcccttgtctcttctaccactggtgagcacccccaaccatctcctttgcttgccggctgtgtcattgttgatgtttgattcgatgattcaataatgtttgatgtttgattcagtgatttaaacttgttgatgaatatttgattgtgtgatgtgtacttgtctttttttttttgatttttgatttttttttttggctttaaagaattggctcgactcaaatcgagccgatcgggcttttttttttttttttgcaaatcgtatacctcaaaggtgtcggttcctaaaccggcacctttgagtcatctcatcagtgccgccttggtggtgctggttgggaaaattggcacctaaggggatttcccaaccggcaccgaaggctctttctgtggtagtgaccctggttttgttagcacgtttttcaatctgctaggtgtatttcgtgcgaaaactttttatacataatttaagttgctttaaaatatcagataaatctattttttaagtgtataataattaaaagccaattaatcatatactaattaatggatttcttgttttcgtgtcctagctacttcatctttagtaaaaacgagcatcaccaaactatgttccccggactggttggagagtggatatattttaaactttcgagaagacgttcccttgttgtttacatatcactcaaaatagttattaaaaaatttaaaagatatattaatatataatatatcagtatttaaaattcaacttttacaagttgtaaaaaaaaagtacagctagttaatgtatattgatagtcattttttttttgcaacatgtagaagttaaatttaaccttgcatgtttgtttggtgatctatcatatattaatatatcttagtgactttttttaaaaaaaaaattaactatctttatataataaaagtccattaaacttcctacaatcactctcaagccgccacgtggcatcctaaaaatactcccgagtcgccacgtggcattctaataaaatagagaaatctgaccatcgattttcacttaaataggtgggcccattattttagatcgttagattatctttaaagaaaaaaaaccccctgccgtccctacctccgtgcaggatgcgtattgtacgctccctatcaccccttctttttttttctctttgtttctttcttctttttttatctttatgaaaaaaaatccctacaaatagacatcgtacgagtaagtccattaaacttcttagaaacgcttttaagccaccatatggctcctacaaacgctcttgagtcgccacgtggcgctctgataaattagagaaatctaagaaattccaataaaaaaaagaaaaacatcgtaccatttattttctctttacacaccattagatctatatatgtaaaaaacaaatgtcacgtacgaccacacctctccctaggtccctcatctcctaacatgtacgtgcatccaaagtacgtatgtctccccacccctctcttcttccttccatttatggtagcaaaattttgtatataaaaaacacaacaactaaataattagaatatcttataatatattcgattttaatttgaactatgtttaccatattttggtatgtacatatataagaaacatatcatttgacataaacccctttatcgcaactaaatagtaataaaatattacaaaaagtaacatatatcatgccattgtaaatgatctcctattatctctcgtgctcactttcttatccatattttctagcgagcagttcagtacataaagaaccaacaaatgctatattaactatctattatatacttaaaaattcattaaactccctacagatcctcttaaactgtcacatggttttctacaaacactcatgagatgccatgtagtgctcaaataaattaaaagttcctagaaattatgataaaaaaatcaaaccattgattttcctttaaataggtagatccaataattataactgctacatctcacaaaaataaatccggtacccccacctccacccctaccgtatgtgagcatgcatgtacgtacgtacctccaccgtcctactcatctctgggatccaattctcatatcctatttttaagataacttttcctattttctacctagcacataatatatagaaaaataataatagctaaatgatcatgactctcaagttacatgtacttttctcagtttatttgactttttgtgttatttataattaaattcaagacccatattgcacatatttactatatataagttagataatactgctatctaactacaaatatttgagcaaaatagcacttcgaaaatgatgaatgaattcaaatgtgtgggtctaaagtccaagttcaatcatcaccaaagaagcttggaaccagaatgcacactctgggcctgaacccgatgaaggcggagctataagacattattagcaaggtggacactgacggcagcggcatcatcgacttctacaagttcctggacctaatagcgcactaaatgattagatgaaggacaaggactaagaggaggggaccagagggagacgttccatgtcttcgacaaggactagaaaacagcttcatctttgccaccgagccccaccacgtcatgtctaatgtatcaagagaggctcactgatgaggaggtcaacaatgatccgcaaggctaatggtgacaggtggatcaccacaaggagtttgtaattaaattcagaacaaaaatataaaacaagcaatttgattaaaatacacaaacaaaaaataaaaaacactaaaactataaaaaaaaaataacaagattccatgtagaatataaaatatcaagagtccctataaaagtataagttataaatatctaaaatttggaataataaaataagtattaaaaaaagagatcaaatacagcacgatatgagattaagcgcaatttaaaatccctaaaaagacaatttagaataaagtaatttgatttgaatacaaagtcgaattaagaatcactcaatcactaaattcagaatacaataaatattttttaaagaatttttctatctttattgattcacatgcataacaaattgcatatatatgaagcaattaaagagagggctagcagaatggtaaaaatatatatttattaccaatgaaagtttatcgagatttcttcacgaaaaagagatataataaatactcaattaacagtagagaatacattactttaattttggatagactagttcttccatgctttgcttgctctcccttgtgaacacagagtacactcctctaaactaccaagtctcacttaagtcgacggcctccacacttcagtgaatccactccccaattaggaagactctacgcactgactcgttgctccaagtcaagctggtatcaccgtgcgcaccgacgccggccggccgcggcggcgatggctggctttccgctgatcacatcagcgatcacttgcgcagtgggcatcatcttcttctccgtttgctacctgcatccggcaccggtcgccgccttgtacttcaactactccaccttcagccaggacgacgggaacaccatcagactcgaaggcgacgcctccttcggcgacgggtggatcgacatcagcgccaacaggtacggccacaggggacacagcaaaggccgggcatcgtacagcgcccggccgatgctcctctggagcagggacaccggcgaggttgccagcttcaccacgcgcttctccttcaacatcaccccgcccaaagaggacggcggcatcgacaacaagggcaccggcatggccttcttcctcgccgcctacccgtccatgctcccgagcggggtcgatgagctcggctacaacatcggtctcaccgaccaaggcccggacgccgtggcgactggcgacagccggttcgtcgcggtggagttcgacaccttcaacaacaccatggtgcacgaccccgacgccacctacgaccacctcggcatcgatgtcaactcagtcgtgtccaacaagaccttgaccttgcccagcttcaccctcgtcgggaacatgaccgccgtcgtcgagtacgacaacgtctccagcatcctggccatgaggctgcacctcggctatgggcttagtggcccccgtcaccggccggattacaaccttagctacaaggttgacctcaagagcgtgctgccggagctggtctccgttggcttctccgcctccacgaccacatcctttgagctgcatcagctgcattcatggtatttcagctcatcgttggaaccaaaggccgcggtgcgtggcagagttgtagcgggagccaccgttggcacggtaatgttcgtcatactcctcttcgccatggtagcagtccttgtacgacaacgtcagagcaagaagagggagacagaggaggcaaagaacggaggcatggatggcagcgacgacgacgatgacgacgacggcgagaccatcgtagagatcgagatggggacggggccaaggcgatttccatactacgaacttgtcgaggcgaccaagagtttcgcggcggaggagaagcttgggcaaggcggtttcggcacagtgtatcggggctacctcagagagcagggcctcgccgtcgccataaagagattcaccaaagattcctccaagcaaggcaggaaggagtacaagtcagagatcaaggtcataagccgtctgcgccaccgcaatctcgtgcagctcatcggctggtgccatggccacgacgagctccttcttgtttacgagctcgtccccaaccgtagcctcgacatccatctccacggcaatggcaccttcctcacatggccaatgaggttattaactcttgctaattttgtcttaatctttgtagtgtcaacttaattggcgaacatattgtcaaattttactcaggtttacgaacttgctaagtgcacatcgagatctctaaacttggtttagagtatcatctcggtccaaagccgcgtttgaccgtgctcttgcctatgtgacacgccacatagacgatgacatggaattttttttctcctttttcttttttttttctcctgcgcaaccgaatcgttaaccatgttcccttatacagtttcgcatactcgttcgtccagttgttagttattcacaggctgtcgcacgtgtggaacgaagaaggaaaaggaagtatccatgtgctttcctgatgggccacccttacctttcttctaaaattcatcatcatgtctccacactactgccactgcaaacagtgtacgcattgactcgatcaatcaacggggagggaacacaacacggcggccatcgatggccggcgttttgcagatcacatcgtcgacgaccaccacgaggtacaatattgtcggcctcatcttcttcttctccgtcttctgcgacgatctctactcgccggctccagtcgccttggccttgaccttcaaccacaccaacttcggcccggacgagcagacgaacatcaggctggaaggcgacgccgccttcagcgccgacttctccttcagcggcgacggcggcgggtgggtcgacatcagcgccaacaggcacggcagcatcgaagacagccgtggcagggtgtcgtacgcccttccggtccctctctgggacgccgccaccggcgaggttgccagcttcaccaccggcttcttcttcgtcatcaacccgcccaaacaggacggcggcatcgacaacaagggcgccggcatgggcttctttctcggcgggtttccgtgagggttcccggcttctacccctacaacctcgggct

SEQ ID NO: 6941 - DNA, 14310 bp, Oryza sativa
ttcagaaagtgcggggttgtacggaagccaccgtcggcgcagcactgttcgtcgtgctcctcttggccatggtagcagtcgtcgtactcgtacgacgacgacatcagaggaagaagatgaggaagccggagaaggcgaacgacgacgacgatgacacggaaggcgatcccatcatggagatcgagaacgggacggggccgaggcggttcgcgtaccatgtgctcgtcaacgcaaccaagagcttcgcggcggaggagaagcttggccagggcggattcggcgcagtgtaccggggctatctaagagagcagggcctcgccgtcgccattaagaggttcatcaaagattcctccaaccaagggaggagggagtacaagtcagagatcaaggtcataagccgtctgcgccaccgcaatctcgtgcagctcatcggctggtgccatggccacgacgagctccttcttgtttacgagctcgtccccaaccgtagcctcgacatccatctccacggcaatggcaccttcctcacatggccaatgaggttattaactcttgctaattttgtcttaatctttgtagtgtcaacttaattgacgaacatattgtcaaatttaactcaagtgatcagctaacttctattttgtcacagggtcaagattattcttgggctcggatcagccctattctaccttcatgaggagtgggagcaatgtgtcgtacaccgtgacatcaagccaagcaatgtcatgttggatgagtccttcaatgccaaactaggtgacttcggacttgcaaggttcattgatcacatcgtggggatgcagacaatgactgcagtctctgggacaccgggctatgttgatcctgaatgcgtgatcaccggcagagcaagcgcagaatccgacgtttatagcttcggcattgtcctactggaggtggcgtgcgggaggaggccgatgagcttactagacagccagaagaatggtatcttccggttggtcgagtgggcttgggatttgtacggcaagggagacattctcatggccgctgatgagcggctcaacggcgactacgacgcggcggagatggagcgtgtcattgtcatcgggctctggtgcgcacaccctgatccgaacgcgcgtccgtctatcagaaatgccatggctatgctccaatccggtgggcaactgccagtgttgccggctaagatgcccgtgccgatgtacattcctccagtggtctctgtagatgagctcttcacgtcgcctgcagggatgtcatcctcaagtgcgacgcagtcatcaacaacaacggtgagtggctacgcaacccacatctcgacttcttctgacacatccacttcagctggttcgaaggactcgtcttcgttgctcaaacatcagttctagtaatgttcagttcatttgagttgttcttgattttacagtagttgatgcttggatgggatgttcagctcgtcagcgcccgttgatttgatctttagacttttgcttaattgccggtgtgagtaatctggtatttacgccatgctttgaacttttacagtcattttaagtttgtctacaaatatgtatgtataaatgtataatgccacatttctattcattcagattgccgatatacctaacagctcgttctttcgatcgtccgcttgctagaagccagttaatgttctgggcctcaggcccattagtagagtaggcctccatcctccttattgccttcaccatcaggcccatagtacaaagttaggctgggccatagcctgcaggcaaagttgctttaatcaattcctagtgattttgctatatactgtatttattagcaaattttctcccaaaatattgacatgtaaatataatataattatagtgtaactacatcgttagatttgcttcaagattcgtactaacgagagaaaaaaatcacaccgcatacacatctggggattcggtcacatgacctccattttatagaaatagcatattactaagagatttttaaaagttacatacaagttaaattttagttttatgtaaattaaaatgtattgtactatttattttatctaccaaaatttttgaagaaaatttataaacgaatatataggtagtaccattagaggaagctattagcagagaccttgagacattgactggtctctcttgagtagatagatatatatgtactttttttttccagcatcactctcgatcaatcagtggatggctacaataattttagataggatagtgctagtccttgacttatggtctcctgaaagcaactactacttgctactacaatagtttcagtcttcatataggctcctgtagtccttcgacttgcggtttcatgtgcattgcacctagctctactatcaatggtgattggtgatcagatgtgtttgtgttttggatatatatatctagatatcggtgcctaactttatacggtagtataattttttaaaggtagaggacaacaataatttatactatcaattattcaaaggatttttataactttgtgtcgttagaacgaaaccagtgcacgtgcttaaaatcaacatcagcataggctcattatattcctcgaagtctagaaaattaatcaaaccaatgttcatggaggcaatggttaattttcagtcacaattttgagaagtttgggcgcaccataaaaaaaataaaatacaccagcagttcttaaactagttaggaggtttcactcaggtttacgaacttgctaagtgcacatcgagatctctaaacttggtttactgtatcatctcggttcaaagccgcgtttgaccgtggtcttgcctatgtgacacgccacatggacgatgacatggaattcttttctcctttttcttttttttttctcctgcgcaaccgaatcgttaaccatgttcccttatacagtttcgcatactcgttcgtccagttgttagttattcacaggctgtcgcacgtgtggaacgaagaaggaaaaggaagtatccatgtgctttcctgatgggccacccttacctttcttctaaaattcatcatcatgtctccacactactgccactgcaaacagtatacgcattgactctattaatcagcgggggagggaacacggtggcgatcgatggccggcgtcttgccggcaaccaccacgacgaacaatattgtcgggctcatcttcttctgtcagatcgtcatctgacagtgctgaggaagatactgaagaagaactgagcttggaagcagagcaggacgatgatgagaagatgcaagctgaagctgaagatgcagagcagggaggagttatggaccatcaacccgcgttgcggcgcacttcaaggactgtcaagcccaacccactgtaccatgggccacagtgggccgtgtaactgaattcgttgtaacagctgtctaacagctagcgtgtcgcgtatgctgtacgttgagagcgagagagagaactatatatatgaattggggatgaactagagaggaggacttttggcaatctggtggcgaaggcggcggaaggctcaatcctgttggattggtgcataatacatcagtaatcgattgccatatatcttgttgctgttctgtgattgttctagttagattagatcctaacaatctggtatcagagcctcaatttgtctcgaaatcctcttgattttgctgtaaaattccttgcaagggattggaaccgacttcggttggattccgcgaaaaggaaacttgcccttctaggttagcgaaattcggagagtagacaagttcaggcctcggatccaggagtagcgccatggatacggatgggaagcttgatgtgttgctcaagttggtggaggggaacgagaagaagcgggtggaagcggatgagtgtacgagggcggagtaccaagagctcaagaagacggtggaatccagaattcctgtggttgagaagaaggtggaggtgttgagcgaggcgttgctcgagctgaatctcaaggtgaaccgcttggagggatagatgcagaggacagttaaggaagaagttcctcaaggcaaggttgctgatccgaaaccgaccacaccatctggtatgcgagatcttcacctgttttcctctgcttctactttcggaaacaattctaggaagtctgatcaaggaggtgaaattcccatggacattagtgctaacggtccacccatggtttgtccacaattcaatggtgataaccctcagatgtggaaatcaaattgtgagcaatattttgaagtttatggcacacatcctatcaattgggtaaaaattgcaaccctgaatttcgtgggcaatgctgcgttctggatgcaatctgttaggtctcaactgcagggaattacttgggtggggttatgtgaattggtgtgtagcaggtttgctaaagataggcatcaggcactgattcgccaatggattcatatttctcagactgggtcagtgagtgagtatgtggaaaaatttgatgggttaatgcaccaactaatggcctatgattcatcattagttcctgtttattttttcaccaagtttgtggaatgattgaaagatgagataagagtagtggttatggttcagaggccccaggatttagattctgcttgtgccatagccctgctgcaggaggaagctttagaaggtgttaaggccagtcattacaggaggtcagacccaggggttatgctcaaaacaaatagaactggacctattgtgggagttactcagcatactaagaacaatttgaatcaatctgaagacagaaggggcactgaatctgctagagctaaagatgataaggtggctgctctgagggcttataggaggtccaagggactatgctttgtctgtggagaacgatggggtaaagaacataagtgtgcaactacagttcagcttcatgtagtggaacaactgttggcagtgttacaacctgaaattgacagtgattctgataacattgaattgggaacatcaccagaacaacatggcactttattgaccatatctcaacaagctctgtggggaactgaatcaaatcagtctatcaaggtgaatggttgggtgcagggaatggaactgatcatgcttattgactcaggcagcacacattcgtttgtggatgaacaaattgcacttaagttgatgggagctagaaggttgcaacaacccctaactgttagaattgctgatggaggtgtcatgcagtgcactagggaaattgctgactgtcgttggtggatgcagggacagagtttctgcagtaatttccgactgctacccctgggaaattatgatgccatattgggtatggactggctcacaatgcacagcccaatgaaggtagactgggttcaaaaatggatggaattccaatacctgggaagggatgttcgaattcaaggaattactaatcagccagcacagtgttctcatataacacacaaccagttatctggcatgaacaggaagggttcactgttgtattttatccagttacaaaatatggccatacaggagaatagcactatttctgattcagtcaaacctatgttgttagagtttgctgacctctttgaggaaccaactgaattacctccgagaagagcttgtgatcacagcattaacctcattccaggggctaaacccattaatctgagaccttataggcacaatcctgctctcaaggatgaaatagagaggcagatagctgagatgctcaagtctggggtgattcaacccagccaaagtcctttttcttccccagctatacttgtcaagaaaaaagaccacacttggagattggtaatagattacagaaagttgaatgccattacagtcaaaacaaaatatctagttccagtgatggaggaactactggatgaactatctggttcaaaatggtttaccaagctggacttaagatcaggttatcaccaaattagaatggctgagggagaggaacacaaaacagcctttcaaactcattctgggcactatgaatataaggtgatgtcttttggcttgactggggcacctgcaacatttttgggggctatgaatgacactctaaaatatgtacttagaaaattcgtcctggttttctttgacgatatcctgatctatagtccagattttgagtcacatttgactcatgtcagacaagtcttacaactacttcagcaatatcagtggaaggttaaattaagcaaatgttcttttgcttagtcacagttatcttatttgggccacatcatcggtgcaaatggggttgcaactgatccacaaaaggttcaggatatactcaattgggagattcctaccaatgttaagaagttgagaggatttctgggattggctggttattacagaaaatttgtacaaggctttggtctgaaaagtaaacctctgaccaatcttttgaggaagggtgttccttttgtttggagtacagaagcagattcagccttccaggctcttaagacatctctggcctcagctcctgtcttggctttaccaaattttcaaaaaacctttgtggtggaaactgatgctagtgactatggaatcggtgcagtactatcacaggagaagcacccaattgcctatataagcaaagccctgggtcccaggaccagaggtctgtccacttatgaaaaggagtgcctagcaatgatcatggcagttgatcactggaggtcttacctgcaacatgttgagtttataatactcactgatcaccacagtctcatgcacctatcagaccaaagactccacaccccctggcaacataaggccttcacaaagttactgggtttacaatacaagatttgttacagaaaggggagtactaatgctgctgcagatgctctttctagaaaaccacagcaatctgaggaagagttcaatgctatttctcagtgtgttcctcaatggctgatggaagttttgcagagctatgatactgatccacatgctactcagttagttgctgccctgacacttaaccctaattctaagcctcatttttcacttcagcatggagtcttgagatataagggaaatatttggataggcaacagtcctgacttgcaacttaaaatcattaatgagatgcatgccagtccagtaggagggcactctggatttccagtgacttacagaagaatcaaacaattatttgcctggaatggaatgaaatcccaaattaaggaaacacttgccaattgtcaaatttgtgctcaagcaaaaccggatagatcaaggtatccaagactattgcagcctttaccagtccctaaaggtgcttggcagactatatcattggatttcattgaagggcttcccaggtccagtcactacaattgcatcttagtagtagtggacaaattttctaaatactcccacttcatacccttgagacatcctttcactgcaattgatgtagcaaaggccttcatgagtaatgtgtacaaactccatggacttccacaaattatcatctctgacagagataaaatttttacaagccaattgtgggagcagttatttctgagatctggcactaaattacattacagttctgcttatcaccctcaatcagatggacaaacagaacgaggaaatcaatgcctggaaatatatttgaaatgctttgtccagtcagcaccttccaaatggccttcttggttgcatttagctgagtactggtataacaactcataccattcaactattgacagaactccatttgaagccctgtatggatatccacctcgccattttgggatcagcatcagggactgtgacaacagtgagttgataacttggatgcaggatagaaaattgatgcaacagttagttcaacaacatctgcatcgtgcacagcaacaaatgaaactttttgctgataagaaaagaagttttcgacagttccaggtgggtgagtgggtctatctcaagttacagccctatgtgcaaagttcagtggcccccagagcgaatcacaagctggctttcaaatattttggaccatttcaaatcctggagaagttgggtactgttgcttacaaacttcagttgccagccacaagttccattcatccagtctttcatgtatcacttttaaaggaagcaaaggggttccagccatcagtgcatacaccattatctccaacttactctgctgtccagtatcctatagcattactggatcatcgtcttaccaaaaaaggtaaccatactgttcaccaggttctaactcattggtctgacactattccagcacaagctacctgggaggatctgcatgacttgaaggccagatttcctaatgctttggcttggggacaagccaaaactcaaggggaagggattgtcagatcgtcatctgacagtgctgaggaagatactgaagaagaactgagcttggaagcagagcaggacgatgatgagaagatgcaagctgaagctgaagatgcagagcagggaggagttatggaccatcaacccgtgttgcggcgcacttcaaggactgtcaagcccaacccactgtaccatgggccacagtgggccgtgtaactgaattcgttgtaacagctgtctaacagctagcgtgtcgcgtatgctgtacgttgagagcgagagagagaactatatatatgaattggggatgaactagagaggaggacttttggcaatctggtggcgaaggcggcggaaggctcaatcctgttggattggtgcataatacatcagtaatcgattgccatatatcttgttgctgttctgtgattgttctagttagattagatcctaacatcttcttcttgtccgtcttctgcgacgatctctactcgccggctctagtcgtcgtggccttgaccttcaaccacaccaacttcggcccggacgagcagacgaacatcaggcttgaaggcgacgcggccttcagcgccgacgtctccttcagcggcgacggtggcgggtgggttgacatcagcgccaacaggctcgacggcaacatcgaccacagccgtggcagggtgtcgtacgcccttccggtacctctctgggacgccgccaccggcgaggttgccagcttcaccaccggcttctccttcgtcatcaacccgccaaaagaggacggcggcatcaacaacaagggcgccggcatggccttcttcctcgccggcttcccgtcgaggctcccgtccgccggctcctacgcctacaacctcggcctcaccaaccagactgccgactaggtggccgccggcgacgaccggttcgtcgccatggagttcgacaccttcaacgacaccatcgtgcacgaccccgacgccacctacgaccacctcggcgtcgacgtcaactccgtcgtgtccaagaggatcttgaccttgccaagcttcaccctcgtcgggaacatgaccgccgtcgtcgagtacgacaacgtctccagcatcctggccatgaggctgcacctcggctatgggcttagtggcccccgtcaccggccggattacaaccttagctacaaggttgacctcaagagcgtgttgccggagcaggtcgccgtcggcttctccgccgcgacgtccacatccgtcgagctgcatcagctacgttcatggtacttcagctcgtcgctggaacccaaggccacaccgccaccagtggcgccgccgtcaccgtcaccaccgcctacctccggttcaggaagtggcggggttgtagcgggagccatcgtcggcgcagcactgttcgtcgtgctcctctttgccatggtagcagtcgtcgtactcgtacgacgacgacatcagaggaagaagatgagggaggcggaggaggcgaacgacgacgacgatgacacggaaggcgatcccatcatggagatcgagaacgggatggggccgaggcggttcgcgtaccatgtgctcgtcaacgcaaccaagagcttcgcggcggaggagaagcttggccagggcggattcggcgcagtgtaccggggctatctaagagagcagggcctcgccgtcgccattaagaggttcatcaaagattcctccaaccaagggaggagggagtacaagtcagagatcaaggtcataagccggctgcgccaccgcaatctggttcagctcatcggctggttccatggccgcaacgagctcctcctcgtctacgagctcgtccccaaccgcagccttgacgtccatctctacggcaatggtaccttcctcacatggccaatgaggtaattgatttccctaattcattagaatttttgctaatgtgcaattgacaaatggccatgaactgatcagttattgggtttggatgttgcaggatcaacattgttattgggctcggatccgccctgctctacctccatgaggagtgggagcaatgtgttgtgcaccgtgacatcaagccaagcaatgtcatgctggatgaatccttcaatacgaagctaggtgacttcggcctcgcaaggctcattgaccatgctgatggggtacagacaatgacgcacccctctgggacgcccggctatattgaccccgaatgtgtgatcactggtaaagcaagtgccgaatctgatgtctacagttttggggttgttttattagaagtggtatgtgcaaggagaccaatgagtctactggatgatcaaaataatggtctcttccgactagtcgagtgggtctgggatctatacggccagggagccattcacaacgcagctgacaagcggctcaacaatgactatgatgtggttgagatggagcgtgtcattgctgtcgggctctggtgtgcgcatccagaccgatgccagcggccatcaatcagagctgctatgatggtcctccagtccagtggaccaatgccgatgctaccagccaagatgcccgtggcaacatatgcaccgccggtggcctcatcggaggggcagctctcgtcatcgacgggtatgtcatcatcaagtttgacacaaacagcaatcacacctcgttaggggcataagtttgcccacttgtggtacaaaaataatccatgccattagattataaatgcacttgccttctacttattctcatttcagattgataaactgtaaaccaaatgaattagcatgggtcagccggcggataccttgagcagggatccttttctcagggatgccgctctcggtgaaatctagctagagatttaaattgcaaacaatgtttgactggatttgaatcaatttgaacaaaattcaagaaggacatgctcattgttgatagatgtcatacgataatcggcaaaatggaggcggacaactgcatagaacattacctactaaacttaggttttatccaaatgcatccccatctctgactgacaccaaagtatgtaacctcgaacgatatagaacacatggaacatcatcacaaaaagcatatcagtaattttgtaccacaccactaaaattcagaacaagaggtcacaaaatatattttgatacatggttcgagttgctgctatcattgtcagcatttcgtcaagcaaatagatgaattggaacttccagtgctgtttccagtcttcgttaccatggaagagcgaagtctaatgtttgtttcaagacaaaaaaaaaaggtaaactcaatcagaaaaagaaaaggtagatgaaagagagtacttttatggtacattctactgctagtatatactaccagtatatgaagggtagttttggtattagggaaaaatctgaaaagggctttttggtcatttaaattagagaagtattttcaccgggattaattttccttcggttgtttggatatcatcatccgcgtgataccgcttcttctggatacatctcgcgtcgctgctccttctgcagctccgcctgcccatcgcctcactcaagaactagggttttgggtcgctggaaaagacatgagaggaaaggatgagggaaattgattcgattcccgatggcggcggcgcggcggcgctcgcaagaggaagacatcggcgacgcatgggcggccatggatcagatttgactagtgaggaaacgtgaaatcataaaattacccccacacaattagataaaaagacaaatatacccttttcaatttatactgcagaataattagaagggggatcggatgaattttcgaccgttagattaaatatactggtagtatatactagtagtagaatgtaccataaaaatcctcatgaaagaaggcacctctttcaagttgaaactcctgaaagctataaagagtaaacaagcaccaaaaatggttgctataataattggctgtaactcttttgagtaaaggccgggatgctattttattccattatctaaaaaaatatattttcacatgggaactgaaacacaacagataaatgcgcagctcaaagtcaaatgcaaacaatatgaaacaacaatggtggtgtaaacaacaggaacctcgatataataaaagtggagcatggccactgcctactgtaaacaggatagcctgcaacaatttactactacagagttattcaaatgcaattttctcaaattacggatatttatgttcgacactttggttttgacttcagaatcaaggtcatcgaaagcagaaaaaaaaaacattaacgcacaaaacattagagcacgatagtccacccaaattgtaagatttaagaaatagtcaatcattcagcaagcatgtcacccaggactgatagctctgccacttcacggagtgatcaaactaaatttggaaataaaagagttgattcttatagtgtcagcagtggttctgctgttgcaatttcctcaacaatttctgatcaaaagtgtgaaatcatagtcatgattaatatttgtaatgaataattggctttgcaaaatgatttattcgaagaattggtttgagagtatgtgtgaatgttggtgtgagtgcgtgtgactaatttgggtcaggttgtgatatctgtgcccagaaacggttgttttgtctgattgtgtgcaggtgacttgaggtcagccttggtcaatggtgaggaccgaaactatgctcagggtggagcagaggtctagtgcggtcatgataccatgtgagaaggtgactagagtcaggattcttggtgaacaacttcggtcaacggtggggatctgaaacgctccgcttttcgtgaggcgttaaaaactaactcggcaaaatcctaattgcgaaaattttcgttctctgtgtgagagtctaagttgtgccaaggatcccaatttaatcccgttgttccctctcatcgaaatcaaaaaaatcctccccctcatccaaattcctcttccgattcgagtctttgaaatcaaattctgaaattcaaatccttcctttgaatcctcgccaaatacttctacgaatccagaattattcaaatcccgcctcgaatcctttccttgactccaccctatgttcccgagaacaaatacccaagtattccttttgaatcctttccatgacttctccttgagtttcccctgatacatccctaaaccctcgagtttgaatatcaaatttgaattcgaatccaaaccctaaatctctccaattctatccaaatcagttttctctgtaaaaatctactttacctccctatgtttttggatggaccgattctcctcccccggcccatctccccttccagcccatcatctccccccctcgcacgtgcgttacacgcatgcgagccgagagagagccgtcgctcgctctctctgtttccctctctctctctctcgttcgatctccctctcctcggcgccgatttcccgccgtcgccgcccaaaacctccaccgccttcgcccattcccgcgcgcacctcgcgaggtggccgaccggcctgtcaccgccgacgccatgcgctgccgccttgccctcgctccatgccaaaccgaccgccgccgtcatcgtcgacgtcatccatgacccccccgccgtccacgccgcacccgtccaagagtgggagaagcagctgctctccctctcgtcctcctcactctccctcccctcattatggcaagggaccaagcccctttttccccttctttttccctttcccgaccactgcgggcgtcaccacctcttgcgccgcttgaccgaccgcgccagcccgcgctccaggggttcgatttccgccgctagatccacgggcttcgccactcaacgcatccacgccgtcgccgcttt

SEQ ID NO: 6942 - DNA, 17998 bp, Oryza sativa
  unsure (1)..(17998): unsure at all n locations
aatcgaaccctcgtcgtctcgtcgtgttttccccttttgatctccggtgattgccgccgccgcaatccaccgtcgtcggctcctctcgcgtcgattcctctcgccgccacgctcccggggatccccatgacctccccctggctgccccaaggccgtcggccttctcctttgtctccgcgccgtgtcgccgcttccgccgccgcctaacgccgccgtgcgtgcgccgccggtgaccatcgggtcccgcgtcaccgcgtgcgcgtcgcaacaccataccggttcggctaagcccgagcccgcgcacccttagctcttctcgcgcgcggccacgtcggcgtgctggcgagcttggtcgccgccgccagccaccgtcatacctcccctctcaaatccgtgccgttaaacggattccccctgacctcctctagctgccggcggtggccgctcgctccggttcgccgtcgctcgcaggaacgcctcgcgcgtcgtcggccgtccgatcccgggcacctcctcctcctcctccttccctttcgcccctgcccgcgtggccgaccacgtggcagccacctcagccccgggcccgcttgactgggtcaagtcgcgcccagtcagcctcctccctccgtcttccctcccatgcgcgcggtccacggcaagccgtgcggctgcacgtgggcccgccgccatccgtccacccggcgcgccgcgcccgaactgcgcgcatccgaaaccctagcgcccgcctccgcgtgcaccctccccaccgtgaacccaaccaccgccatctgggtcccgcgcggtggaccgcgcccaccccgacgggcctccctctctccccgcgcgccctcatgggccgcctcctcgcgcccgcgccggcccatttggtttggccgagccgcgttagcctttgggccgcaccaatgccaccgaaacaagtctaatatacatccctccttgatttcctttttccacccttgttccataaatcaattccttattccaaaattccatgaatcattttccttggtcccggattcaatgactgtcaataatattcttgagaatattatttctataaattccataaatcatctctcctattccagaaactccaattaaactttcaaaattcatatcacccaattcgcaactccgattgactccattccacttccaataattccgtaaattgagctctatttaatggcactactaattagtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccatttgatcaattgcccctataattgaaaagtcattattattttgtttgcaacttgcattattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaaggacgagaagcttgctcacttaccgatcaaggtggttggagtttgatttgtgaacgcctaaaatggcctatgtttatgtgaggatttgatccttctatgtggcatgaggtaaccctgggtcggctcgggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtttttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggcagctggactctgggagtccgagaaaatgaaaaaggctctgggagctgattaatcaagtggaatggctctgggagccgagaagtaatgaactgacccgggaggtcggtacattaccaaatgagctgttgaaaaacatctcttaaagtcgaatcgagacgcaagtctcttttcgtcccaaacttagaaagaaataaatcacttagtgatttcaaaatgatttcaaacaaaagatttgcaaaacaaccttgcctctctgccaagcttgcattaaacacctaagttcccgtgacttgctgagtacgaaagtactcacccttgctctatataaatatatatatatagttcctccgccctgaagggaagataaagtgaagtgaagatttgggtttcgtcctggttcccagccgtcgcctgtggtgttgggtgttagaccgttggttccgctgctgctgctgctgttggtgttttcctcgtccgcgtcgtcggttgtattctcgggctgtctgagctgcaacctaagttaaggtaaataagtcctctatttattttaaggattgctatgattcatatttgtcaccatgggtaccagcactatgtcctgggactggtaccgagatcgcggtttcgtaggaagcggttcgcgccgttttccctacgacacgctcctgtcaggtgccgttgtacggcggtatcagattggggtgtgacaggatcgggactaaactcagggaggagttgaggtccagacagtcaaggataccgggtgacgaagttggatacgagatggcacacagtgaatggatatcgtgtgggagagatcttcgcaacgggcttcacgagatatgcgtgcaagtaccggtgttggcgaaggagattggagtgagaaattgaggaagagtatatggtgatatagtacacgtggtactgtagcatgcatatgtgtggtattgatcgatgcatgcaagtgtactgtagtggttggcagtacatggatgcatgtatgcatatacatgtgtgttggctcggtgagtccaaggcaggagcggcgctaaggcaggagaccgaggccgaccgggacttcgtatgagacggacatgtgtccatgtcgggtttgctatgacacggattgactgtagtcggttgtgaggctgcaggctttaggagactaatttggatagagtcatagtttgacgagtggtactcctatttcgagtaggagaattttcatgtataaatagagaggaagcgtgaggcttcccggtatcggttttaggaagctgagtttgagagattagatagggtttcgtgagaaacttttgaggggtgctgtggctgcaccttgtgaacaatatacttaagcaataaagatcatattcaatcatcaaggcattaacgatctattccggtttcgtaagttttacgtttatatttggttttggtattaacttgtgattgttcattttgctgcgattttgttcaagttaattcatccaaaacttttctaatacttcaaagatcagatctggaaagtttcgttgattggttctatttgatgatattttgtcacgtgcaaggaaaaattgcagtggccaaagcaagcaaataatgtgatccctatatgggatgttcagattgcatgcagagcagtacgagctgtgagcagcaaaccacaagagatcggccgggcagctggttgtatccatgcatgcaagcccgcacatacgcacgcatgggcttcaattacacctgcgtacactcgcatacgtgaccgtattttctagcaatacggccgcgtatatacatggaaaaacaaggagatgcgaagctacggtgtattttacgctatacggttaagttagctcatgcttgcccggatcaacaaattaaatttatgaagagataaaatttatctgaatgaattcaacacaatccttgcaagccacgcgcatacgaaagacggccttccgccggactctcaccggcccagcaacggaagagtggcaaggaatatcggaaaccgccatgacgcgctccggcggatgcgcacacgtacgagagttaaattctatcctgtaggcccatcagaaattaacagaaccaatatttgacgtcaggcggatcgaagagataagattaacaaaccgatcgattgatcaagtatatccgcacttctccaccgacctcaggcccctatataaggcgtcgacgtactctcggcagcctggaggccatggacgccgatcaatccataaacacccatcgacacacatgatcatccatctgtccatctcctcctggaagacaactatccaccggcgacctagctatccatcgaccggcaacgagcatcaagatgtgatctcggcggccggcgacctcgtccacagcacccctgtgtccggcaagaggcgcacatgaggaggaacaacgacatcttccttgggcagatcaaacgctgcaggagatcgtactcaaaccttcaggaggagagcaagtctctgtcgctttcttttctctcgtttcaggtgggagatgagcctgtacgcgacgccgccggggttatcgtggctgccatgactatttctgaaccatctccgctgccatcgagactcatccgcccgccgtcatccacattcatcaacatctccatctcatctcagatggactcatccattcatctacaaatcattcaagaagcgacaccaaagaaagtcttaatggccactacaggtaaagctaatttagattggttcctttcttttggttccagtgcctacgtgcatgcatggaggacggccgggtgtgctgccatcgccggagtcgtcgcgtagaccaatctgttgacgctgatcgcaagcctccgtcaagatcgatgccgctcgtcctcaagctctgatgttcgagctgccggtgacgatgaccctgctcattgctgcgatctcgcctagatgttggatgacgttgccttgccgaccgctgcctccactcggcgacgccgtggatgtctgctggccatcttcgacgatgctgccaccttcctcacactcatcgtcaaggcgctcgaggagaaggccggtcggagtgccgctacccggcactgcgacaccaccaacacccatctgccggagaagaccatcgtgatgccactccgcccgacgcgacgcgccggagatcgtcggagcagccgcggatgctgcctagtcacgctgatccagaagctcttgttgagaacaacacaacaacacggacgccgctgagctgcccgcgtccgtgaacaacatatcgtcatcacgccggtggccgcccacgccgtcctgatagagcagcgggaggccatctcgtccaccttattggcaacgcacagacgctcgccatccccgtcaagctgctggtgacactgtccgccgagtgccaccctgtcaaaggctgtcgttgtaccgacgccaagctctaaggacgccgccattgtgatctctactgtgtgaggacgtctcaccgagactcaggcgacgccttcacgctcgtcgcggtttcttcggtcaccatcaacgtctactcaatcatcttcgacggtgctaccaccttcctcacgctcatcatgaagccactcgaggagatcgccattcggagtgctgctgcccggtgcctgcacgccgtcttgccggagcgtaccacggatcgtcggagcacccgcggatcgacgttgccgagctgatcctgatccaggaggtctgaacggagccgtcagggacgccccccgagctgctcttgcacttaagctcgttacaattatcatgcaactgaggcactgccatgtagtgttcgttcttgccgatcaaacactgtcacactgcctgccggagcacgttggattacgccagagtgccattgctaggggcccgtacgccgtcatcaagactggccgtgattctttctcttcatcaagccgaggtcgttgtgccgtttgtccgcgacgctttcacttcatcatgctggagttgttcgtgatgtcacgtgaacatcacgtcggagcaccactgcttggtgcctataaaccatcgtcaagccggagtcgtcgtgccgtccgtccgtgacgtctccttctctctacaccgcatgatgagatgccatctgtctacgatgctttcacttcatcatgccaagatgagatattgtctgtccgtgatgctctccctcttcgtcgagatcaacgacgctgtattggagcgtcgctcgtccacatcaacataaagcaagaatggtgccgtttgtgatgtcagggaaccgttcatgccagatctacaccaataatttcctcgaccgttctgccgacaaggcatttacttctacaaaggtcgccgttgctaccggcaccctcatagagccccttttatgggctcgtcgtcatatcaactggatcaatagtagatccatcatccgaaggatgtgctatataagccacgttcgtccggctgctgtctgcactgacttcttcatcaacaccttcattacaaatccctgttgtataagggacatgacgggtcaggaggtgcccagccatgtttaatccggttgccgtctacacctactttcttcgtcaattcttcattactttgatcacatctagtcagaaggtgcccatccatgtttattcggctcttgtgtgcaccaactgacttcaccaactcatcttacctttaacaccattccgatgttgttgctatgacgtcgagccgtccaagctaggcgattccatgcgtgtcttcttcaaacaatctacaccgacacgtcgttcaagaccgacgaggctagacgacgagggtgcgcgaagccgacgctaaggctatgtcaccaacactggcgcacggaccgacgaggccgtggatgcgttgccggcgcccacatatatatcacacatcttcaccaacattcatcatccatggagaacgtgaagcaaagacgatgagacgaccacaagcagcttaatcgggggttctcctgcaggcctagacctgcggaggtaattaaccaggagcttctcgaggccctaggaaccagaagacaacatcgctgatgtcagatctgtccaacgacaggcaatggcacgtgtattttctattatacatggaaactgtatcttgataattcaattaataaagatcatgtgtttttgtgtctcttttatgtttattttacatttgtgtatttaggtacactggcacgtccgcacttattttctctctaaacatagagggacatattcgtatttttctaccctaaacaggttcttgttagatttgaatttgcttaagttttaggttttgttcagatttgctgaaattttgatagagctgattttcaagggtattttctcttaaaccgtttattagtttacaaatccctccggtggaattgttctttaggttgtttagtgtcaagtttgcaactcgatccaacggttggtttaagagaaatcgtgtttttaccgaagcgctgtcgtgttgttttcaggctgacggttagaccgcgagaggaccagcggtcagaccggtcaagcttcggtcagaccgaccctagtaggtcggatagaccgccaaacgtgtgttccattggcttttgtgggatgtgttttgatctattaagattcgattatttgacttccgttgacgtaatctaacattcacccctctctggtaggcttggttacttatgtttgattctaaaaaagcaatccgttggaccctatccttacaaaagaaagagcagatctggaaacataatatcacaacacagtagcgtgtaatccattctctttcacatttgtccttagccaggatcagatgcgcttttttaaacctatcaggaagatgattgcgaaaacagtgatgagaatgaattttgacagcaacagctccagttatttatacattccaaatctaaagttacaatagtttcagcaatttttcatccccaaaagtccctgcataaccaattctgaatgtccaagttagttattcaacactactgcagaagtgcagaattgagtcaccctaaagtgaggttgaagcccttaaattcctttattgaaaggggaataaaaaacacgccaaggcaataaatatgaagtaattctcacatagacgtcacaacaatccccatccagccatccttgaattctccatttgcagatagactagaacagctagcgcatgagagtatgtgttcaatggttatggttttgtgggtaaatacaaacatataggcaaagggataaatatgctgttctaaatttgtaaattagagtatcatcaacaaaaaaagcaatgcaatgatctccagggctaacaaacttcatcagacagaggacaaagaaggaaatttaacacaaatcaattatctcaggtcaaagaaggcgatttcaacattagacaagacaaaaggaaagcaatactactgtaaccaacaaccactaaggctatgtacatcctttgggtgcagagtaaggctgggaacatgatcctctgacgtagagcaatctaatctacgtcagaggaacctatgacgcaaggctattgacatactttaagtgcacaggccgattcaagccattatctaaaaaaaaccagacaaccactagcagctttcacattgattacagagggaaaggaatgcagagccctgaccttaggagaggccgctccggtaggacgaatcggcggcgatgcacgaccgcagccttgccgccgccaccgcgctgtgcagcggcatcaaagaatccacgctcgccagcgccgctgccaccgccacgaaggacctgaaacagtcaggatctaggtactttgggcgtgacctgcggaggcggggaggagagaccggatgcttcgccgcctggaacgagctcgtaaccggagatctcgactggcgcgcggcggcgcggtagaaagacgccatcttgtttcgtcgtttgctgcggccttcggttgaggaagggaagaacaaaagctcaaaactgggcctgcgtttattgggccataaagggatcgcggtggcgtacatgagacccatttaagttggcccttcttgtggcccatatatacaatgggccagagatacctcgccgccacgggtaaccggaactaactgcggcggcggccgcgggggagcagcagaaactctgaaccagcagcaagctagcttcatgcttcaggcttcaagctttagttgctagcctgctacattgctcctcgttgcaaattgcaaacaggcgatggctgatctgatgcatctgatggcaacgggattagatcactgtagatgatccaaaaaccaatcgtttctctttgtggatttcagattcactagcatcaacttttgccctaatttcctccctccttttgacttgaactgtctccttaatttatcggagacgtttggttctcagctggatgagagtgaaactgatgaaatcatataaaacctattgcttttgcctacaacttttgcccccaggtactgtattactgttctactgttctctcaacagttgatcgatgccatctgcaccgtccaatctagcgtgtgtcaaggatccaaatatccaatatctcttccgcttctaccctcccgtgaccgtgagcagctcgagattagtttcttctcgaccatcgaaccctttcccgctgcttctgttcgccgccgccgtgctccagcgcctagggttttcttcgccgccggcgagtgctccagctcctagggtttcttcaccgccggcgagtgctccagctcccagccctgcgcgtcctcctcgccggacgctgccggtgacgtctgggccaagctaggtgcggccaccctcctcctccccccttcctttttcttgggtttcttccgcctcacgggttcttgattcttgaccttttcgttggtcttgggcccttggccattgcttgcacagcaggtctgtagtgccctccgattccgtgttcccggaggtggagctggccgaggacgacgccgtggtgtgctcccgggtcaccccggatggcggcggggaggtggtcgcgtggtgcaagattaggcgcggcggcgacgtgtcggcggcgacgatttggaatctgaggtatctgttgtgattggtggttggtttatccccttttcgctgctttgctcttctggactgtacatcgtaggcaagatgcgctttttttttttttgcaatcctgttttattggattgggggtacaaatgccattcattgatgatgcatgtttgggcgaaggctataaaatgcagaaaagttcttactgattgcgatggaatgcgagttgttgtcgtttggattatgtgaattgttgcggtgtcgcactatccaaaattaaagaaaggtttcctgtggataaaaaagattcaaatttcctaatgattccaaagtgcctcattttcttatccataagaccataataactcagtttccaaacttttgaacctgattgattttgagtcgtgctgatctgaaatcgatagatgtgagcccctgaagacagggaataggcagagtggccatgggtgagttttttcttttttagggggtggagggaactgtgttgcaaccttccgttaatccttttatcaaattctcgctgatgttagatgcctgtcttgtcatccttgtaatgtatgtttcattcgaccgctatcttacgttaacattatccatgtgccattgagaaagcttggatgcaattattgtcgatggaagagttatccagcaagaagcagttgacatcaaaccggggagtgaaattgttccagggccccagaaagatggtgagacaattatgtattttgagtttggcattttgtgcatagattggttgttatgtttatttagtggtcttgtattttttttaaatagactattttattcctttatgaagccaaatgagtgtttacacatgactctgaatatatgtactcattgagtcatttggaatgtttattgtttcctagacctttctgtttagaaagtgaaacttctatggttgcatgtttgtaattgtgcttctgaaaaatttaccaaattacaaatggttttccttttgtgatttcgttatgttggacaggtgaactgtaccactatgtaatgcatttatgctatccattttcttgcagggtatctgttgtacacctttgatataactggcctgaatgactaggacaaaaataatatcaaggtattttgttgaaatgaatgttgatcaacagcaataacctgggtgcataaaagtcactaacttctatttaaatgacgatgtcagattgtgctaggtattgagaatgcaaagtgcagcatatgcttaaatttgtgggatgatgttgttactgttgcttcatgcctccacaacttctggtacttttgccaattttcctagctacttttgatttatctcaaaattctgattggtgcttattcctgtattccttttaagcaatggctgcttctttgagtggttaagaaggtcttcagctaattcgcgtgataaaagttagagtgctgcctgtccacaatgtaggacgacagtgcaattagttggtgggaatcacttcctacataatattgaagaggtgtgatagttgggtgtgatgacttaactcctcaatactgtttaagtgctacatattgtacagctgagatgtttatttatagttctgcttttgtaggctatactgtaagttttttcatcgctacagcggtctgatgaggagattgcattgttggagtcatatgccccggtcaagacaaatattgtgagttcaaaatcttactaagaaattgttgattcccaccattttctcaatggattgtatcaagtgttgtgccagtctcatatttgccagcactgatatttgtccctgttatctgccataaaatcgaatattgttttaaaatcatcatctttttttcaacttgtaaaccttattttttttcctacaaactttgcccatgttactgtattactgtttaatcaacagctaatcaaggccatctacaccatccgatgtaccacgcggcaacgatccgtcccctcttctgcttctaccctcccgtgagctcgtggttgaaagttacatttgtcatgaatttggattatcattctattttgaagatatccttgattgataaatgcactgccatgtttcagataacattttattctcttatttcccccaattttccttccatttggcaattctcgtggtgttggtttgtctgtactgcactttgacacattatatttaatttacaagacttgccaggcgcctaggattgtctttagtattcaacttttgacaagataatagtggatgaaatgaaaatctgtttacaattagtactggcctcttaataaactaattagtaaaacaaaattccccaaatggtgggctcattccgttagtcgggtacttataattgtagaatttcctttcagtgcaggttgatctagaatcatggttctctctctaagtcctattttgcttatcgaatacttgcctcttaataaactaattagtaaaagaaaattccccaaatggtgggctgattccgttagtcgggtacttataatggcagaatttcctttcagtgcagtttgatctagaatcatggttctctctataggtcctattttgcttgtcgatgatattgttaaatgttgccatggaatgttagcatctgatacatgggcttctcatctatagacatgttgtgcttgtcattacctctaaccatatcatgttatttaatttatatcacatgattgaaaatgcattttagcatgaatgactcataacgatttagaattttctaacttacaattagcaaaccatggcagcacaatatggtatttcaaattttcatttagttgcactacttgagaatgagtttagtggtttggttggattgtctaagtgcaaatgttgctgtcatttgtgggaatcaggaaaatataaaatgccatatataatatcctctatattttagttcatagagagtatagtttccattcactcccaaagaaaatatgggtataatccggagcaaataatctggaagcagatatgaatatggatattttttgctggatatgaatacaaatactatgacgttggcgaaagggcttgtagcctagtggttacaagagcatcagtagcatctgaggtcctgggttcgactccccatgggagcgaattttccagaatttaacggcgttgtgctttcagtagtaggcgacgtacccgtcgacagcgaggctcctgtgtagtcttcgaagatgctcacaggggtagggtttgcgtgcgtgtgtttataggggtaattctaaaaaaaaaagaaaagaaaatactatgacgttgtttccagtggatggggatacaaataaagatgcatgcttattgtttttcaaccacatttgcttaagcaatgattggtctattccagtattactattgttggcccctttggaacatataattgatatgccttttgcatgactcttctcaactaaaatgcattagattgcatcatgtctgtggttcacaatatgttacatatgttatctggaaagaatataattaaatttgctacagttctgtgctattgttatgttatttttgcattgttgcatgtggtgtttgggatccaactaaaactaagttggttattttattatgtaatctcaaccgatatacggaatttatatgttgtgtatattcatggttgttaaattgctacattatgttcagtatatatacagttttttttggcttcaattttatgccgtcctttccagctttcccgccgcaccgcgcggggcaccctctagttatatttgttctctgcacttctgctaggctgcttagctaccactagccttttactacccagctgcagataaactaaaacatgtatatatgaacatgaattccctaaccatataaactaaaacgcctccgatgatcgaaccatatcttggtccatcgatttaagtggaaaccaatgatcagttgttttattttatttattatatttatagaacaattactccctcggttctataatataatgtacaaccactttctttatatgttccataatataaggcatgcattcaattaattatgacatcttcttcattaaattattaattttttaaacaattcactctcacattctctaattctattggatgcatgcattatatttattaggatgatccaaactacaagatgataataactatttctttatctttgggttaatgttggttgtgccttatattttggaacggagggagtaatttattagagtcacgtgacaacttaggtgtattttgtcggaacactactactaatagtctcagtttacttgtagtcaactactgttggttgtagcttggtggcatactctacctacctatcagttgttgatgttactcgcggagtatcgttctttatctttggtgctagatgacatgcatgcatgctcattggatatcagctgattcttatattaggtacattgtgcatgaaatgtcttgtaagcaatatgacttattagcgatcggtggatagtggtttgtatgtagaactcgtatacgtggggattagtgaggacatacgattccacatgtggaggggagtatcgtggtgggtatacctgattttttttctttgagatggagatctaatgggtaaaattagtaggtccaccgatttttttttcctaatttattagaacaccatgtggcggtttacgagcgtttgtaggagaccacatggcggcttgggagtttttgtaggaagttaatttaatgaacttttagtatatgatagatagatatagatgtacgtttacaccaggtcacattttctctgctgtttcctaattggttttactttcatgcctagttaattaattatattagctatagggttaaaccaatctgcatgagcacacagacagcaaagtggaggaggggaatagccaacagttgcttgcacaagcacgtggacagaaagacatgcattcgctttaatcacactgctctgaatgtgacatttctgtcatgccgctcatgcatgattagtggccggagtaggagtacacgttactagtggaaggagaaaatcttgttgtcggaggctgccgcgaacgggtcatgtgcacacttaattaccgtgtagtcacgtccaaattccaaaaacatagtaagacgttgaagaggatattgagcaaaattcgcatacattatattaattattatactcacgtcacatgggctggagcctatttatacggaggaggagcaaaggatcggatgaaatcgaccaagatgacgaagatagcaggtgttcttattttagttcttgttatctgtccaactattacttccgctaccgaaacccggggaggtaaatccatccatccatctcatgttttctcacaatctagctgagcttgattctctcttcctaattagtagtaattacttgtgcatgtttgtattgtgttagcgcttctattcctaattaattacttgtgcatgcatgcgctaattaattctgtttgtattgtgttaacaggccgggatgacgaccttagtgacgacaaaatctggacatctctgattgcattccactatcctggattggtggttccgccaatctgcatcgaggacattgcaaagaaatgcgggtggaataatctgacccctgcatgcgtgatggaagagatggacagctgccactaaggcgaccaccggccactctccatcagtctcaggctgacaggctctcagccataataattaataagctgtaataaggggcctaattaatatgtactacttcatgcctctgattttgattgcaagcaccactagccatgcatgcatgtcgtatattctaatagaattaattaatggtaataatataaagctagctagatgtgcctgtgggtttgatttttaatcactaggagtaatagagtagtactcctctatcagaatgtcagggtgcagtcagaaccccttgaatttggacgctacaactagctactacttaattaccgatcgatttggggcaaaaacaactactgtttgccagatcagagagatggtcatccaccatggtgaagaactagcttaacagcggcacaagcacgacctcgtccaagaacccgtgtctagctcgtgtggccggccagccggtcaccatggccgtgcaaatcatatatacaagtcatcgcttgtacaaagttttcattgtttgattaaacaaatctgtacaggacatggtgatacagctggattactcatgatgtacttaaaaaccaacttgcttcaagattgcccatggaacataacatcaaatcacatgccttactttacatttattacctatgaaagtaccttcttgcaatgtttatcagagcataagcccatgttcacatttttacctttgaagtacctccttgtaatgtttatggtagagaaagatccatactatcaaagataagacatatatttttacgtagaaacaatataaatacataattataagtgattgaatttaacatcacatatgctttaaatttctaattaccaggctaattttgcacactccaacatgtccatacatttttcttccaaaacaacttcatgcaggtagcaccctgaactacttctattctcaccctgatcagcactgagatggcctcaggaagtcaggaagcagtgccggcagtagatagggaagccaaacctgccatttgaaattccctggaacttaaggagacagctagtgcacatgaattgcatccaataattaatcagctactacaaaacaatgtgagaattgaagtagaagtacgagaaatataagttaatgaaaggaaactaagtactgtctcacgacatgattcaagataaataagggggataagaaaatcgcaaagaaaaatcggtttggaataaaagattgatttagtagtagcattttgtcaaaacatctttgggcaataggagcatcaccgatttgttatctttctcttttctactgttgcaaatccaacaaagaattgtgaaagcaattataattattttttttttaaaaaaaagatggcgtagagttttctcaaatttttacaagctttacttcacaaagcacatgacttatcagctatagccagaagatcgcatgattgaaactgatttattctagagagtaataggcaatcatagaaccatccatgacatgcaatcggcaaccaacagatgatggtctatcactcctccatatgttcatctccagcatattcgtgtacagcttgtaatgtacagtcaatagtggcaccttttatagcatgtgtacatgccaacctacaaacagaaagatgaaaaggaacattcagcaacgcgcaaaaaaagatccattttttattcatacagtttgaaaacttttgaatttttacctagcataagaatctttttatatgggnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6943 - DNA, 697 bp, Oryza sativa
gacgacgctagagcttgcatcactttgcattaacgatgaaaattcaagttgaattatagggtatgtataatcggcgaacgatcgcgaatcgggcgccatgcacgaccacgtttccatgcagagcaaccgctttagccgaaagcaaacatttcccattccggaactctgcaccgagcctagagtggttcatcctaatagtgagatgggacagcccaaaaaattgatacatacactctatatgcaaaataatgaaatatataaaacttcatgtatagacatataatatgcgtacaaatatagtaaggacatgcgaacaaacttcttatgtacaaatcctgcccatataaatttgaaacaaattcaacggcgtgttaaagtaggctcgagaaagatatatatatagaatttcattacgtcagaaaaaactatacatagcaattttggacggatatattatacaaaaatgtgcatttaaactttgcacggggaaagtatatagctataaacttaggatatgcaaagacaaaaccaaatataaagtgaaatatgtggggtagaggcccatgagcatgctggcagcccactgtaaagaaaaagcccagcttaaaacaagagcccacacatcagtccaaaaggaataaggcctatggtgccttacacaatacttgctcctggtaaaaacataatcctaaattgt

SEQ ID NO: 6944 - DNA, 657 bp, Oryza sativa
agactcggcgcccatcccttctcccgcatgcatatagcgcgcgctgtgtgaaaattttcctaccaggttcttctttgcgcgtgcgcctaccagtgagtcaatccatcacgccatcagcttcatattcacagcatctgtctggtatatcagccatgactcccgccagcttccacagagtaagacatttatttctcaacgtcagcgccagacccatctcctatcctattggacggacattagtcggcgctcctccagcaacaccaccgactcgaatcggccgtcgccccaactcatctacaatcgtccatcgaccgtgccgcatcctccagcacagcctgtctctcgcgtcaaactggagtagcgctccccccggtaatgtgcaggcgacaaaggccccatgcgatgcgaccagcagccgtcgacaaccggaggtgcacagtctctggcattcatagaatcatcgtgcacctcggtcggagtcaatttctgattgttactgctgctcaaatctgcagcttgctattgctgagaactgcttggtggtggtactgaaactttgatgtttgctggctgatgaaaactgatgctcttcactgctaaaaactactgcgtgctagtactcaaaagtcctattacagctactgaaatatcatgctg

SEQ ID NO: 6945 - DNA, 1614 bp, Oryza sativa
accacatcttagctgctggtttgaatggttacatggctactgtgacaaatcttaagagtcctgcgaacaaatggcgatgtggtgcggctccgatttcggtgagattactactgtgcacccccttttggcaaaattagatgagtatgatatgaatgaagggaacacctaacccacaattcttttccctttagtctatgatgaccgtgaagagatggtcacgtggtcctgcggctactcaaatagggaaacctgctgtccatatggctactgtcgacttgaaaggcaaagcattcgagtaagtgtgtacacaatctattaatcccatcttatattcgatcgctgtacagttgctgtcattggtctaaagaagatgcataatctcattgacaataacaaacttgtgtttacaggctattgaggaacaattctaccagcttcttaatcgacgacatctacagaaacccaggaccactccaattcgaaggagcaggtgctgattcaaagcctatttcactgtgcgtggaagatcaagactatatgggcaggatcaagaaactccaggaatacttggagaaggtactttccataatcccaataattgatcgatcttcgtatcgaacaatctgaattcctgtggacaaatggcacatgttggtgtctattctaactgttgttgctgcgcaggtgaaaagcatcgtgaagcctgggtgctcgcaggatgttctcaaggcagcgctgagcgctatgtcatctgtgaccgagacattggcgatcatgacatcgtcttccactggccagggaaccccactctgagtcaaatggattactaaatccacattcgcttgtgtcatctgacatgtggggttagaaacagtgatgttgcaaccccacggctttctttttcgtgttttttctttggagagttttgccatttttgagccggtagcgtgagtctgctattgatgtgtttggttggactggaataataattgttcagacagcgatgttcttaaataaaccaaattttggtaggcaaaaaattacagtttgtgtttttcttccctccttcgagagggttgcactggaggagtaatggctgatggtacataactcgtgaggccaactgcgtggatcggaagagcgctggtgtggaggatcaggaggcaaagctccggccgcaaggtttggccgggaccccattcgctgcgtaagccgaaaggccaaaaaggaaatttctagagtccctgatcgctgataaccgatagtattgggtctgttcggcagccctatacagcggctgtgcagctgctaccattgatcttctataaatttcactgtagcagctggctgccaattagagctaccgaacaggccaattcttttttgttggagaaacgttattttctttcccgatggcgaatccctactgttctcgagatacgttggcaaatgaccatttgataatccttggaatggtaaaacatagagcaggttaaaaatgcaaatattaaaaaattacctaatatcattttttcctatcaaataaataaaatgagtaagtcctcaaacccacgctggttagcccatcaaattgttgagggaaaggagaggacc

SEQ ID NO: 6946 - DNA, 7498 bp, Oryza sativa
  unsure (1)..(7498): unsure at all n locations
nnnnnnnnnnnnnnnnnnnnnnnnnnnnnnnnnnnnnnnnnnnnnnnnnnnnnnnnnnnnnnnnnnnnnnnnnncggatgtgcatcgactacaccgaccttaacaaggcatgtcctaaggatccttaccccctacctggcgcgccagatgacggagcgtggggctcctcaccgggagaccgcgctggcccccctttgccggttcggccggggactctgggtgagactctaagctcccaatctgtggaaggttcgcgagacaggaagcacacaagacgccggcgatgtatacaggttcgggccgctcagaagcgtaataccctactcctgtgttttggtggatttgtgtatgaaggaactacaaagtatgagccagcctctccctcgttctaggttcccaatctggaaaagtctcctcctccctctaagtgggcaaggtcctccttttttatcttaaggggataccacatgcacccttttcataaatggacggagatttgtatagttgccatccgagtcaccttctgatgggacggtccacaactacctccactttcgccgggagcagatgcgacgtggaatcgtggctgtctactgacgacatgaccggtgtcagaccagtcacgtcggtcattcttgtccaccacgtgtcagcttagcaatctatatgttcgtccttcttcacacaacatcttgcctgtaatggttaggatgaagcctggcatatatctgaccagggctaacgtgccatctctgggaggtaacacgctagctccagctggggacaagcgcctagaagccctcgtcctgacgggatggggcgaggcgtgcgtcagatcgcctgtcgccacctaacccgcgatctgaccggtctgtgactggtcacagaccggataaatgagtgcactgcactgcgttacatgcagcgtgacacgctcagccaaaccgcaataaatgtggttaggtgagccccgcttgtctcacctaacccatacacacagagcaaaaaatccacgaggggtcagggcgcctcggccctcggggctgaagcgggtgcggtccgaccccctcggggggactaacaggagggcgaacacattaccctcgggcccgacgtcccccgagggtgccaggccacgtgggcgattgtgtctgcctcaaacctctagtcatgatactcctgatcccatgtcaccgacactcataaccttcagttacaatctccatccattttggtgaactaatagacatgaccagcacctcttcatcctcaactttcctggaaagagcatctgccacctgattatctaccccttttttgtatcgaatcttgtactgcaagcccattaatttgacaaaagctttatgctgcattgatgtgttcaactgctgctctcccagatgtgttaggcttttgtgatcagtttgaatcacaaatgcagagtgcagtaaatatggtctccatttattgactgccaacaatattgccaaacattccttttcataagttgacatggcttgcgctttgacccccaatgctttactaatgaaagccaatggatgaccttgctgcataagcactgcccctatccccttgtcactagcatcaatttccaccacaaattcctgagagaaatctggaagtgctagaactggagctgtggttaaagccttcttgacagactcaaatgcttgctgatgggtttcctcccaaacaaacttgacttcttttttaagcagatttgtaagaggttttgtcatcaggccataaccttgaatgaactttctataataccctgccagaccaaggaatcccctgagttgtttcaaattcttaggaacttgccacatttgtacagccttcagtttctaaggatcagtagccacacctctgaccccaattatgtggcccagatactccaattcctgttgtgcaaaagagcatttacttgccttcataaagagttgatgctgtcttagcagagtgaacacccatctcaaatgctccacatgttcagagagagtcctgctatagattagaatgtcatccacaaatactagcacaaactttctgatggcagcagtgaatatggtgttcattaacccctgaaaggttgctggtgcatttgtaagcccaaatggcatcaccctgaactcatatagaccttgatgagtcctgaaggcagtcttatgttcatcttgttcagccaaccttatctgatggtatcctgaccttagatccagtttagtgaaccatttagcccctgctagttcatctagcaactcatcaaccactggcattggatatttattctttactgttatgtcattgagccccctataatccacacaaaacctccaagagccattcttcttctttaccagcaacattgggaagcaaaaggactagaactggcctgaataattccctgctgtagcatctgtacaacttgttgttctatctcatccttctgctgaggggcatacctataaggtttcttagtaaccgatttagctgttggaagcagtggtatgtgatggtgaaactggcggtgtggaggcagctcagttggtttcttgaacctatcttgaaactccttcactacaagctcaactgctgctggtaactcttgcttaatatcaggaacttcctctattgcacaaagttgcaccatctgtgatattgccccatctttatgcaagcccttcaactgcttaacagatagcattgtggtctgggagaggtttggtttaactccatttagtgacaccctatctcccatatatgtgaatctgatcctcttccttctccaatctatccacatgggactgaatgattctaaccattccatacccagaatcatgtcatatccccccaaattcagtaccttaaaatcaatggtgaaagtatgcccctgacaccaccattccacaccagatacaagctgattgcactgcattttcccaccatcagcaatggtcacctgagttgctggcacagtttcacactgaagtcccaacttgttcaccacattctctgctaaaaagttgctggaactacctgaatctagcagtatcagcagttgttgtttctgtatcatcccatgaaatcgaatcgtcttccttcccatggttccagccacagcaaactcagacaaaactagctcttcatcacttttatgttcttcttcatcatcaccttgggaaccatcctcctgcaattggagcacttcaagcaattcttccaaaacatgtaattgtacagacttaggacacttgtgccctaggccatacttttctccacacttgaagcactctcccctagctctccttgctgccttcagtgtgtcaaatctttcctcccacttgggtttctcctcaggcttcttagcctcctctggtgatgctcccagaatccctttgccttgataaacaggtttaatcaccggcttgtaagcatccttgtatccttctttggagtagttcttcctgctactctccagcaataattcctcctgcgtttttgccaaagataatgtcagatcaaccgttcttggtttgtgtaactttatagttgttttgatctcagtttttaaaccccccatgaatctagtaacaaaaaatgtctcatcatatctcttgttgtaaactaagaccctatgcatcaactcctcaaatttagtataatactcatcaactcccccaacttgactcaacccttctaactcctctaaatgttgttggtacttgtccttaccaaacttcccatgcactactacacacaattctggccagctctctacacagtgcaactcctcataggtttgtaaccataacgctgcattccctacaaagtggagtgtggcaaaggatgaccaagtttcataaggaacctggtacatactgaaatacttctcactattagttttccatagctttgggttgtctccatcaaattttgggaaatcagttttgggtaacctagatccactagaccttccaggactctgcaatcctcccatccctttttcagagcaatcccccaaatcaaaatgaactggcgagttgtgaaattgcagcttacccttgaccagggcgcgcccctggtccactggggtaccagttgcagctccctggtggttcaaagctgcgccgtgcccaacgggcggaatagtcaccggcatagttgtcgccggcgcctttgcctccagcgtggtcacccgcgaggcaacttgttctacagcttgacgcaggtccttgatgccttcatccaccgccggaatccacttctccataccttgtagggatcccaggatggagttgaggcttgtggtgagctccgccaccctcgtcgtcagcgattcaacctctccttccaccgccgccatgcgctccgtcaaggttggattcgccttcttccttgccaagctgccctaaaatccactgctctgataccagatttgtcacgaatcagtgagatctcccttggcgaaacgccaaactaggcacggatcgagcaactcgggaggaagaaaagaggaactgagcaagaacagagtggggaattgacttggagaggaggttggtgatattgtattttcttattcgttgcctacgaccagcgcttcggcaaagtatataaaggttccagctagtacacagctcacagctgggccttcactcacgcaccagccaccttacaaggccatcaggcccaaatcccaaatagaatagtgaagccaagcaataaaagactcctgaagtctaacacagcaatgttagcaagatgctccagcctccaggtatattaaatcaaacttcttcttacccaacatacatatatgtgtatatgtccattggcattgcatggcctatgcacgaacacgtataaggtcgtcatcaatggcggcgcccacgccaccgtgcatgcatgcttgcgtctgatgcgtgtttccaatgcaggagctgctggcgcggcagcaaggcgacgcggtgagcagcctggtgtatgaggcgaacgaccggatgcgggacccagtctacggctgcgtcggggccatctccttcatgcagaaccaggtgtcacagctacagatgcagctcgccgtcgcacagggcgagatcctctgcatccaaatgcagcaccgcgatggcaatgagaacaagaagaatgtgagagaggaggaagagagagaagatggaaaaaaagagagaaggtgctgacgtggacactgacatgtggggcccatatggggacccatactgactcagctgccacgttagacaaaaccggggtcaaaactaccgaaggatctaaagtgaatggttttgtaagttgaaggatgtcatatatttggttttgcggttggggatgattttgtatctcgatgacaagttgagggaccttgggtgtacttttttcgcgagttgtgggccctctcgtagcgttgcaggccaagctgaacgttttggtgggctccagtttataatgggccgtaatcacttttgggcctccatctggcctattggcatttgacgtcagattcggccctgtcggttgccatgtgctgcacaacagctccattagttttttttgacgaatcggcacaacagctccatcagtagtatagatggccatgtgggccgcccggcacggcacggcccaggcccggccgtgcctgggccgaggcttgtcgggccggcacggcccgaccgacgcaccgggccgtgccgtgccagcccacgtgccgcactcacagcccaggcacggcccaacacgcctcgggccgtaccgggccggcccgaaggcacgatgggccatcgtgcttttcctcagaataagtctaaattttctccctcctattgggctgtgacattgtatagctaaaaaaagtctattttacctccctcttctttgtgctgtggtatataaatagctaaaataagtctatttaaggtccctattctttagacattgacatttatatgtctatttttagtccctatactttgtgtaccgggcctggcctgccagcccatcgtgccgggtcggcccgaccgtgccgggccagcccagcgtgctggtggggaggcccaggcacgacccgacagtcgggccgggccggcacgggcccgacccaagtcgggccgtgccgtgcttgggccgggccaaaaaggcgtgccgtgggccgggccttcgggcctcgggccttatggccaactataatcagtagcttaccttagctgtactcttttcggtcttcagtcttcagggagaacatcggctctaggtcgtcaacacacttccgtgtttccggaagaacacaataggtgtaaccgtgtaagagcaagtttaatagtgtagccaaatactatctctaattcatctatagccaatctagtagtttattcatacaatatttacatactacactattaatatctagtcccacctatcataaacacactgcgttttggagtccgtgctataactggctacaaatttgtagcccgctgctcttctctctccttatttatctctttaaaatatctttgcagctggcttatatcctgctattgtacctgctctaagagcaaagtatatactactaatcagcagcttaaaacgtactcctactcagtgctgcatgtactcaaatgccattagactcaaaaagtccaaaagtaaaccatccccttttctttaattatacgcacaccttgtggctcgtgctccaaacaaaacgtgctactcctgcttttcactcatcggcccaacacggacacaaaaaggcaaaaacgacatggcgccacgccactcacccacacggccgtcagtcccagcccccagtccaccacacgtgtccccttcactcacgccccctttcccctccatgcgaagccgtgtctccttcacacacacacacacgcacgcacggtcgcggtcgtaggtgagcggccgcgcatgccacgccccgtccgccctcgtgccgagccgcgagattccgcagggcgcaccggcgcacgtacgaccaactccgtctcccgtggtagcctcggcatgagaatacgattatttcctcgcaatctcgcatcgcgcacgcgcgcgcgccatgtgttcggctccggccgtttcgccggctcacggcgtacctaaccgcgcgcgcgcggccaccatcgatcgatcgcgactttgcggatcgcgcgagcccccgtgcctgcgttgcgtgcggctcgatcgatcggcaggtgcgtggcatgcggtacgtgtggctctcctgtgacctcaagctcaacggtttgactaatcgatccaagactctaatttatgtacggacggatttttccatcgatctgcttgaaaaaagttctggaatgcatgcattgtacgtcaagagggagattgtcaaggatatgatctgacgtgtgttcttgctgtggtgttacgtgttaacgttcgttgagctgaatatatgtatgcatgaaaactgaatcgagag

SEQ ID NO: 6947 - DNA, 18227 bp, Oryza sativa
tcctgccaactcgcatgtttatggttaactgctgcgcttaacccctacaagtccactcactctgctggacgaaacatcactattctatacgtaatctctacgcagttacgtagaactgagcagggcgcacgcacggacgcatgcccactaattaattcactcatgtctactagtagtaacactgtcagcagctgctgtttgatctgcttggtcgatgacccaaccaatcacgcggcgaaatttggcgtgcaggctggccacccgtttcacattttacacggacacgtcacactgccccccctggcttcactggctgtttgcttgtccgtaccggcttcacatcgcgtgttaattagtggagtagcagcttaattaagctactccccgcgcatgtcgctctcgcgaaaaggctcgattcaaacctaccttcctgcctcgttcctctcccccgacacccgcgcgcgagagctatatataccccagtttgcttcgcttgctgccacttgaccagcagcagcagcggcagccggcagcggcagcatcaagcagagtatagctcgcgatccaggaggccgtacagaatcgatcgcaattcacacacgcacgtaaaggagatcgaagattcgaagagagatggagggttgtgcgtcttcgccggagagctacgtgaggatagggaggaggtggcggaggcggcggccgccggcgagggggttccggctgtgcccgaggaaccggttctcggtgcggcggctgcgggccaagctgctcacgttcctcggcctcgtcggccggtacgtgcgccagctgctggcggtgaggcggccgcggtcgtcgtcgtcgtcttcgtcgtcggctggaggcggctgctcacggagcagcagcacgaggttcctcgtcggcggcgggaagcatcacgtcgacggcgggcggcggacagtgccgccgtcgttcatgcggtccaactcgttctacgcgcaggcgatcgccgactgcctcgagttcatcaagcggaactcagtcccggtcgaggactacgccagctccagcggcaggagatcatcggtagacctgacaacaatctgatcaaagtctggaatggctgcaattttttttggaacaaagatacagattagttaaaaggttgtaaatgtgtgcttcgaatgaagtctaaattaagatgtgaaactagtttttggattgacgacactcatgtcttaatacacatgaggatgtaattaacagggcgtgaaatgtgagccgcataatctgaatttttttgccatgctcattggttcaagatagatattaacacttgttttccaactgccatctgtattagagtagaccttaattttgtgtgacaaaatttttcttccacgaacggccgtctagccgtccaggtccatgggattttattcgatagaaaaggacggggcaagaataatacaactgaatattcaaatacgtgttaacgtttcagactgttacagatatactttccatgcagcgatttccttcaaaaaaaaaaaactttccatgcagcgtgcatgctctctctttttttaatggtgcatgccaatttctttgttctgccgtgtgagtgtactccattttcttctgctgaaagtaagtgtcgatggagagtcagtttgacgatatctgtctttttttttggcaaaaaaattaatgcatgcccaaatggatggggttaatttctcaccaattacagaaagtcagaaacacatagctagtctggccaaacaaatctttgcgtctcacctgttactgatttttcttatcggcttaatttgtttgtcactagctgttctgtggacaatgctggtttatctttgtcaactagttagtgaaagcacgggagcagcggacagccggacaccgacactgctatcgatcaggtttttctttgtctgaaagtgccattgcatcatcctgaaagaactgcatttaaaattttcaatgatgtagcgtgaataaatggtaaaaatgctgaagctgagacaaggctgggtcattagccaaaagcccacgggtagtagtagaaaagcccgttgctacaattagtatcgtggatttggtcgagagaaaaatctgctcatgggccagcggctagtgttgtttattctggtccgtttgaacgaaacgctgcctctgaattttttgtttacagcaaagggatcgaaagcgagatttgatcggctgcatgaacaaaaaggattaaagcagtgggcagtcggcagcatgttcctgtgctcgtgtctctcctgcctgaatcctgaaaagctcgacaggtaatgcagcaatggaggaggacatcatcatcaattcatcatcattagaacgaccaaatccaaataaacatggcgcacgtactggccattatcttaacgaaactgcacggagagtggaagtagtgatgggaagagagtgattcactttggctgtgtcacgcagcggaagtttcgatcgatctgtttgggtttccatccgaaagataaaagatggaagccactatttctcgccatcatctgaatgaagcccttctttttttggcgggcctcatctgaatgaagctggtcggaaggagcaagatttgcagatccacgtatgtgcaaatcgcaccacgaatcctaatactccgacatgattttgcttgtgtcgtcacaccacaaactctatttttgagcttagtttgttaacatcacttgatcgctctcgcttgcgatctgtgaatctagtgcgtgcatactgtgcagttgaaaagtttgccgtcaagtgagcgtagctcaaatccaactcagatcgaagttataaagttgacacatatgctcgcttttacggttaattattctttcaacagtagacaatatagccgttgatagtaatgcactcgcaacaacttcatgaaactcaagatatgttaatccagatttctaaatgtgctaatagagataaaatgtgtgttcatatggagatatatcagttcagtttttttggaggtgtttataggagtacggcgcgtttaaaagtgtggtatgcatcgtgttgtgagtgtttgtgtgtttctttaaaaaaaaattgccatttgtcaattattgtggattttctgcaacttgttgtccaaagaaaaagaaaatagtttcggtcaacaactcaacatccatctgggggtatgaccgaccgagcgcggtggccgttgattggctcgtcgcctcctcccttctcggtctgacggtctgaccagtgccgggtaggaagcgtaattttgaggagagactccgacccgcgccgccgccgccgcagccaagccatggagggatccgccggggcgccgctccgcacgcgcgtgtgcatcatcgggagcgggccgtcggcgcacacggcggcgatctacgccgcccgcgcggagctcaagcccgtgctcttcgagggctggctcgccaacgacatcgcggcggggggccagctcaccaccaccaccgacgtcgagaacttcccggggttccccgaggggatcctcggcggcgagctcatggatcggtgccgcgcccagtccctccggttcggcaccagcatcatctccgagaccgtcaccgcggtcgacttctccgcccgccccttccgcgtcgcctccgactccaccaccgtgctcgccgacgccgtcgtcgtcgccaccggcgccgtcgcccggcgactccacttcgccggctccgacgcctactggaaccgcggcatctccgcctgcgccgtctgcgacggggccgccccaatcttcaggaacaaacccatcgccgtcatcggcggcggcgactccgccatggaggagtccaacttcctcaccaagtacggctcccatgtgtacatcatccaccgccgcaacaccttccgcgcctccaagatcatgcaggccagggcgttgtcaaaccccaagatccaggttttctgggactctgaggtcgtcgaggcctacggcggcgagggtggaggtccattggctggtgtcaaggtgaagaacttggttactgggaagatctccgaccttcaggtgtccggtctcttcttcgccatcggacatgaaccggcgacgaagtttctcggcgggcagcttgagctcgatgctgatgggtatgtggccaccaagccaggctccacgcacaccagtgtgaagggggtctttgctgctggggatgtgcaggacaagaagtatcgccaggctattactgccgctggatcaggtttgtgaattgatgatttttcaggttacctgtgattaatttttttctgcactttcttagagatcagtcgcttcatgggttgctatttgctagtgcgaattgcaatagaaattgttcagggcttgagtatgtagtgagcgaatgatgatggtcaaaattagaacctttttaagctatcatagagttaacgtgtttgagtttctgaaataagtgctttcattatgtatctagcatagttgattagatatactaactaccttttgggcatgttgaatgcgtgctctgtttccaagctaggattgggtgtattagtcctaaaaaaagttaggtgtatttgaggccggttaatgcttccaaagtaccatgtaggttcatatgtttgactaataagtagctggtagttaatcatggaatttgttgaactgggataagtgactttcaagctattctgggattttcatagttaaggcattccaaatattgttaggaataaaaaaaagtgctacttcccatttagtatagaagagtgcatttcaatttctacactacaaagtacggactgtatttttgcaaaaaaatcaaaaacagaagtatggtcagtacatcactctgtcactcctgtgatgtgagttaactttgttaagcgtttacatgctaactgatgttgcagcaagtatttttactagagtgcaagttacattttcatgtggttagagggcacatgcaaaattctccatgctcaaacttcaataattggtcatgtttcgccattctcccttcttgatcctgtcagagatggagtttgaacttattattgcataaaagaatgaattggaataaacagagactgggttcactttccctgcgtgctgtgaacatgtgttccggatgggcataaacaaagtaaactaatatgttaccaagtatggacttgctgaaataaattgacctttttgatggacaacatagtggaggaataagcagagactgggttcactttccatgcatgctctgtaaacttgagttccggatggtcataaacaaagtactccctcgatccctaaatgtttgacgccgttgacttttttaaacatgtttgaccgttcgtcttattcaaaaaatttaagtaattattaattcttttcctatcatttgattcattgttaaatatacttttatatatacatatagttttacatatttaacaaaagtttttgaataagatgaacggtcaaacatgttgtaaaaagttaacggcgtcaaacatttagggaaggagggagtaataatgttaccaagtatggtcttggtcagaaacaatccaaattggcatttttgatggacacagtcataggagactgattttaatcctgatgtctggttgtttagcaaaaattggaatcagggaataaggccagtactgctgatgtagaatgaaagcagtatgccatttctatatacttcagaaagaactaccttgttacctgtcgtgtgaaaggaaaaagcctgatgataagattttcatctcagaagcagcatacagagtttttcctttgtgattttcatgttggttgatacatggtcagtatggttagtacatgatgaagccttattattattactattattttgtgctagcttgtttcaggagtttgatccaatagacatgcacttcaaaaaaagagagaaattgtctatatgcatgactctgtcgacaagatcaattctaactcatcattgatggctactgctgagcataaaatttttgtggcagacttctaactcatcattgtatccagggtgcatggctgctttggacgcggagcactatctgcaggaggtcggtgcacaggagggcaaggccgattgactatctcaggaggaagcgaccaccagcgtttcaagaagtccaacgttgtcgctgctgaaagctacactctgaacgtttatgccatgggctgttctgacttctgaatgcttctaccggattttcctgccccttattagcgtcgtattatttgatgtgctggagatttatctgtatttacgctgaagacgacgtattgcttgcgggtatccgcattttctgcatttgcttatgattgagttattgtgacatttggcgtttttagtaccaaactagcaaggaattgtgtattctgaagaccattccgatcaatgctactgatatggtggatatcactattgttttcctggaaagaggagtaattagaagttcactagcaggttgctaaccctgagagaatacagagacatgtatgtagcggtgtacacctacttgcccagccagcctatgttacaggggctcgcaggcagggcgcccagcccatatcatatcgcggcctctaggttattgccgggctatgtgaagtctcagcagtgacaacgagaactttatctgttactactaggttaaagccacgtacttattctttacgtgttttggtgaggcgtaccgcacctgcaacgttaactctgcgacatatattgatgctatgtggtgtttgcgacatacttcccctttttcatattataagactttttaacattgcccacattcatatagatgttaatgaatatatatgtatatgtatatgtatatatatatatatgtatatatatatgtatatgtatatatgtatatatatatatgtatgtctagatttataaatatttatataaatatggataatactagaaagttttataatataaaatggagggattatattgatgctacgtggtgtttgctcataacatagcacgcacgagaggcatactggcatagctccacgtcttggcacggcaagcaccgcggaccgcgcgcggtaagacgaccacggctgcagctggccgctgcaccccgcgccgacatgctttgcagtcgaggcatctgcggccaccgccacggcatgttgccgccgcgcggaagccggcgcggcgcaacgtaccatggtgggtctcacctggctgcagctgtgtacaaatctctccttccctttctcctcccaccctcctctcgttgccggcaatggggctcctccatgtcgatgcaacgtgcgaggaatcggccgctagatcaccagctgcaaagcaatcggcaaactcgcgttcggccagacatggagaggatgcagtcgatctcagcgtttacggcattcttcagatgcatctagctcccctttgttacggcggattttgaccgtgttgaccgacagtaaacacgattggctattaatggaaaaccgacggcgatgacatttctttaggaaagatggatacctccataccctaatagaagagatattcactttttcttttaacatttaaccacacgttttattaaaaaaattatacaaatataaaataaaaagttatatttaaaatactttggataataaaggataataaagtaagtcacaaataaaataaataataattttaattttttttgaataagacgaatgatcaaataatacaagcaagatgttaaaataccttatattaggggacagagggagtacaatggtatggtattttttagacgctcgccgatgacatttattagagcttaaaaaggaagtatgaaaaaaaaaattgataacttagtacgcggctttgagcccttaatacaacagttttgcatagtgattagcccttaatacagttgggaaatggatcgtagcaagcgaatgtgtccccagagcaattctgttcctcagtgcctgtctctgtttcttggtcgacgggtacctcaagggccttggattcttgcccttgcacttttcacacgccatcctcttatacaggaatatatcctcaaggttcaccgctgcatccatgacaagtctgatatacctaatcaagttttcgtcgttcgactgaaagccaaacatgactaacgttgacaggctgtggttcttgaaatctgacgcagacgcattccaatccgcgttcttattctcgctgtatgagtaggctttcctcctctcatcatccgtctctatttcgcagagatgatcccatacctgcaggccgcaaaacatatctcagaaattgcagtcaatgcaaaatgtaaaacagtggcgtagttaaaatttaaattaaaagtagtccatctatatgtaatatgtcaattaaaagggtggtccactatacaatttttactatattaaccagcacatatactataatttcaaatttttagatggtccgtgaaccacggtgccacctagctggctacgcccctgatgtaaaaggcttagcagataatcaagcatcagttgcaggtgcttaccgccacgtatagctccctcaaggagggtgcagcctcaagaaagaacattgtccacgagggatcatacccttcaggaagatcaactaaattcacaacccttagtttgtggaatgcagatgcaagtgcttttgggccttctggttgaacccaaatatgcaacaaggaaaagaacacatgagtacatgacatggtacaaacatacaagtaaagccatcagagcagaagaataatcctttttagatggaactataagaataacattgatataccttttcactattaaaatctaaagtcagatctcttatagagatattgctcagaaattcgctcaacttcaccgcattgtgccaactaagaccaacattggtgagggttacagactccagtaatggaacatgtccaaaagaaagtggatcttggaaagctatccaaccaccaaagatcatccgtgtgagttttgggagtgaactaagtttgattattccaaaacggcaattaataatactaagttcactgagttgcaagtgttcaacttccaaaaaagtggaaattcctgagctgcagttatacaaacgcaaatagtttaatcgcttgcaagtgttgaggacatcaatgatttctggttcaccaaatctcaaattctcaagttggagtcctgtgagacctccgaatgtatttggacaataactgaagaacaacgcaaaacgtctcccatagacgatgaaatcatcgtcaatgcactgattgtcatctttctctgtcaaaattgtaaattcaatcatctcaactttttgggttgccataacgtggccaacagtgtgtccaaaggatatgcagtcatcgtctctcaagtagaatctcatggataggaggctgatagtgtgctcatttgacttcctgcatgccaatatgctcttcgttgccttaaccactgttgcattgatccgacccagttcatcatcagagaagctggacatgctcttgggatcaaagtcagaaacatctattgtaagatgtgatatcatagtggggagtggcctccaacgctttgagaggaggcttgttcttgcagcatctcggacattgagtccatcaaggatggctagcaaaatatcatctggcaactggctaatcctgtcttgtaggtcagcattctgcatttggtgcgaaaacattaagcaaacttaaagatgaaatctgaaataccgaccacagtcaaagaagggaactatatgaccgcagaaaaattcgaaggaaaagttggaggattcatggacgggggagggggaagaatgacgtagatttacaaaataaaacgcttacggaagtaatgtggtcttgcttgatggttggtgtagtttcaatgggcgctaacacgcttagataccctcccttgttagccattgcagattgatgataaaccgaataaaacaggtcaccggacctgaaaaacgacacgtttcattgattgaaattggattgtgtctttccgtattcaaaacgaaattaagtaaatactatactttgtcaatttaggtgggaaaaccggaggtatgtgattccaaatagatcgctcaggagacctcaatcagcaattcagcatacagaaaaaaaaacagagagatacttaccgccgacgagaggcagcaattaggtagaagagagagtgaaaattaaaaaaacaggcgccggatacgttggattgatcttaaacgattctaccttgcctcgattcaactgaatcaaatcgataatgtcgaaatttgggttggagactgttactcggtactagcagaggtagagggacagatggcctgatttagcttggagaggtggtcggcgaccaggtacaaaggccccgatttagcttagagagggaaggagggaaggtggcggactagcggcggcgagtagcggccgtcggcgaccggagagagcaagacgatcgttctggcacactcacatctaaacaaatttatgaggcaaaatttcctgcaggtattacctcgccaaattggaagttcacctggagcagcagagcactgttgaaggtaaaactgtttgcttggctgctggttcgaaatagactgtccacaatgaaaaatctcttgaagaagaagattgttcagtcagcgtcttgcgtgatctgcaacagtggcgacgagacggcaaaccatttgtgcttcacttgcccttttgtggtcagtttctggacaaatattggagtgcaaccctcaatccaagaccttcagttcttctaccggctaagtcacacgcagcttctgccggcaaagcactgccatgtcttctacctcctctgcttttgggtgctatggaatcataggcatgatgtggttttcagggggcaacaaccttctgtagctgcatgccttcaacgagggataagcgaggcaggtttttggggacaaacactagcggtgcagaatagatccgtaatagatgattggaaacacattttctcttcctgtctacaaactctaaatccattgtaacaaaactatttttctcccttttatgcaatgacaattcagatgtttagtcaaaaaaaaaagaaaagaaaaaagctcggccctagggttggtaaagcaacgaagccctctaccattcaccccatgggccatgggcacaaaatctgttgtccctattatggaccggtttcgctcgatttttttatttttatattactagcaatagtgcccgtgcgttgcaacgggaaaaacgccgtttgatagtgtcaccctaaaaacctcaaatttgtaaaaatcaagtataatttgatatattaacaaataggtagaaccgagtctaatttgatcaattagcataggatttaggatttagttttagatttatttttcaagcctacttaagagtttatccgacggactttaatttgaaaaatgtgagccacattgtttgatcaaatttgctttcggcccaggtcttcccaagccagcccaaacttgggctggcccatcttcggcgagttgagtccattcgatggcccgcaagctgagcagctgagcgcggcccacatatgcggggacggtccgatgcacttccgtggcccattaggcgcagcgtaatcaacggcgacgacggcccgacactgggcgaatctgagccgtctgatctgatggacggctccaatcgtcccccccccggatgaagcgccgaccgaggagaggggcaaaaccctagctcccaaattcctgtgtgctgatcccatttctcttccgcgacgagagagcggaacgacagtggtccggcaagctggtgcgcgcgtgcagcgatgaccgctgagtggctcctgcttcgccggctggggggcgcacacgagggcgcgcaaagccatgccatgacgtcagcggtccggcaaggtgggcgtgcaaacggcgacaagcgccgagcggcctgacctcatcggcggtaggggcgacgccaagccgacgcttcccgtcttcggcaaaggacggtggaggggtgctccaggacagcgcgcatgcagggaacccgacacgactgcgaggaggtgaaggtgcggcagtgccacttcccggaaagctccaatgagctcaggggcttcaagtccggtaagtaacccggacccttggcttaattgatttggatttgactcttatggttcttacccgaaattagggttcttcgaatttagagaattttgtcgggaaatttcaatatattttattccctcttttcgagttaggggagtttcaatatcgtttatcctcttttaattttgggaacttcaatctagtttatccctctgcttaattttgttttttttctttggctggtgtttcatcgcgcgggcggggatggagggtgctgctcgtccccttggaaagattgagattaagataagataagatttttacggacaatggaagtaaattgaatcgaactttcttttttctgttttaatgtttttttcgcccttctttcgttattacggacaacggaaacgtttttaatttttttaagtagtagagatagagaaaatagagatatagtaccatgtcaaatataataggattcgatttttttactgcaccacatataattctttttttttagatttgttttttttttctcttttttttaccgcatccacgcggattcgttttttttggccggtctttttttcacctggttttttttgcgccccttttttaaggaatcggacagattccttttttatttcttttctcccttttttttaccacggaatcggattcgtttttcctttcttttttttgcccttttttgatgggacagatttggtttttcttttcttttttgcccgttttttgtccggtttttttagcccgttttgttttggatcggatggattttttcgtctggtttttttttacggacgatggaagcacatcttattttttaagtagtagagatagagatagagattttgttgaaatatttaaaaaataaatttttgttttgaaaatttacaaatttagaggtctcacgtcctttaaaaaaaaagcccttccagagagatctaaatgtaatttattttatttgtatccaaattcttttcactggttttaattgttttatttaagaaatactaatgcttatttgatactccaaatgatttgaaatgaaaaggtaatacactacaaagttgtagatctcaatgatatcaataactcttctataaagtttattttcatctgaagtgatatcatagtattttttttattatttgtggcactatctttaagctacttgcgtcaccacgccacaactaatctaaattatagcaatgttatgcattaaacaaacatccccttcacgataccatacaaagcacgccgcgccgcgctgtcataaacaagacaacagcaacactagcaaagaagaagaagggaaggtagtaccaacttaccgggttgacgattggcgtccacgggaagaagcgaaggacccgactagagatggcaatgggtacccggtccccggtcccccgtggagaattctcccattatgtgatggtgatggtatcaattgtgtctccatggggaatcaaatggagagaaagtagtctccgtcgggtctggcgggggcgggtttagttcaccgtcccccgtccccgccctccgtggaggcccgatataaaagtatgtgtgtagtaatatcctgtgcatttggcccatatggcccataaaaaccaggcccaaagcatagagtatataaagcagttgtgtaaccctaaccattccaatccttatccccttcgtccccattccccagtccacacgccaccgtccgccccgctcgtcccaatccccacgccgccacgcgccacgccaccgtccgtcggccacagcggctaagcggcgccgactcccgatctcgcacccgcacgcgcagggccgccgcgcccgccgtgccggcgaccgcgccagcgccgggccgccgcgcccgccgtgtcggtgaccgcaccagcgccgagccgcccggtcccaggtggcccagctcccagctcccgagccccgtggccaggtcccagcgccacgccgcgccgtcccgttcccttcactcgcagcctcccaggtccgaggacgccgtggactcggcaccgaccactggacgtcggctccttcctcttccctctgtcaatatctgatccgtcatgtaggcttatttgttttgctgatggtggatgtaggtgaaggcttcggtggcaagaaaggggaaaacgacgagtccacacgacgaccagccgttcgagtccaccatggcttcgccttcaccactgctaagctccgacgacgatgcaaggtgagcacatctagctgtcctactcccaactcagtacccctccctagacgcctaactacagtaccatatccccctccccctccactaaattcctcttccatggctacatcgtgtctcgttgagtcactaactcacgttcggcgatccacaataagggacgccaatgcggagttggaccagccatcgcatgctataagcgctgcagctgcagccacacctgccgttgtgcctgttgctggatctgccattgttcatgtgggcagatctggttcctccaactccggtgcaaaggcctgcagtcggccgccgcaaccacctataaaaaggaccaccactaggcaaaaagccatcttgcaggagcaccttctgcttcgactaaggcaggagctccttctgctccaagaactccagaagcttcatcttccaccaacggcgtgcgcttattcaaatccatggggttcgatttcacgctaaccctttatatattgtagcttcacttttgtaatcctaagttcctaacaatttagcatgtgcaatttattaatttgcagcttgcttgattttcttagatattgaatgttgtatttagagtatctgtagaaaattagatatctttacatgtatattgtatggttgtacattgaatgttgttaagttataaatatgttatgaacttaagtttttgaaattaaaggaatctgaatctgtgtagtgtagctcataaaaattttattattctataggctgtagcagatttcagtatgctttatgtgtagagattcttcatttcaagttttccaagattattctataggctgaaagatatattgatctatatttatttgtcaattgtcagatttaccacgaattcaactgctggtactggttgtgggagtagcagccagcaagaatcacaatcacttccaccacaagcagagtctgttaatgattctgagccaatacaagttgaagatgatgagccagaagatgattctgagaattttggcacaaagaggaagcttacttctgttgtttggaaggatttcaagaaagtcaaagtctgtggtgatgtcaagactgaatgccttcattgccacaagcggcttggagggaagagcagcaatgggacttcacatctacatgaccatttgaaaatttgcacattgagaaagatcaagatggggccaaagacacttgcacaatcttcattgaggttcaatattacatgagtatcctttatctattgttgaccatattggctttcgaagatttgtgctcctagtgaagaagaatgggcttttgctagtgaggtagttgataggctcaagttgtttaatgacatcactgcagtattttctggcacaaattatgtgacttccaatattcaactacttaaaatctgtaggctaaagagcaaattaggaagtgggctgtttgtggtgattctactatagaggaaatgtcagttgaaatgattcaaaagtttgataagtactggaaagatattcaagggccaatggggttggccaccattcttgatcctaggtttaagattgactatctccttgggttcattgaaaccatcactggtcagtcaagtgaagagtgtgcaacgaaagttgctgaggtgaaagacactctatatgatttgatggagtatgaagtggaagatgatgaggataacacggaatcttcagctcctccacttgtcaattctgatttattgtcttcaatcacagcacgtgttactagtaggacaccagcagcaatacgcgttaaatcagagctagacaggtacctagaggatgagttggtttcaattaatacagaaaactttaagattcttgattggtggaaagtggttgggacaagctttcctacattgaggaaggtagcacgagatatatttgctattcctgttagcactgttgcatctgaatctgcatttagcacaagtggaagggttcttagtgagcatcgtagccggcttacttcagaactcttggaggccttaatgtgctcacaagattggctgcaaaacaagtatcgaggtacatatgctgttttattcatacatcatgcttagcatagattttacaatgcaatggatgcaaaataattcttataattgttatcttgtagctgataacgaagaagcagcaagcttttggagttgccttcaagatatccaagatcggattgagctattctttcaacaacttaaaattagcaatcaaactcctaccgccattatttgttatatccttataaaatctatatacctaattaaaaaatatgtaaggattctgggcgtttttttcgtctgtcccacacgtgtagctaaatccgttttaatctgattaatagacggatcggacagttttcaatctactccaaaaccgaggtttatatactatatgtaagttccatgtaatctcgtagcacatatagtaatctgcctacatggttaacatcgaaagttttcatcccggcgaccagggttcgattcccaccttcctctcccgcattttttcacctattattgctagcactatgcctatgggctaatgggcccctcctagaataagtctactttccctccctcgtgtcaaatctcccgcattttttcacctattattgctggcactatgtctatgggcccatcctagaataagtctactttccttccctcgtgtcaaatcatattaccatgcacatcccattgctgaaaaataaaaagtattgcacctctttcttcaacagattgcttctgaaatcttataatgaaccattttttaattcgaaattattgattctgaaatcttataatgaaccattttttaattcgaaaagtaaagataatcatattatatacacaaaaatatatataaatatatgcttaccgatatataggatgtaatacatattcaagtatacaaaattaatgccctttctttccatgaaagaaacaaaaggttgctgcacatgcaaaggacccacggtcactttttatggtgttaatatgtacctaataataaaaaagtatgtaaggattcgtccgtccttacctaaattttttcatccgcaacatcctgtgtccaacactggccgtgccaaagaggcaagccgagcggatggagctagcgaacaaggctgagggttgaaaagaaatgaatgggactttcagcctaaaaccaaggagtattcaactaaaaaaaccgagcaagctggataatgtatatcaattttaaaatatttttacccgttgcaacgcacgggcattttttttctagtacttgactaattgaatatcttttgctacttctttaatttagggacttgctcttgtttgaagccatgaatgtatggacatgcactgttctcgcaatgattttggatgtttgtaacccctgttatgtgtcatgataaacttgtaaaccatggcaatgcttttggatatttggcacaaaagacctactccgactatggttttgtgtatgcctggacaacatgtgttgctgctgcaatgtggtgataactaatgagtgatgactgatgaatgatgaatgatcatgtattattgtgttgttgcttaatctgggaatatgatggatattgtattcttgggcacacttttgttgcactgcttgttgctgcactgttgttgtaagtgatgaattgatgatgtgcatttgtgaactgatgatgtgcatttgcgaatttgtgaacttgtgttcttgtagttgttgttgatgtgctgaaattgatggctagaattgttattttgagtgttaatcttttgt

SEQ ID NO: 6948 - DNA, 35526 bp, Oryza sativa
attaggtaaaaaaaaattttgccgaaacatacacgtactcgatcggataggagttccgactccaaaatctaaacaaaattggtagttccatctagtagtgccttgcctagtttacagatgctttactacgttgttattagttagtagatttagtacaatcttaatggatggctctgtctctctccccctgtgcatgcacgcgcgcttttttttgagagaaaacaccaggacatgtttgcgcctgagaaaccctgtggacatttcacgaaccaaacgacctatgcagcctagccagcctaggaaaatgttcatttgagctccttcattttattgtcaagtttcaaaaccattcctgagccggaatacaagatataacacattcttaattatacaaaatcggatcacattggatctcaaaacagtattgctttcgatatcatccctgtacccactcccgtgcaggtaacgggtacccatacccatataattgactcataccatttatagttttgttctataattagctatttttgaaccgtaacccatcaataattcttctggcaacaatgctattaacattagcgctcaaagtcgagtaaaaaaaatctacaaccatattacataatcaagaaatcaaataataatttcatataactagaatagaacttaagataagaaagaagttttatgttactcatggatttaggcttaatctacaggttttttcaccctcgggttggtaggtacgagtagataaagaatagacccatacccatgtacctaataggtaagaattttcgcccgtcggtaaactcatgggtataagagttaaaacataattagcatataatagataattagcttctaatagagtaaaaaccagtcaggtgtcgggtcatagcaccctgttgccatctctagagtctagacatgtatgtaacagtgtacacctgcttgcggggctatcagaggcctctgcatggacatcttctcttcaccttcacggcccaactacctgtgcggcccagccagcctatgttacagggctcgcaggctgggtacgctcagcccagatcatatcgcggcctctactggctttagcccttggccaccggacaccggccggtgccccctacaaaatctaaccgaccggatttctgcgtgattgcgcagcgccggccggcggccgcccaccgtacaactataccaggcatcccggcgcggcgggcgcgtgcgagtgtgcgacgcatctcgtcgcggtagcggcaagctgcacggcggaaggcccggcgtacgttctgggggagggagtttccgtacctgcgcccgcagcgtacgcctgatcatctgggcgggcagcagtacacgcggtaagttcctactttcctcttccagtcttcctcttcttcccatcgtacgcctgatcatctgggcatgataaattttgtgtgctcactgggtaatggccgggtagctaggctacctgtacgtacgtgcgttgatatagcgttgctgaaattttagaccctacgaaacgtacctcaccctagtggaaaaaggggctttaatcctagttgggaaccccctatacaaccggaactataaatccgggtatctttaatcccagttggtaatggtggaagcagtccggttgatccctagtttttttctttttttttttgtttctttgctcaaattgatctgctccctatatatccccaaatcatccacaaatcatagcatcacagatctggaaagaaatgcatcacagattgaaaagaaatacatcagagatcacaaatacatcacatcacaaaatagaggggaaggggaggaacgggtgaggaagggaatgaaggggagaggaagggatggaggaggagatattaagaggggaggaaatcgagaggatacgcccggataatatcaaaatggtgcacggctcggggtactctttgctcccggttggtataaacaaccgggactaaagatctatttgtagtccccggttgtttataccaaccgggagtaaaaataatcggggtctgtcttgaactcaacaacttcttaaaccgagactaaaaatgatctactaaagatcaaaaagtacccctcaacttttaaactggaactaaagatactttttaatcccaggttttattagaaccagaactattgtggaatttgaccgatcgagcaaagatggtttctctaccagagtcatctggctcacattatccattacccagtgagtgcacaaaatttcttgttttgttagttttctaggaaatgattttttttaaaaaaaacaatgtccatgttacagttgggagctagctaacttagctggaagctaggttgcaccgagtgtcacgctaagatctacttcaccttcaatttatttcctcccctattcctattatgcctcctccataacaaatttatccatccaactccactcatcttgtcatcgcatataaagataaagaaaaattgtattggtttatctgtgcatgtattagaaccgcatgatgctaacaaatatatatctctatatacctaataaaaaaatacataataaaatatacataaggctaataaaaagatacataaggcttctcggtatttttccatccgtattatttcgccgatccccccgcttttttttcatctacttttttcatcgcagttttctcttcacatgtttttttgccattttttcagggtttttttcatccacttttttttacatcgcggtctttttggcacgcttttttttcatcccaatttttttacattacgttttttcgcatgcggtaaggattcgtttttttatcaactaggttttcttctgtcgtcgggctgaaccctagctcagccgccacgttgatctatccctctatgcgtttcctcctctaattgattgcaaaaattgattccccacaactccctcatcattttccccttgatttctccttaaaattcgtctttaattcaccggatttaatctcaatcactatttttattctgagttttgtggattgctccattttttaaaaaggaaaagaggagatcgagtggataaaaaccctcaactaacccatcgtgaaagattcgaccgaatttgatgggaggatcggctccggtatcgtacatgcacttctggaggttgaagacgatagggctgaaaaggaagaaaataatgggctttcggtccaaaaccaaataaggagtataatgtataggcgataaaaaatatttttacccattgcaacgcatgggcattttttctagtaaaagaaaagagactagcttcagcaaccatgaaatcccaagctagttcttagaagataagtcccccctatagtcttattctggatctgcccttgctactaagttcctttagtttctttcaaatttaatgtaccataatatagagaacaacatgtatatataggaccaaattaggaaaacttggcaatctgatgcttgactccaatgtgatttgacaaaggccttcttgacgaaagaagtcataagaggtgcatcatcaggtagaaaatcgagcaagatcttagtcttacattattgtcaatgtaccgggaacaaataacatagaaatgttaacaaaactctatataaattaacgggatcaaatcaggtgaaacagtacattatttagtatgatcatctctttaaaacataagctgattaaagccatgaaaattaaaaattaatccacatgattatcactaccacccattaccaagcaaataaacggccggcattatggtgaacaaacaataatatatagtggttttttaaccaccaagttaagtatttcattcatcacaaaaatattctgtttaaggcaaagttgcaaggtacagttatcattcataagatgaatgtaggttgaactattgccgactgcatattttaatcctgtttttgcatgttctgcatcgatattttatgtttaatctgaatactaggcctctagacaatagcaaatacagtttgctcgcttgctgcaagatttagttgtagatgacacaacatccaatgccactcaatggaattccacaagatttagttgtagtcttgtagatggcagcacccaactagagacaaggtgcatgctaatacaatttaccctaatatatatgcactgttattagcacttagctagtactattagacggttagacctcgtcttaagttttcctttcgcaacttgcatttcattaataatatatccaattagagaccaaatcatgtctactataactcgcatatagtactagctagctagtaacattgaaagatatataatgccaacaagctagtgctatgcatgcatgggtgcaaaaacttaattaacacttgtgctggtttggattactccagctaatttaattcagaaaatatacttcataatctaaacagttgctttggaaaggtggctgaacacatcgacatctgaaaactaaagtgtactgaacaaatggacatgatgatgctccaaataaaggggggagagatactatgacagtatggcactagcttagtatcccggatttggagaggcttgaccaccagatattggtgtggggatgctctggcatctgatctccaggactccgagaggacaaaggttgcaaagctatgagcaagttccaaagctctgggccttctctctccccccacaaattatgcgaaagtgtgaaacgtccctctcctctttatttcccattaagggaccgagaccctatttccagatttgtacttcgagaatgcaagatgcatgatagtacaagtaccatagcagatggtgagaatcttgcagctagtgtcaattttgggcttggcatctcatggccagcagctttccagattttgcagctctgccctgctggttaaacggaacctcactgccactgccttgctacagctttgcctgttggttaaacggaacctcacctagacacagtcttaagtattgctatatatactacagtattcaatcacacatataattccaagcaatgaaacgccaaaaacatgactgaagatgtcagagattcagaggccattataaaagctgcaggtgaaacaaaaagagggagggcagaaggctcctgcctcctggtggctggttccttctggacctatatactgaatgccaaaactaagtacagtacagtatagtaggagtagcagtacaagaacgccaaaattaagcacaggatagtacagtacttgatcgtatactatcctgaatttgttgagagcaaactttaagctaggagtatactactactcctactttcttgcaaaaaaaatggtgttcaaaatgcatgcttcagatcgacctagcttagctagggttcgaaattttgaccaggtcgagaaccattcaatatcaccatctggttccaaaacaaaaaataaaaataaaaaataatattcaacgccaccaaatcgtgagcttgaattcagaccagtgaaagtgaccataagacagttctggtgttgcacatgtttcagaggttgaaaaaagggaacaagagtttttcagaaacatggttctaccgatcaaaagatacaaactagaataggatagtaccatattacagaatgcaaaagagaaaaaaatgaaaaaaaaacacttggtagaattaaacacaaaacattggataatctcactgacctttggtttattccgagcttgctcttgcaactctcctctagcttcttgcccccacagatgttaaaatatgtgtatatgataaacctcctcatgaatatgaattgaaatcttaatttgcaacgcatgcatgatagatgcatacgtatgttgcacccagtacaaaggcctgtcgatcgtccaatcaacaatccaacatgcatgtcgcaattttgtaccattagcttagcttgcatatctgcattggattgctatggcttctgcactgcgcaattcttaatttggagaatttttgaactggatgctaagacatgggtcagaacggtggcctgactccgccggcgccggcgccgctccaacctccgaagttgtctccggggagctgatagcctcccacattcccggcgaggttgtagagcgacatgccaccggcgccgccggtgccgtcgcctcctgtcacgccggaggactgtgacgccgccggttgctgccctgggggtccagctgattgtgccacttgatcttgtgcttcgcctccggcggcgggcgcggcgacctcctcttcctcgccctccagcggcagccgctcgtacacggcgttcgcgaatgaggccgccatcaggacgacgggccccgcggcgaccagcgggcccaccacgctgccgccgatcacctggccctggccgccggagaggaacacggtgaggccgctcgcgccgggtggcgcgggaggcggcaggaccgtgcccgtgagagataggatctcgaaccggccccgcagcgtggccaccatgctgcccggcggcgacgcgcccggctgccgcagcgccacgttgacgacggcaccgccgccgctcagcacgcacacgccgcgccctcggcggcgggcgtactcggccacgcagtcgacgacgtcggcgccgccggcgacctcgagcacgtgcgagtgcagcgcgttcgggctgtcgcgcgtcacgatgatgggcggcttcggcttgttcttgaacccggccgggcgcccgcgcgggcgccgcgtcggcccacccgagccactaccgccggcgctgccgctgccaccctcgacgggcaccatggccgacgacgacggctggtggtcaccgccgacgccgccgcttccactccctcccgcgtgatctccctcgcccacggggctcttgtcgggtgacatcttggagtgctccatcttgacatgggatgtcggcgacagcggtgacagcggcgacggctgctgcggtcggagcagatggtggaagtaccgtgagctgccggcgccggcgccgcccccgccagggtccatcccggccatggccgtgtcatctggccgctcccaccacttcccggccgccagcttcccggttgatcggtgcccctcctcctctacaactcgctcctcaccatcaccaccacaacctgccaagacaaagcgagattaagccccttgtaaagaatctcgaagtaatttgcatggcacagtagtgcagcccaaacccaaacagcgaagcaaagcaaagcaaccaaagcgaaatgggagatcttttcatcaacagcaaagctttggcctttgacttgtccacacatctagcagctagctctagctagcatagctaagctacccagcaatgatgaagctctcaaaacgatcgatcgctgtagctagcatgttttccttacctccgccgcacgcttctcctcctccacgcaccgctcgacacgtcgacaccccggcggcgcgcggcagaaacctccctccgacgaacctgcccagccgatcgatcgcccaagaaaaacctccccggagcagcaagcgaaacgatcgttattccaacaaagagaaggtaaggaggcacgcggtgtaggatgggggtgaagcgggcggcgcggggccgaattaaaggagaggagatgaagaagcgaggcggaggggtgagctcttggggggacggcaagggatgggatggcgctgccgataaggtcagggaggtccgcctctctctctatcaatctctctcacgatacaatgccaatcccacccacaccaactccccggtttttactagcagctcgctcgctcggggaacggaaaggccggcctgccccgcccaggccaggccaccgcgcgcgcgcgcgtgtgggggcaacccgaagtagcagaggccacgtacgccaaagcgagcgaacgaggcgcccgccgcgccgtggactcgtttgtcgcgttcgttgaacataaaaaacgtggagtacgtctccctcccccgcgcgcgcccacgggacgcgcccgcactgcagctgcacgcgacgcgttcgcccacgacgtcgtggtcgacgcgggtcgtcgtgaaattcgcgggcgcgccgttgctctcgcgcgcaggcggccgcccaaatgcgtgcgcggtagcggcagcgcggtgcatgtgcatgcaccgatcgatcggtgccaagtcgagggtagtggtgctgtcacgtagggtgtgcagggctcggtcagtcactggacagtaggcagacaagcaagcaaataattggacctacaaggcgtgttaaacaattgggtcgtcgctttttactgtaccggtgatttttatatacacccgggcaagtacaagcaatccgcataagataatactacacgggacctgcatactccctccgtcaaaaaaaaaataaaaaaagacaaaacctggtctccgtgtccaactttaactggccgtcttatataattttttttataattcgtatttttattgttgttagatgataaaacataattaatattttatacgtgacttgtctttctaattttttttataatttttttaaataagacggacgatcaaacgatggacacgtaaactagagtttgtcttttttttttttatgacggaggaagtatgtatgcaacgtacgcttccttcctgctactacttgaaaacctacgaaccggtcctgatttgtgaagcttttttatattaaaaaaaatctgcccggtttatatatatgtagtttaattatactatatagtatggggttgcagctaggacgcgtataaaataggagtagctaggtttcgcatgaaggctttttcattcgatcatatccaagagtattgggttcgtttagtactagtataggctgtgtttgatacttggggttgggaacccaactccaccgcacggaaaacggagcggtccattagcgtgtgattaattaagtattagttaattttttttaaaaatggattaatttgtttttttaaagtaactttcgtatagaaactttttgcaaaaaaacacaccatttaacagtttgaaaagcgtgcacgcggaaaacgatggaaaggggttgggaaacttgtggaaagaacgcagccgttttggcccccatttggagcactgtacgtacgtaattgtccaacgattatatacatgcgctgtgtatcgcaagcttctagagctagccttgatatgttccgttaaaccaaactgcatgtactagagcctgtttaggataagaaatcggcttacgtttggaaatatttcaacatgggtacaagcagctgttcacaattccaagattggataactttagaaatgaagtggtttctcaactaatcaaggacgactcgaggtattatcggctgcgcccaaatactggcatgtggcatgcatggataggtccggtttggtgagaggtcccattcaggaactggaaattaatcaaacgagctgggcgaaaacttgagttttgcaatttgtgaccaggcttttctcggcgtggagaagccaagataaccttgtcgctttgcgtatgctctcaagtgttcaattaatttttaatagcggattacgggtcattgtcatgtgacgcatgagagagagcaaacaaatttgaatgaccacggcctgattggctggatctcgagacgcagcggtattagtttagtgccgcgcaatcacgaacagtgacttaatgatcgtcgccacagattagcagagtggagacatgaatggtgtatatgtcaatgaaagctacacgagcatataaaaaagggaggagctagcacgcaacaaaacaggttgaaatccaaaggcgagtacgtctttcggtcggccagttttttccccgttttttacgtgcatgggccagtacacatgttgactttgatacaccaattaattaaccatctttttttgacagcggccgtatagtaacatactggagtaagcatgttactagtaatttctaaattttgactctaaacgcaggtaccacaaacacgcgctggacactcttaagttgaatctcttttgttcggagtaattcttaaaagacaagagatcatgatatcttgagatcgtttaactgttgaccagctaactattgattgcattagagcaggtacaatagcaggttataagctagctataaacatattttaaagagataaatgaagagagagaaaagtagcgggctacaaatctgtagccagatgcagcacggacttcaagacgtaatgtgtgtatgatagatagaaccaggtattaatactatagtaaacaactattgtataaattggctattatattggctatagatgatttagagctagtagttggttatactattaaacttgctcttatatgcacctggtacatatacctggcctagcatgcatcatgatttattttttatttttaaaaagcatttctgcacggtgcacagtgccatgtcacgcgtgcatgcatgtcagaacttctcggctgctagttacaatagctgtagcatcaattatagatcagttttgccactttgccctaaattaaaacagccatcggtgcagacgtaattaattaaccatcttcttgaaagtgatcggtaccataacatatcatgtcaacaaatggatacctctagcagttgtattattctttttcacagttttttttaagaatgagttactctctccgtctaaattaaatgcagttttacactattcatgttcaacatttgactgttcatcttatttgaaatatttttatgattaatatttttattgttattagataataaaacatgaatagtactttatgtgtaactattttttaaaatttttttataaacttttcaaataaaacggacggttaaacgttggacacggatttctacggctgcatttattttgggacggagatagtatatagctgcatgtagttaattggtgcagacctggcaccatgaaattaaagaaagcgctgtgcacagtgccatgtcacgcgtgcatgtcagcacttctagcatcaattagatcctaaattaaataaccaattggttactggatcggagcacataaattaactcggtcatatgatactccacagtactagtatatatgaagatgaatccatccatctatatacacggtggtattgtggtaaaattaaagccatgcatcgccattccgattcatcccaaatcagccgaaacaaacagatttatacttcaaatagtactactacatcgcattgtattttagatttgtttattttaggatgaaatgattatatatgtacatttgattttctccgtagtacgcacgcgaagaaaaagtactactgcaccgatctggcaggactccgttggaccgatatcgagcctcgtagctgcaagagctagctagatcaccgtcacgtgcggtcaaggataagctagggggaccctctcgtccggtcaaaataaacgagaacgcaatgtgggggtgatgggcggctacaccgtccgtacagctgtcagacacgtggtggtggcgggcaggcgcgtctcggtcaccatctactagcacgagcagctagctagcgagagatcgatcagccaccgcgatgatatgatatgatcgccctcgcggccacgcccacgcgggccacagttaagcccatctcgccctcctcatcaatctctcgcgatccccaaattcatcggtggcactggcatcggccggcctcgcctgaatcaaacggccgttttagagcaagtttaatagtatagcccactattagcttcaatttatatatagccaatctaatagtcaatttatacaatagttgcttactatactattaatatatggtcccacatgtcatacacacattgtatcttgaagtacgtgctgtagctggctatagatctgtagcccgctgctcttctctctcatcttttatctcattaaaatatgtttacaactggctaatagcctgctattgtaactgctatttatcactgcatcttcctctcccattcctcctgcaagtctgcagcaagataacgcaaatgtgagctctgtacacctagctgtgacgccccctgtatcaagcaagataatatagcccgtatagtatcccgtgctagctgcagccttcactacttggactctctctctctctctccgtgatcactgcatatgcatttgcattgcaaacacgcgatgcaagtgatatatccatctgctttccctgatcagcggttgtgcctgtgtaaacgtatctcgcgcggtgcgccggtgcctacccaacccctctcttttgtcccatgcctacatgtctcatcccatcgatcgatcgatcgctgcaagcatggccgctggccccctgttgcaacgagacacacacagtgcgctcgcatccgtatcaatatcattatcaattatcatcaccgcccggccagcgcctttgatttctcggtctttcccgtgcatgcgcgctagctagctagcacgctcttttattgatctctgcctgcagcatactctgcacgcacgcacagtgtgatccattcgcaagcagtacgtgctgctgctgccacactgcacttacgcatgcgaggccgccgatcgagcgcctctctgatagatcggcaacatgcatgcgattgaagcattgtgttgttggatatcgtttaattgattagctaggctggtactctcctccatagtttagttactgtgcagtattaatttgggtgggtgacaagatcaaatcaaaacattatcctgcaataacgaatagtgattgttgatttgttgtctatatagctatagctctgcctctaaattaaagcgacaaacatcgtccatgaatgcacccatgagtgacctcatgcgcatacatataggggaggggggggggggtagtttgctcttcctggtggcatatttatttactagctagtgctagtattgaatcgaagctacgagaatcatgcttccaatccaattccaaggtacgttaagttttatagcatatcaaagacaccagaacaaacgatacagtacatggcaggggtttattggctctcgcttgtatttttgcagatatagaattgtacatagggtggacaaaagcgttggaacgatctctccactggcctgtaaaataattgagcagttgtgcacttgattaagagttcattatccaaagagtgctggtgttggcttcctcaactaaacaccattgtttatgtgttcgagcttatgattaagttatctaggggggttataaaattgggcaggcgagctagatggccgggccaactcggcttagctacacttggaagctatattttgatgtgacgccttgcgtggatggcgacaaaaactgccttacatgccatgccatgcccactgccatgacctaattcttctcactgttggtggctgtgcatgcaagagcatgctagctctgcctttaattatttcgtcgtttattaagtcaagtacgtacagggacataaacaatgagcggcaactcaactaaagaaaagggaatctgtgctcacctgtagtacggattatatgcgtgtaaggttttctgctttctggttgcaaagaaaattgtgttttgaatgcagaaagagagcgagaaacaaattcagttatagatacatgttgcatgttcttctggtaggtttgaaaaatcaagtagtaatactatactctaccaggcatgcatatataagacagtgctaaggtaatcgatccatgcctgcatgttatggataataaaactcatgacgacttcagactttcagagttgacgattggtgcgctgcgactagctccgctgctttgtttagtttgacgcatttgcctccggatatccagcttgtacaggcgaatagtcctgcagctaattaggttcaggtattcaactgccaatagttaaacatctacagcaaactcaatgataattaagatccaacaaaactattattactatcatggcccgcgagtagcttgctggtacttactccctccgtcccataatataaaggatttaaagtttttaattgcactgtttgaccactcgtcttatttaaaaatttttaaaattattatttatttttttacttactttattatccaaagtactttaagcacaactttttattttttatatttacacaaattcaaacaatacaaacaaaaactcaaaatctcttatattatgggacgggggagtagtaattaactagttcaccaataatttggtggaaaattaagtcgagttcaacattaatttatgcacatagccatccgtccaagaaaaaatcatcaacttctgattacgaatttggatataggctaggttcagattcgtagtcaggatgtatttattttttaacaaagaaagtaagttgatgtgcgcgtagatctaagttaatttgtctgacggctctaattaatgcactaatgccagtagtccagcagtactactgcccaagtgcccagccggccggtatagatataggggctgtttggttcccagccacactttaccattacttgccaacaaaagttgccacactttgtctaaggtgaggtgatcaaattgttagccacaacttactaagcctaagggaatcttgccacacttttttgagccattgacacgtgggacccaatttgttggaggggaatcttgccacaactgtggctacaaccaaacacctgtcaaatttgcctaaccttagagcatggccaacagtttcccgatactcttcccaatatcagttttgaggagttttgttggaaaaaatcgctccaacagtagacctaaatcacccctaaaagcttggcgtttccaaacccgcatatttcgttctccacttgtagggaagagactcggcgcccaatccttcaaccgcatgcacttcgcgcgcgctgtgtgaaaattttcctaccaggttcttctttgtgcgttcgtctacctgtgagtcaatccatcacgccagcagcctcatcttccccgcagctgtctgggaaagcagccatggctcccccaagcttccccagcgtcgacatttttttctcagcggcagcgccagacccatctccaacccaattgggcggaccttcgtcggcgctcccccagcaccaccaccgactcgaatcggccgtcgcccctattcatctccaatcgtccctcgaccctaccgcatcctgcagcacagcctgtctctcgcgtcagactggcgctgcgctccccccggtaatgtgcaggcgacaaaggccccatgcgatgcgaccagcagccggcgacaaccggaggtgcccagtctctggccttcatcgaatcatcgtgcacctcggtcggagtcgatttctgattgttgctgctgctcaaatctggagcttgctattgctgagaactgcttggtggtggtactggaaatttgttgtttgctggctgatgaaaactgttgttctttgctgctaaaaactgctgcttgctagtactgaaaagtactattgcagctgctgaaatatcttgctgcttgctgctgaaaacttcaagttgttaacaccgttcacactaaaaaagctgaaattttttttctgggctgaaaaccccattgttgatgattgcagaaccaatatttttccatgtaaaatacaggagatcgtggtaataatcaagtgaaatatcattttggggcaaatactcagatcgtacctgaagccaatggaaacattgttcaatgcttaaactgtcagttatgatgtcaaagagattgatcactgaatgtcctgaaaggagccgtgaggaggatgcagcattgcagcgtgtgcgagcgtgagtggaggagaggaatgacgattctgttggtagttgtcgatgtggcctactttttttgttttgaggattaaattttgggaatctcttggagataaaaggtattctcataccttaaatcctttttagagatctaaaaaaaatgatttaggggattgaattttgggtggctgttggtgatgctcttaggcgtggcaaactgtggcaaagtgtggcttgcaaccaaacacacccatacagccgcaagttggacatagagggatatatagctcagagatccagtactgatgttaatttgtacggcgtacgtgcctctaaaattcgcaaagatcaatgtatcgaataataatgtaattaaccatatgatggagcgcacacgcaatatcaccgccagcaggcaagataggactatattcaatgtttcgattgctgtaaattactccattcgtactcgtaaaaaaagtcgtttagaacaatgtttaaatcaaaccctaagaatataaatcatgaataacttttaagttgttgagtttaaaaatataaaaattatatgaatagatttgtcttgaaaaatactttatgaaggtatacgtatatcacttttcaataaaatatttttatagaaacaagaagtcaaagttgtgttttggagaccgtatcgctgtccaaaacgacttcctttaggccattcccaacctaagacactagatatggtttccataaactccacatcatcaagaaactagtactccctccattccataatataaggcacaaccacttttcttacatgttccataatataaggcatgcatgcaaatatgcaattaactatggcatcttcttcattaaattataacttttttaaatcctccactctcatattatctaatcctattgaatgcatgcattatatttacgaggatgatccaaactacaagatgataataattacttcttggtctttgggttaagggtggttgtgccttatattttggaatggagggagtactagacactactcttccaatgcaaacaccactattctatacttaaatttaatgctacttatctcacatgatgtcttggatgttgtgtagaaactatgtctcatgcaagacatggtttccttctctttcctcatttattcacttgtcacatcatttttcatcataggtgacagtttatttaatgctatagacaccatcctagtcattgggttgggaatgcccttatattctgagcactgagggagtatattactactaatttaaaagcacaagaaataataactaattaatcaataagatcctcagaggcaatacatgcatgaatcttacttttgccttgtcgcagaatataaggtagctttgtgatatcgagaccgtattttattccatatctattaatttttatactatttaattcatatatcaacttttgtactactccctccacttccatggttataagacatggttataaagtcaaactacttcaaatttagttaagtttatacataaatataataatatttataatacctaattagtttcattaattcaataattgaatatattttcataataaatttgtgttgaattgaaaatattattattattttttacaaacttggtcaaatttgaagcagtttgactttgttaaaagtcaaaacatcttataacctgaaacggagggagtactgatttatttattcaattattatattaacttttataccatgacttgttatttagctattttcttatttcggagagcgtgcagtttttcctatgtgttcattgaactcaaataactatagctaatttagccatcttactccagtaccagataacactatgcctgcctctaaatagtcaaagtctgcacaccctactagagcatagtacaactgaatttgaatctactccatccattttatattataagactttctagcattgcccacgttcatatatatgttaatgaatctagatatagataatgctagaaagtcttataatatgaaacggaggaagtacgatatacgaagatatgaactaaagtcattgcttaggagtattgctatacgaccagaattaatcttagagaaaaccattctttacagcctgttttggcgcacaatggttaaagcaggcagcagccaattaagcaactacagctatatgcctagctagccgcaggcaccaagttaattaatcaatctgtacgtacagaatcaaaaagcctgtcatgatgtcgcttattagccagaaaagtacttaagcaatatacaaatctgtgaaaaggcgaaactcatagctttgtttcatctttttcttccacgtccgattcccttccgtacgcgcagatcagcgcgtgcatgcatgctgaaactgcagatcgtacgatccatatatatgcaaaaatacactaccgccggaaaagaacacacacgatctatttcgggaataactcactgcgttgaaaaggacagtgcatcagaataagttaacactaattaactcccagccacgcaaatttctaggctttagttttgattaattaaccacagaatccgatcgaatttgagcacagcaaaaaatgtacatcagcttagtagctagctgcagtcaagctaattaagctaattagctcgcgactggacaggggagcaagagaaccatgatatgattaaatattttctgcaccttaaccaatcatggccaagagataagctaagctagctaggcagcatccgatggccggccggctaattaagaattagtgcctgggcgaaaggctgattaaagctgcgtggatgcaagtggggaggagtgattagattagattaggggggcaggattaagataatccgagcggcgcgctgtctcatcgccgggcatgtgctagctccctcgcctgtcgcgttgcggcgccaagcgtctctcgatcgatcggtagctcgcttgtccgtgcatggcgccatggttaacctgatgatgataatgctaatcttttcgttgaagccgtctgactttagcacttgattgttaatgaccttattaagcagccagttgattactttatcggtcgggaagagacttgaaatgatatgagatatgcgcccagttgccacccgcggggaggtcgtaatctgcggtgacctaatctgggttagagacaggcaacctctcaattgtcacattaatttgtaagcacgtactcatttgtgcctcttttgtgtctcctgtcatttcgtataatttgcctggctcccaaagcttacagtattaattctctctatatataaagctggctcgatgattcaattctactacataaataattgtttgttcaggagtagtactagtacttactaatctttattcataagtaaaccttgggaaccctaactaatgatgaaatggcatcagaaaaagccatgcgtgaagtgtcacgccaaggatatgggacaggtgtcgaccctgggattcgcctacagtttttttctttttcagggggattcgtctactgttggctgcaccgcacaggctactgcaggaggaagagagagagagagagcgcacgtaacgccgcggggaatgggtcacgcgccacacgtgggcgacggccccgcgcggtggcgaggcgaattgggtggaggggacggggggccgagatatgtcacatcgaatttttgatacgggccggccgtggccgtgggccgcgcggccacgtgacgatgccggcggatgccgcgtcccggagcggcgttggccactgtggccgcgcgcgcgcgagcccgaggccggaggccaccatcatccgtccacccacccgtgccgtcgcgtcagctgctgatcgcggtctcgatcgccttggcgcggaacgctccgatgtcgtcgcgtgcgggattgtggcggcgtccgtgcctcacgcggacgtgatcgcgcattgggggtgtggtgtactggtggtggagcaaacttttcgcaaggattgtgtatttttgtgccgtgcgagggctggttgatcttgcactagcagttgcaggagatagtgctggacggtggaggactggaggaggaggaggtgaaggagaattgactgggtgctttatgggctgttttgggctacaaatctggcccaaagtctgttcatttcggtctcttgggccggagagaagacgggagaattgttggggtgctttatgggctgttttgggctacaaatctggcccgaagactgttcgttttctcttcaacagcgtggaaatttccgggattttgatccaatctgccttttctacttgtgtattgaaagcgactacacaagaacagaagttattatatgtgcacttgtagattcgaggtaggatttatttagctactaggagtaggattttggttaaagataaggagaatcattcaagatttcaagtggttctagtgcggcgtaggaaccagcatagcgcggcgaggatattcttcagcaacaacaatagaaagcaggcgtgattgaacacgagaattttcgcaccgaaatctgtgagctcaaggaatcacagcacatttggcttttgaaatctgtgtgcttatggaacgaaccggaccagtatattcgacttaccttataaatcaaagcaagtacctgacagcaacaggcacaccattgcgaaaaaataaaaagagaaggcgttctgatttgatccacactatcaacactcggtcacaggcaacaggcagtcaggcaagatgcaatacaggctacaaaattcagaactgagggacatggagggaacaaaaggcagaacgaacagtaaaatgaacatacacagtcaggttctctatgctgtaaacaaaaattactgagctgctatactgcacaaaagcataagttaacctgacctgctgctatccagaaaaaatggaaaaataagtttgattggttacagaagaatgaaaaaaaaaactgaagggtaaaattacagtcagaagctgcactataggttaatgcctcctcacacattatgctagtataatacaggttgagtttggaactaaagaatcgctctcttatcagcagtatgtacaagcccattgctcattcgcttctccacaagctcagggcaatccctgtctaaatatgtccagcatttgaatgatgcgaagggctgctcaagaagcagccttggcgacatccttacttgatcgattgtacatcatgtggctcttgacaaggtgaccagaggcaagagcggcaaggagcgagagctcgccagcgagcacgctgccagctactatggtagccaaacgtttagcatttgcaccaggtgagccatgatttgaacccttgacaccaagcaggttcaaacaagccgcctgtgaggccagacatgtaccacctccgattgtacctacctgagagaaaaaatgaaccattttactaacatgaagaaattaaataaataaaaatcgatgcggatattgctctcacgatcaaactgcatgctaaaacaaaatattacttcagttaatacaagaagatctctatgctatagattttgcagctccatttaaggctagcaggttatgctataatctacataatgcaggtaggaacggaaagtaaaacgaataaataatcacctcaatggacggcatggtgacagagatatgaagatcatctccatcatttacttcttccaacatggtgatgcattgtgagctttcaacattttgtgcaggatcctgtcctgtagcaatgaataatgcagtaacaatattactcgcatgggcattaaaacccccaagagccccagctacagctgatccagcaagatttttgataatgttaagctcaacaagtttttctacagtcgtcttaagaactttctgcacaacatctcctttaataatagcctcacaaacaacagatttcccccggccttctatccagtttacagctgtcggcttcttgtctgagcaatagttacctgatgcacacagattaattcatcaatgtgcatgcaaagacaagaaaatacatggtgaattgatgaaaacagatagtgtgaacacccattgtttcaaaaaaagcacccccggcacaaatgcctaattgatacacgcaaatatattatcagagaatattagaccatgtttgatgcgagtctgatgaaaagtagtacattcactgttattcggtaatcagaatatattttacaattgaactaggctagtgcacaatgagcagaaaataaataaaaaggcatccaaaaatacttcttagggatgaaaaaaatccatcttataacctgctgaatcttctaagaaccgatatctgctttctgtaaatgaagccaagggtttcctctctagatcggaaaaatctaattagggacatgtttctttaagttacaaagcaataggagaggaaatattttgggtgctgatgaaatatgtttttcatcatttccttcgcaacatttccaaacagaagttaaagaatgtgattttttattcgttttctgctaaaaggaggcattgacttagagaggaaagcaaaactaactgaagcatgcaaagttcaaggggaagagttaaaaccagatacgctgatgacatccatgtcagggaagacattctgcagatagcccaagacattctcaacaccttttgacaccatgttcattcccatagcatctccagtgatacagctaaatctcatatataggttcctcccagcgagtgcacaacgaatgtcttgaagcctaccaaatctgctggacctacaccgattaaaacagtttttatgtcaattctaatagaagatgacctctatatggagttattggttctactaaggaagcgaaacaatagagcaaaaaagaaaaaaaaaggatgatgtaagaacgacttaggccctgttctattcttcaacttccttgttttccgttagcacgcttttcaaattgttaaatgatacatttttttaaaaaaagtttctatatagaagttgttttaaaaaagaaaataaatccatttttcaaatttataatagttaatacttaattaattatgtgctaatgagctttctcgttttacgtgcaaccaaaatttatctccaaatgtggagattaaatggggccttagataagcaagctgcgtgattgtctcaaatgaaaatttccacaataaagtatacattttttagataatggatatcattccggcctctacactccacaagagtgtacacagccaacaataaagtatgcatgaaatttactaaattagaacttatatagggcacagaggaggataacaatcagataagttgtacaaacagattgattctcacagtataatggatcttcaaacaatagtaccaaatcaacactgtatagcaaccatattgtgtgacatttgccacatcaaaaactaagactgaaacatatgcaatccgaaatgcagaggttgaaagaacaatgtcaatggcaaactcacacttagctccggaaaagtccctggagaatacactatgcaaaaaggtatccatggaaccatgacacttgcccatatatgcaacccatagagttgcgtcggtattgggtagatggttctagctgccaagaacaactataaaacattgtacagtttaaaagatcagaaatcaaataagatgtatagacacctttgactttgactggtagaataatatgccgatatgtacagtgtctgaataactggatacgaaaaatcaaagaaaaatatgaatatgaaaaatctgcacaacaaagttgtggaaatcacagaagtggcttgtgtggtaaaatagcacaagtgaggatattaggaaagtatactaaatgcagcatacctaggaactaactgttggacctatttggaactttgaaacacacggccacaattttttaaagagattcaataaaaacctccatattttctcagtactctcaaatgacagaaaacaatgtaagaaaagatacattaattagaaacatgaaaaccaacaataacttattggaacacaagcctactgttatctaaagtgtacttaatgacagtaaccaaagcttttgaacatgagcctacaattacgtaaaggttccagacaacaaaataaaacaaaacaacatatcgtacatttaaaaaaaaagagagagacaatagatcctctaaggatactgactacagagcgacagttactagtcagtaacacagaaaaactccaaaagacaaatgacattaatctgaaaattctaacaccgtaaactgtcagtagatgtgtgtaccctgagtccctgaacatctgaaggtgcaaagatacacactagaggttgagatcttaaatccacatattctcaagtttggagagcacaaaccaatgattcattcacattcggtattatttaagcgaacataaaaaggcaattcaaggtgaacacttcagaaaggtattatctatgagctggcattatctgcatttagctggtagctcttagaacaagtaaacatagtattgataatgcattgtccagtacctccagtgcatgtgctagcttacacactgtgggctctaccctgtcagcaatcacatgatagaagggctttccgttgtgggaaatcacctggtcttaaaataccattcagtgctagctatcaacatcagtccattactcaaacataagacgacaaccttaagatacactgaaagatcacatttttcccccattaattaacactgtgcctgcctattgtcgcgcaaagtcttataacactttgagcaagcacacaaatcaacaaactagattagtggatgatgtggagtgtacctattgaagacagcagccagcaactcaaaattcgcaggcgcctcagcaaacgccttgagctccgctgcccgcattgcggaaggcagcttgacagcaggagcgcgggacatggcgtcccggagcagaacgctgaaggcgccgccggaagcggagatggccctgcacccgcggttgacgctggcgacgaggcatccctcggtggtagccatggggacatggtactcgcggccgtccaggagcagcgggccggcgacccccacggggagctgcacgtacccgacgggcatctcgcagcattgccccaggatggcctggtagtccatcccatcgaaggggaggccctccactccccgccccgtcacccgccgcagcgcctcccgcctcagcctcgccgcgcggcggcagtccccgagccgcgactccaggcggtgcgacggcagcgcgccggacgccaccgcggcgacgatctcctcgtcgtcggcctccatcatcccgccaccatgcccatgcattggcgcgggctccgcggcggcggggcgcgcgcggcgggagcccccctggccgtcgtcgtcgtcgccggtggtggtggcgggggcgtcagggtgggcgaagaggctgacgaggtagacgacggtggcgaactcccggccgccgaggggccgctccctgtctctgcagaggcggagcaggtcgcaggagtagagcacgagggagaccatggccaggccgttggtgatccgcatcgggaggggcagcgccccccaggtgagcgccctccgcgccgccccgaagatgcgccctccgcccccgcccgggcgcacgtccatccgcctccttggcccaggatctctggagacagagagagagacacaacccaacccaaggcgatcgcgaacgacgcggacctcgcctcccccctcccggctgtgcgtgtgcgtgtttgctcggtacgcgatcggagggggggatcggacggacgggagggtgtgatggtggtgtacacggaaggcgcagcgagagagaggggaggtgaccgcgggattgtctctctcgctcgcctcgggcgttcagatgttcggcgtgacaggacaggacagggggatctaagcggcaagccgcaagcagaggcgtgggcgggggagggggaacggcacggggcccgcgcgcggatgggcggcgggttctttcttttcttccaagcagaagaccgggaggagacaggagaggctcgggcgttttccacgtccgatgctgtttgcaaattgcaaatctgctcttttgtcagcagtgtgagtcatccgtcatcgatggagctcagcgagaaatgtgtttttttttcttcttctctcttttatgcagtcgatcgtttggaaaagtgtgaacgagaagcactctctactcggtaatctatgatgaaatgtgtggttgatgtgatgaactcgctcgagcatgggaatggtgtgcgagattttggtctcagtcactgctcaccttggaaatattttacatcctgactaggcagttatgtttgggttcagagactaaatcttagtacctgtcacatcggatccgatgtttgacactaatttagattattaaacatatactacttacaaaactaattatataaatgagagctaattcgcgtgacaaattttttagcctaattaattcataattatcacatgtttactgtaacatcacatagactaatcatggattaattaggcttaatagattcgtctcgctaattagtttagagttatggaatggattttgtcaataatctacgtttaatacatctaattagtgtccaacatctgatgtgacatggttccatccaaacccccagttcggtacatttggttcccaacacctctctctcatattccgcgcatatgcttttcaaactgttaaatggtattttttttcaaaaagtttctatacaaaagctgcttaaaaaatcatattgattcatttttgaaggaaaaaactaatacttaactaatcacgcgctaatggaccgctctatttttcgtgcgcaacatatatgttcccagcagtgagtgccgaacacagaatctttatcataaggcacatagttaaaacaaatattcacttcgtccaaaataaattaatttagtatgagaagttatatatctacgaatcatatattttgagacaggtggagtacagtatatgatctattccctaaaatttttttgatcaaattcgtatgagattatttcatacgttcacaggacttttactgatcacacaatataatggtggtcataaaactttctaaagtaattttgaatttctcttatgaataaagataaagaattaagaagtacatgtttcacgacaattgttgtgtgttactattatactacattagatgtttttagaagtgttaagtgcatactttaggtcttctatataacttctacttttagctcttttttcgtaaaaagggtgcgacaacttagtgagtaaaataggatatgctacggataagatcaaatgagtaacttttagccctaagttttttcatgtcattcttcggacaaaatgattcatttataggaaaagctaccatatttactgtagcagccatactatcatgtatcaagatggatgtatggaacgtactctatatatgctacggataagataaaatgagtaatttttagccctaactttttttcatgtcattctacggataagataatttatctataggaaaagctatgtttactgcagcaaccacactatcatgtataaagatatattgaatgtactatatctatccacgattataaaaattcatctaagtgtatagttagaaatccctatatttatggaaaatgtggtagtaatttatcttagcataacaccacttcaacatctcaattccactttagtatggagatgttttctccttcgcatagagatagttaattaatccttaaaaacacctttctcatgacttggtaagtcaaagaaatagctagtaagttacatgttatatatactctaatatacatgtttgtaattaattttgttagaattataaatacaacctcatcagaatatccttgaaccaaaaattaaagaaaaatgacacatcacatccattgaatccaaatagaagaggcatgtagctcttcaacttgttttatataaaatcaattgcttacatgctaactgagatcatatgaacagtataaaaacgcgaaaaacatgcaacgaacttttaaaattatattatcataccgtgatgcaacgcaatgccaatctactcaaacatgtccgaatccaacttaccttatatcgaccaaaacttacgacaagtagcaaatttgctcatcatccacgaacacttcgattccaaattcgtttctaatatttcgaagcgcccgcaatttcgctgtcaaccgcgtgatccatttgaaaaacccaaacagctctctccctcttacactgtcacacacactggcttcttcgctggcaaacgaacgtgacttgggttcccgtagcagaagaaggcgcgccaacccaaccgtcggccccagtcacaatcccccctttcccctcctccgccgactcgcccaccttttcccccttccaaaatcccaccgccgattcgctcccactcgcgaaccctctccaatcccaaggtcggagagggggacagcgaagctagcccacccgcaccaccgatcctcgaagggattccagccgatcgctgcgtagctcgccggatggcgcagcagcagcagcagcaggggtcggggtcggggtcggcgtcggcgtcgagctccagctcggggctgcacctgctggcgtcgccgttcggggacaccacctacaccaaggtgttcgtgggcgggctcgcgtgggagaccaccagcgagaggctccgccgcttctacgaccgcttcggggagatcctcgaggccgtcgtcatcaccgaccgccactccggccgctccaagggctacggcttcgtcagtgcccttcgatttttcgccgctgttgatcctgctttttccgggtgtttgtttgtttgttcgtggaaattgctggctgtaaacagtggttggcttatacaagtgtcatgttgaccttgtgcaggtgacgttccgcgatcctgagtcggcgagaaaggcatgcgaggacccgacgccggtgatcgacggcaggcgtgccaattgtaacctggcgtcgcttggccgcgctcagcctgcagttcctctcggtattgatctccctgccttgacactgatttgcactaacttattcgagtagattatgagcacattttgataccaccgtgaggatttgcttgctagcaagttactgcagtggtatctgtggtatgattgtgttgccttctgcaaacttatttgatcggttctacattgtgtttgctctagaatttagttacccgcactcgtcctcctagaataagacaactatggaaagaagaaaaattgataatcaagtgaacataggtacagtcaactatataccttctcaagtgggtttgggacttaaaataacaccacaggtgagctaaaatgatactgagcattcatttgaacagaagtactgatgatgttggtgtttggcatgtgcttgttttgttttgcaaacaaaaaactacaaattacagtatgccacccctaatggtgatacgatgactactaatataccattttggtaccttaaacagttcttggaagtgctcatgcggtgataatagttctatttctgtaagcatttgttctgaatacatgcacaatcttttcagggaggccaagatcagctgggtcctactttggcgttccagttccaaggggtgtttatgtagggggttatggtcagcaccggacacttcctcttgggtattaccaaggattcccggttccgcaatacaggtatgatgtgttaacttttccaatgcagcttcctgctcttagatggcccatttgtgacaatcttcaagtagttcttacttaggcgtccacatttggcatataatcttgtggcaattactttgtgtagattgtgcatagcctgcatcctattttttttctgctcctcttcgaaaattgccaaataaatatgttcattttcttcgtggaacataatatcgctgttttggaagtcaataaagtgtgttcggtcattcattttcctccttttgcagctacactacatatgggacagaatacatctatccacaggttgaagtgtgaaaaatattacgtttaattttccttgcgcaacataagggttttacaaagcatcgactgattctgatgagagatctctttgtagggtacattaaacccatatgttggtcagcaatatgttccaatttatggagtttcatccgcagcaaatactgctagccaaccatttagccagttcagcccgtccatttctggtgggggtaatggttatgtggctattcatggttacaatgtgccaggaaatccatttgtacagttaactggatcaaactttagcagtgcatcgcctacacctcggcccaccattcaggccccctttttagttggtaatgtggtcttctttgcctattttttttagtatttagtgattcctcttgtctttccagaaaacacaatactgtgttatgctatatgttctcacaccaaatttaccaggctaacatggatgctatcgttcattcgtcaccctgcatctttttatagtgtctgcttaagtgttctccttttgtgaataacttcatattacttggcctttgtagcagcaccggttcctactcacccgcacttggtcctcccagctcactcacctcagtttacacaggctagtggttcagaccaaagagcaagctgaactatgctgccaaacatttgtaccttgaggtttgttctgtctggactgctgttatcttttcttgtgattatctggtagtaactgttctttttctgtccctaataggtacccttagattgcagcaggacaaaagagcagtgctgctgtatttgtagtactggttcttacctggcaagtaatcccccttgcattcataaggtaccaattatgctgtactgagaagccatgcttacattcatagaatgccaatcttactcttatgggaaattagtccatcaatattctgcccttcagaagttcagatgcatttagtttcagaacaaaatgatggagttacctattggttctaacttgtcagaactcaaaagggacaaactttgatgttaatatgcttgtgttttgtctcttattctcattgttgtactccttaatctcgttatgttttttaggatctcctattatgctccaatagtattgcattcgatactgggtgatgctttcccataattaacttgaaaccaaaccaggaaattcattcttaacgttgatgttagattagttttgcatctaacagaagataagtacattgatggcatcatggcgttcatcattactctgaacatacagactaaacagccaactgaatcttaatcaatctgtttgcttgtgatatgatatggtcgacactaaatagcaaaaatttcccagagaaattctttctgtttgcttcaggctttctttgtttcttgtttcaaaacattgggaaatggtttatacgtgtttgtctgaagttattgtaagccaattggatcatgtgcccgcacgtgtatactaatgtgatcatgcatcttgttttttatcatatacaagttttcattttattgacctgagttctatttctgtaattttgattattatgataatcttcgctatgaaatttctgcaggttgcccttatcatggtcatcagatgtacctggaatcatgatgttgccccgatggatgggacaatgatccaagagcaacggttgctcttgtcagttttgcttggttacatcctatgtctcaatgggactgcgaccattgctgcagcttgaagctctagatacagcattattgatcctgtatctgacagctcattagcccatggagatatactggatgctggaatggagtccagcactctgtaagatgactaatccccttggattagtcatgatgcactcatatgattgttcacctaaactcctgaagaatcatcaagctactatgtggttgattatatcccagtgttgaagtctggcacaagtccaacaaatgtagcccgtcccgtcagtcttgtgtctgtctatggtcatcgtcgtgatctatgcttgatcggcctttggaggtataaatagttattgcgtccgcttcactcatcatgtccaaaatgttggaccaagatggtccttcctcctgtatctgtaacccaagtgtctaccggaactgctcagggtcgttactcgttaccaactggtagcgaggtcacgaggactatcttctatggtgttactggtatcggtatcagaactaccgtctattgtgttactggtatcggtatcagaactgttgttatgtgtttaatttttcattgctatgtgctcagcagttcctcgacttccgagaacggcactttgttgtccgaccaaaataaatcagttcggatgagaaacccatgctttggggtcttatcggtgttgtgtaagcctggattgttaaaacttgtactatttgtacaaattgttttgctgttttgcagtgatgtgtattatgtgaaattgtttcagaaattgggtgttttctgtgtgacgacaatgctctctgctcgagttagcggtatcagtcttgatcgttaaaacttgtacaaattgttctgcggtttggcagtcttgtgtattatgtgaaatattgttcagaaattgtgttttctgtatgacgacaagtcgacaatgctctctgcccgagtcagcgatattgttcaagtctaggttgttaaaaactttactatttgaactgatttatctgcggtttcgctgtctttattttgtgaaatattgttacagaaaattgagtgttttctgtatgacgacacaatgctctcagctcgagttagctgctgctgccaatgcactaacttggagctttggaagtacaccaggtctgtgaatatgaaccctgagatttccccttctgtgcacgattcaatcactggtgctgataatgatgtgagagaatcgtgagtaataaacaaatgtacacatttactttacatacaatgcattctattctgccaaagccaaaccaccagaggataattcgtcagtcaatacgttgccttactgaactgctgttgggaatgtggcgaatcatgtctgaagctactgaattctgattctggctcttgaactgaacacactccagcttcagtgctacgagggattgaattgatggcctaacagcataaccattttattccgtaaatccagatcattagagcttactgctggaacttacagaagccatcatagaactcttaaatggaggttgggatatccagctttagtcttgtacttctcgaacagttcttgtagtgcgacaacaaattgttcatggacttcatttatctgccacatcagggaattacccaattttaattgtaagaatatatacatttttatttttttaccattcaaaaacaattaaaacaaaaaagatcctactttccatggtaatatttatcttagaacatcatttaatttcagttttttagtgtgcagactgatcaaaaggtgtacttggcataatgtcaagatgatatttcacctcatcaaaggtaggctgagcatttttcttaacctcaattggtcttccaacaaccacgtgcatgggtgtcgcaaacggaatgggagtcctgcatcacaatgtgcaaggacatatgaactcttgaccaaataaaaaatattgaaaaaatatatataaactgcagaaagttacccaaattttccccagaacataattggagtaaatttaattgctctagcaattttgacaattaatttgccacctggtctccaccacttataaacatagctctagtcaaagtagtgccaaaaaaaaatcagcaaactgaataccatgaataaatttactatatggataaggaattttgcatttatgaacttattgggtgcaagagtagattacctgtccgaaagcgaaaacagggactaaaggggaacctgtttccatagctatcttaacgaaaccttttcttgatttaagaaaagcaacctgtcatttgcaaaaattaaccatcactattccggtaaaagatgtaagtatttcacttggttttgcacaagaaagaaggcaatgtctttattgataataaaagaagaaatccgcagttacctctgaatcatgatccatgtgaagcatctcctgcacccctcctggcactatgacgcagctataaccagctttaaggtaggagtagaaattcttcctggatgcaggaaccaaccccaaccatgtccatatttgcctcaagaatggggtatagaacacctaacaccgaccaattcaccagtaaagagcatatctttatttagaaaatggattaaaacctggcctctatatccagatggatgttcgcagccacaataaatagcatatgtagtaatagagtgtcgaaagatcaaactcttaagaatgtactcctaggaaggaaatctgggaagtgggaacctcaccgcactgcttgcaagaacctttatctttggtaatggcatgaatccaacaagctccaaaaggaccccaagggcaatgggcaaaacagaatgcggctcataaccaaacactgcaagcacagcacaatataatcaccaacccagtggacagtgccctctatataaaagactccatacttttctatatattactactcctttacttagcttttagaaataggccaaaagggtttgatactttaaagattaaaaagattcaagtatcacaatatcatctttagtagttgtttctgtttagctttaggaatcaactgaaaagcctcggtatcaatcatcaatgtgattcaagaattaatcaagattccagagatggaatgagataaagaggaagctcaccgtaagctctattgggatcaaaagccttgtagtcctcgacatgtaatgtgacggggaagtacccaatcacgcacttgctgatgaacctgaggatgcgtcgtcctccaaaatgtaagatccaacaatgcggtcaggtaaaaaaacgttggcagccgaggaaatcgaggagacgaacctggcgatcttgcgccccaacctgctcatatcattgaccggcgcgaacatgaagaagagctgcgtggcgagcaccctggataatacagcgcggagaggcgagagtgagacccaagtacccaacccgtcaacggcgagcagagcgcgaggtagggaaaagaagctggaggagagatttgggtaagaggttacatggcggcgacgcggcgggggaagaggaagagcgaggcgaggaggaggaaggcgttgaagtggatggcccccagccacagcgccagcgcaaccgtggtgcgcaccggcggctgcgccgtcccccggaacaccgtggtcccgtcgtccgccatcaccgccgcctcgccggcgccggcaccgccgccgccgtaccgcacttcaccattccccgcccccatccgccgccgccgctggcgacgagagagacgtcgcgtctcgcgtcgagggatgcttctagtattgtccgcctctctctcgcgtcgcgggcgatttcgatgcgtcgtcgcgtcgtctccgctgtggctcgcgggcttgacctgtcagt

SEQ ID NO: 6949 - DNA, 9801 bp, Oryza sativa
cagaaccaagagacagttacaagaaaggctgcagaaagcataccatacgcctgttcatttcatcctcaactaattgggccaaaagtttttcggtttcaatctgcaccggtaaccatgtggaggttgtaatcagacataatgaaatgaaacaaaaaaagcatacgcaaatgactgaaagtattgctgcatatactataatatacctgagaaagttgagctgagtcatcagattcaggatggagaagcagctgcatcagaaaacaacaatgcaatatcagagacctgatgagagttatgaatgtccaagagttgatagatgagtatcagacaatacacacctgcttcctaataaatgggggcaaaaactcaaatagtgcagatgcccaaggtgaaagctgtgaggagatattctccatggaaacacctttgccgtgaagcccatgaatttcctacaattacatagatgccacttagaaatgttgtaaatgaatagccatatggcatgtacaaacttacctgaagcaaagcatataattcaggaatactctccacgagtccctccggaataagtacaactccgtgatacttatctgtgcaacaaatataaggttaagtaaattcataaattttcacaaaatggcatttcattggtgaaagcaaggttacatgagcatatcacaatagaaggcccctacccttctcagcccttgcctgaactgcatcacatatctgcttcgtgatatcaaagatggtaagttttgatgcagcaacctcctcacctaggataacctgaacatatgatacaggttcaaacaaatgcaagaagaatttgcagcaactcaggaagcataagcgaaaagttgaaaagtccaaaccatattcggatgtgattgaagagcacactccaatgccacatgagaagccttccgccccatcatgcgaataaagtagtaatactgccagaaagaatacaaccacaaggcatataaaattgttacttttgtaatgtgaatttgtaaacaggaaggctcagcaggccttgctggaaaagtatgtctactgaataaccacgctgagagaaatactgaagaacaaatggaccatggaaccccaagaaaaaggataattcagttgtctaatggacctaggcgaatttgcattgttatcaatcagtattggcatcctttattgcctatacaaagattgtgtacacctgtgtgtgaagtgtgaacctcccacataggccgaattaaggagtgaaccgcaaattatagcccgtgttctatatttgtttagctctttctgtactgggacttaacagtatcaattcagagttttttttactgtctcaattcaatttgattatttaattctgagaaaaaaataaaggaattgaccatagctaaatagtatcacagacacgaaagtacatccaactaaagaagaagcggatcaaccatattagatattaccttctcagccgaaagagcatcggtgcatacattgcttataagttgtgagttcacctgttataataataaataagttcaacaataaataaaaattgcaaagtggtaaattaaatgcgtagtatttttgaatgggcaacttggaaagttatccatagcacaaaaaacacactttcgcatacataaacaacctcaattgacaaaaccaaacatgcctaacaggtcagttatgcatcatatagaggtaatggaaggacagtaaaggtaaatggagccccagcatagtaatgtaaagctaccttgcatatggtatcaaaaccaacggttgtctcaacaaactgattcttaaggtccccattcaaagttacaggaacacctacaacctgttcaataataaattgtgtcatgccatttacaggcaagtaaaacatacacttgcaatggaaatagggaatcaggaaccaaggcacggactgcaacaagaaaagggaattatgatataccttcgttgcacacttagcctcagcaaaagtctcagcaagttgagcagcatccgtattggatgtaacaccttcagaaaccagaaattaaacagatgttaggattaaaaaaaatatacacaatgtagctatttagtagactaatgccacaaagcctacctccaatgattactaaagcatccaacttcaaagcctgacaactagccatggcaccattgacctgctctgttgttctaatttgatcctttgtccggccaagcatatcataaccaccttggtttttatatgaagaaagaacttcgtcggtgatctccaaagttttctgtgcgagaagaccatcacttccacctgtttcaacaaaagaacgaaataaacacaaacataagaaacagttaaagaaaatctgtaagcattagctccaagtgttagacatgttcagaaaagcaggcatgagagacagaagcccgccttggggggattcatgcacaggatgccaatcacaaaattaacacatttgatttggattagacacttaagaaagataggtactctgtccaagatcttgtagcaaagcatcactgattgtttttttttttttagtataggtatgtcactgtgttgttaatttcattaagtggacctagcaaagttcggttgaagagctttagatgtcactacttatgtgacaaaaatactaaatgatgtattgatgctatacagttgtgatcacctgctaaggtaatgaaaacaaataaaatataacaaaaatgctgagttaattcaaattaaaacactggtggctgctaggggaagtcgacaacacatagtgtgctaagtagcttgtgaagctatttaagcaaacgctgaaagtctgattggacgcaacaagcagacatgagaacaaagggaacgaactattaatacattcatagttgcatatcaaaggactcaccaagaaaaccaataagtttgctgtttgggttgtgagccttaattgcctcatggagtccccagatgacattatggcctcccggggactgccttccgcagaaaacaacaccaaccctgcatccaaaacaaaacaatcagatgtcttatatgtgcaggcagtgagaggcgaagacaaataatttgatgtaatttctctccagcattctcttataatttgacaaatactttactactagtatttggtttctttttttcaaaacagtttcttgtcttgcagcagatggcatatcaagtaaaaaaattgaatatcacaagtaaaaaatacatatatacctgacaacaggatgctctgatatgacagtagcatcggggacattagccgtcttccggagaaaatgggccaggggctgcccgtatgtgtgggggaacgcgtggctgatcacatgagcgcctgcaggatcagcagcaattgcagcgtcaccatactccactctcacagtggtgccctgatttacatggagtgaagaaattcagagcgtgaattcacaaaatcattcatccaccaccaatcacacgcacgcgagaaaatcattcgcaaaattatcatgaattcatccgatccagccaccagtcaaacagcataactaaacaggagaaagtcttacgatttgatagcgattcatgggtcaccacaaaagtaaacaacacaacacaggaccgtgaaagctagtccaaaaagaaaagtccatggttgctgtagacgaatcaatccatctactgtttattccaagttgctacgctccactactaaactcataaataaaacagcaacacgacaataccaacacggcaaaacgagctttcaaaaaaaaaaattcccccgcgcacgcagcctcccgcaagccaggcacgccggttggatctactagtacattgctagacagagccctgcacctcgcaggcgaggtccagcacgattcagatccaatctggttccccgaaaacgagtgacagactgacagctgatacacgtaaacctatggcctaagacccccgagaaatcaaatcggaagcagacgaacagtatacacgaccagcgccggtgagatggactgatccggacgccggagcggcgcgggatctggcgccgcgcggtccggaagcacacagatctagggccgggaagccgcgccagggaccgcaatgtcgcacgcaggggaaggaggattagcggcaatgggtgggtgcggacctggaggcaggggggcagctcgggctggtagagcgcgcgcttcttctgcacctccgagagctcgcgcggcacgccgtagtcggagtccatcgccggtgacgcagcgcggcgcggcgcggcgctccgattcgttctgtgctggtagcttgggggggtgggctcggggcttggtgactggcggcgactagcggggacgatgtgccgggggtgcgggaggatttttgttatatagtcggaggcggaggaggcggctcctcccacaagtcggcaccgcacgctgccgctgccgcgatgccgatgcggtcgcgtcgggtccctgccgtttggcgaattgcgaatcgggcccaccaccggatttgtttcactactaattgatgggccctgggagttgggccgtaggatcgcagttacaagtgggctcagttactggagctattagggatgtgttcttttgccggctttctcaactcacattcctcgttttttcacatctcgaacgtattgccttttgtaaaaagtttatatatgaaatttactttaaaaaatcatattaattaatttctcataaaaaataaataagctaatacttaattaatcatacgctacaattcgttccatttgtgtgcaagggattagttcccaactcattccaacgaacgcaacctcgcattctcatcttttcgattatacttatcaaccaaaatttaaatttttcaaccttaaatttgaagttgattttgggaatttttcatcatagtttattttccagcctttgcttttggattgttgaaaacatgtatataaaagttttattcacaattattttttatttgcaaatatgccgttccgttttttcctcaagtatgccaaacgatggggctgcccttgatttcaaggggttttagtttggtatttttatcgctattatttatcaaaagcaaaagaagtctatcaaatcaacccacccaatagcattggaaaataatgcctctatcaggtaatctaatacggtataaattcgatgtagataagattgtatatgtggaatttttttcaccaaatccaacgaaattcattagagatggctcatgtaaattttagagaaaagttagcaacagcttcaatatttttggacacatgaaacaaataatccacaaacaatatctagtgaaatagctgaaaagaacatggaccttaatattcgatgatagccagcaacaaaatttagaattcaatagtccattgggacgaggaatcaaatgcaagcataaaaaatttgcttaaggacaagcattgcccagaggcacttataaacattactatgaaaatagtaaataataatgttaagaaactaatcctttgttttccaaaaaataaagaagttaagctttcatttaacctattttcatctctctattttgatatactctgcttccgactaaaaataaacaacaaaacaaaaatctccggtaggtcaaaccaaaataaaccagcctacttatgtcaactactataaacaatactattatagcagatccccaagtcttgctactgattacagcaaaattccgttgtcagctcggcattgagcgtctgctcacacaaaaacttgcttctgcaacaaaattgtctaaagcctgcatgaaaaacagaatacctgatatcaaagcatgacgagcttaatttgaagcaagggatagatgcaacggtgaatcacaaacctataaagaattccagaaataccaccgggccagtggtatctgcactcaaaggaaactatctacatatcagcatgcccaaatggtgcacgaacaaatagttggccatgaagcgtgacaacggcggatgtttgatgaggatcgatcctcaatggcagattgaccacctgagaaagagtaatcacttcatgttatctgaagagaatgcaaacgtgctcaaattagtattcaaattgctgctatcaccttcttgaatggagtgatcccccaaggattatcaggctgctctgggtccccagttataaccagacgcccagcaggatctgactgaacatgcacctgcaccatttagaacaaaattcaacaattcatttcttctcgcaggtagtgcctcagttcaagaagtggaagctttttgtttgttacgcacaaattaagtcaggtatttattttaggaaaatggaacagtttgaagtgatgcgttcaacattaaagatattttttcacctcttcgcgtagaagtccaggaaccagagcatagatttcgaaacaatctttctgcaggaaagaaacagccaaatgaagagatttctcccgaataaaaatggcaactcaacagaaaaaccagctcatatgctattaggatttcagaagagcactgaaaaacttgtctgtaatatcaatgcaccatatgagacttacagtctgtcgtacattaatcttcacccactcggcaggttctccaacatcagtgaccattgagtcatccctgaaattgagaatcccgttacataaatacaagttcaggcttcataggctaagtatccaaatatatggatttaaattctgctgagaagcttaattgaccaaaatgtaactgtaatttttaggattttcctataaaattttgtaatgacatattccgtagctaaatccaagtcattatcagccaatgctatataaccaacagaaaggaaaggaagtcttaactgtgatttgtttatttttgtacgagacaccttgatagcacactctggactagatgctttcttcctcttgagtactcctaaatgtgtcaaaacaaataaatgagaaaaaacagcagatgcactgctgaaagaaaacttatcaaacataccaaatactttaggttcttaccacgacttgaagaagggactgaatctttttcctgtacaagtttgaatcttttctgattaaatagttggtgacttgaaaaggtacatgtaaacaaagagcaagatctttttaaccttcaacatttgatctccatatatgccattggtaaggagacggtgagcatgccaaccctgcatagcacgcgctgcagaatcccttctaactctggcagaagatgattgattcataccaatctgcaaggcagtaaacaaacttgtcaagctagctaaaactagtagtttacacgcatcgacaagaaaacacttttggcaacaacgcaacaccacacatcttgatggaaaccttaacaaatggcaggcatcttaaatcagttattagtgcgtctatgtcaataaaattggatccataaccaacactcaattttcagaaggaattcagtgactaaaatcccttggtctttccggatataaccagactgtgtccttaattcagctaggttggtgtaaatatcacagctttcatttatacatgactaatgaggtgcatgctaacaaaggcgtaacaccattccataaacaaatggatataaaaaaaaaagtaaatcccctcacgcacattgtgaggaatgctagcatacgggcctgatcgacacgaaggggtatgcaattttgtttaggcttggcattcactcaggaggcccctgacaagcacattgattatgctttcccttctcttttccgttttattcttttggttttctatatgaaagttgtgtgctccaaagctttagctcgagatgaaagtctccatgtgaaagttttccgatcaaaagctctttagtctccaataggaagcttttcaatctctagtagaaagcttagtctccaaaagaaagttttcagtaaccagatgaaagttccaggtgaaagttttcagttccagatgaaagttgtccaatcaaaggtttttagtagcatctttttttttttttgcaatgagaagttgaaagtttcccttttcgggatgcagaacaagaagggctacaaattccagggaaaggattaggggagactatgcacgaaaagctataaacaaatgtgccatgcccatgcgtgactgtgactggggagttcaagaaatgagatgcaagctgcacgagttggggacacaagaactggattgaggccttctgggtgctctcgtcttactattcttccagtgatgattttttttttaaaaaaaagtcctgcgtggctgcatcctgtccgtaactgatcatgacttttggcgcaggcgcgaattagacaggtcctaaaaggacagcatgtgttcatctaattattaaagatttacacaaatagggtgaatcccgttaaattgtacagtattgaactaaaatataaactgaattaataaattagagctcttattaaaaactgcactattagaacaattacctcacggccagtaccaccaggctgtggtaaagcagacaatggtacttgaagctggccagttcggactttgtatttttcatactcgagaagtgcctaagttaatgagaaacaaaaattaacaaatcaagcagaaaacaatgcataaatatgggatggaatctaagcttacaataatgcttctgtactatattccatccaaaacatgcatcagttagcatataaataactaagaaaattaatgatctaaagaattaagagtaatagcatctgaagaaagcgcaacagtttcaataaaatgatgaagggacgcatcaagtaagataattgctcgttaaactaaaagtaagaagtaagaacattaaatattccctgccaaaaaaggaagcaacattaactgacacgggaacccctaaaatttttacactaataaaggcagacccatcattttagatcaattcttatgtttgaaactaagaactatactaataagtctaacagttttgcaactaaaacttacaataaagttgatgcgatatgatactgattgcaggaaaaaaaatgattgttggtgaccatttacttgtgacagaaagaactgaaaagggggaagttctcttgtgacaagtacagaggcaaaagaaaatcatgcagcaaatgcatcaccttctcatagaaaattcggaacgaccacgatacagtagtgcacgtcctgcaaaggattacggcagcaacaaattactcacatatggaagtctttttttttctgcgaataacatgttctgtgaaaattagaggcttactttggcggcctgaaagtctctccaacttgacgccatagtttacaaattgttacctgaacaagcaaaatatttaactagaataaatataactcaggtccttgcagctcactaatcactgttgaacttatttgatcgtgatccacccggacatatgtcaccgaaaatattttactctacagtagcagcagcgagcaagctagtgacaaggagtcgaggaccatacctgctcatggcctcccaggtgggcaacctgcctccataacctggattggaaaaggaacagagcaagcttagacgagaagagatgggtgtactcgggttgaggagctaacagaaacgagaggtgtagaaagacacgcacttgaggcagttgagacctttgccatagaacttgggaggcttgaactcgaggccgtgctccctgtggaagcgctccagctccaccatgaacgccgcctgctcctcctccgttccagagtcgtcaccgtcgaggaag

SEQ ID NO: 6950 - DNA, 1798 bp, Oryza sativa
cgcctcctcccctctggcctcctcggcggcgcgcgcgtcgtcgtggtcggacccggagccggagccggccgtggcgccgttcatcgccgcggcttcggcagggcaggggagagggagagggagggaacgggcggctgctattttcgcgggctgcaccgaggcgaccgcgagagaggggagaggagaggaggggggagggaggcccggagggtgagccaggggcggggggttgagaggtggcaactggcacgcaatgggaaaaaaaggatggatctccacggcttgcgagcgagggacagattgttcctacgcctactcccgccagtggtgggccgctttgttctctctgcctggatgggccgctttgttctctctgcccggatgggcctgatagactattgaactccaaccgcgtgatagaataagttcactttaggtccctcataattcacgttgagttcgaatcgtgtctttggaccgcagtaccagatataagtataacacacgttctttatctttcaaaacaaacgaatgtagtcccaaggcagctttgtaggctgtgttaagctgacctggaaccaaaagcaaaaatagaaaataaaaaaaaatcatgatggtcctaaatattgaaacaacatcttcttcctcccctctctctcttcctcatctctattcaggcctccatggcacgtgcctgtgtagggagaagggcggtagtcggcagagaggagctagacggtggcggcggcatcaccgagctctatcggtgacgaagacggggaagctcaggttgatgcttaggttgtcatttttgctgtcgtgagggcctcaggcctcggcgtcgtgaagataggagagaacataatgggaagatatgggaaaggagagagagaggctaggtgtcatcacctttggcgacacaatgaggggaagcgtgaacttggcgagaagagtggcgaggctagggagcatggcgtcgccccaccaccacgggcctcctctgttcccgtgtcggtccacccgacctctgaatctgtgatttctactttcgaattagtgtagttaggaattagttgttgatattcactaaaaaaattcgaatgacttccgttgtcttataagatacatattttacctcgattttcgttagcacgtttttcaaactgctaaaacgatgtattttgtgctaaaactttctatgtgaaattgttttaagatataagataaatccatttctaagtttaaaataattaaaactaaattaaccatgtgttattggctttctagttttacatgtccatacttaatattcgtcttcatgggatccaaacagatcatgttcttttgccattaaaaaatatttcactaggggtgcaagcaggcttgtccgcgaacccgtttataggcaaaattagtgggtaacccatggatttgacttgcgggttatctattaatttgacctataaatgagtttatagatcgacccacttgcatatctagatgcggcaagccggaccacgttgcaaaaatccatgagttatcatctactcccatccgtacatgtaaaggaagtcgtttaagacaatatttaagtcaaaccttgggaatataaatcataaataactctcaagttgttgagtttgaaaatgtaaaaattatatgaatagatttgtcttgaaaaatactttcacaaaactatacacatatcacttttcaataaataattttatagaaacaagaagtcaaagttatgtgtttggagaccgtgtcactgtccaaaacaacttcctttacgagt

SEQ ID NO: 6951 - DNA, 25235 bp, Oryza sativa
  unsure (1)..(25235): unsure at all n locations
cttgcatccctatattttagttttttcaaactgcctactggtgtattttgtgtgaaaactatctatatataaattgctttgaaatgttagataaaaccattttctaattttgtaataactaaacttaattaatcatacgcctatgatttttttgttttccgtgctctaagttcatcttcattttcaatataaacgaactactccctccgtacttgtaaagaaagtcgttttggacagcgacacgatctccaaaacataactttgacttcttttttctataaaaatatttattgaaaagtgatatatgtatatttttatgaaagtattttttttaagacaaatctattcatataatttttatattttcaaactcaacaacttgagagttatttatgatttatattcctaatgtttgacttaaatattgtattaaacgactttctttatgagtatggagggagtacaagctactacgtagtttattgatttgttcatttaacctgatgactgtcagaattctgaaattttataacaaggtccttcagacttcatagaaaacaccctgactatattcattattacatctcacatagcgatacgtgtttccactccttgcgcgtcgtcgtcctcgcccccacccagttcttccaaacgaaccaaacagtcaccacagatccgagctccccgtcctccccggccaccaccccggcggcgaccggacctagcgcctcccgaccgttcgcctcgcctcgccgcggcgccgcgggtggggcggccatggaggactacccggaggagctgcggacgccgccgctgtcgctggtgtccatcgtggggtgcccggagctgcaccccgcgatctcggcggcgctgagctccaggcagccgcccatgaacttgctcgccctcccggacttcttcaaggcctccatcctcgctcgcaccgccaaggcccgcgacccgctcgcgccgccgtaggcccccgccgggatcctgaagaaggactggctcctcaagcaccgcacccgagtgcccgccgccgtcgccgcgatgttccgggccgatcaggtctccggggaccccgcccagtggctccaggcctgctccgatctcgagaacctcaagtacctcctctacatctcttgcatcgttgatcccaaatagatgtgcgcataatcagaactcataaatatcacccctgcaatgcaaattggaaactatcgacctcttttggattaaggacttttctgaagtatcagcagtgtataagcagctagtgtagcacagactgaattcgcaaataccaagtaatgttcattttttttttgcaggtctgtgattcagggaagaaacactaaattagtggtgatccttgtacagagtcaagctggtggtaagcatcctctcgagtatacgtaatagtaatacattttctcgctgaacaagcaattagcactttagcttacgaagcttagctaaacaatctgcaactggccatatctgcaacagcattagatctgttattttacgcatgtcaatgcctacactctgcgtcatgggaatcgagggttgggcttgggcatgggccttatgataacagacccttatactcgcttgatatttgtgtcgtcaaacctaaccagatagccaataacattttgcagatgaactgagcgaggatgttacggttgctctgaggaaacgtgcagaaattgattcaaagcacctggttgttttggttgagagagatgaaatggaatggaccaaatctctcaacaagtatgctctgaaacttccccttaatcttctactgttatatttcttttttttttgaaactatcttttgctcttttctttttcatgtgttccttggagttatacctactaacctgcattatgttctgtattgaaaggttgacaactgtttttgcggagttatgtacgacatactataaggatgaaggacgaagggtcaaagctcgcatcgagaaaaggaatttctcatctgttgagctgagcattcgctactgtttcaaggtaggaagaggaatctctctctggttcaatttagcactgttagtcattcttaatgcccgtggtattgggacaaaaatttttcttcacatgcttggtaaagtcagtagtgctaatgacttctcactactctaatttttattttttttgggctgcattcctctgatatttctgattctaacaccaggtcgctgtttatgcggagtttaggcgggattggcctgaagcattaaagttctatgaggagggcattcgtgttctgcgtgaggtgtgaattggatccctgttccatgtttgccatagaccttaaaagactgataattaagtgaatccacacctgacatactcttttagaagccagattattgtgacactgaactcatgagtaaataaagaaagacagctatggttgctatccatccaaatgtcgtatatatttgtaatgctgaatatactcttgtgcacgtgctacttttaaaatattaaatatagaaaacacttcatgaggatctcatacctgtctagcattaaagataatttatccaagctaccactctatcctgccctatcctctccatgtgtgtttgcatcttacattacatattgaaagccttcaagattccttactgttttatttttccgacactattgcttaagcagtttctattggctttacaccctgcattgacaattgctcttatttagatgataggaacttcaacaagactgcctccaacacaacgccttgttgaggtaaaagcagttgctgagcaatttcactttaagatatcaacaatattacttcatggggggaaggttgtgggagcaatcacatggttccgtaagcatatcagaagctatgagcgtgttgttggatcaccagaagttgcttttcttcactgggaatggtttagcaggcagttccttgtctttggtgagctcatagaaacaacatctacaactgttccggatacactatctcctcgttttggcactgctgacaacgcactgaccgagtgggaatttcaaccagcttactactatcaggttcaacctctccctacacagcactacaacagaggatatttcattccttttacttgaccacactagtgatctttttatgatgccttcccttctggcagttggcggcaaattacttgagagagaagaggtatgccttagagttctcttcatcaagtgtaagccttaccaaaggagtcaatggattacctgagtcagtaatgccttccgtatatgttggtcagtatgtacgcttgtttgagcaaggagatacagttgcggtgcttccgtaagttctttgacccttagttacttttagatgttaacgtaatttttatatgactacttatatctgacactgtgcttgcagcctttctgatactgagtataccagctatgctttgtcagaagctgaaaggtttcaagattcctatgagataattgcattgttcagaaaagcttatgaatcatttcggagcctaggtgccacaagaatggcttctgcctgtagtggtggaatggccattgagtattatgcagcaggggattttagtaatgcaaaacaactttttgatggtgttgctggcctataccgtcaagaaggttgggccactttactttgggaaaacctaggttacttgagagaatgtgcaaggaaacttaagtctctgaaggactttatcagttattcacttgagatggctgcattacctttattctctggcagtggacaggaaatttcagaatataaaaaggaaaaatggaccagcaggatctcctaccatttccagtagagagcttatacagcaggaagttattaatatcttggcaggaaagcatgcatcggagaacactgatgatgaatttgatcttcatttgatggaagaatctactcacctcgatattgatcaaataagtccactaaggatagtgtttctcgcatctgttgcttttcacgatcaatctgtaaaacctgattcaccaatgcttgtcagtgtctctctacagtctcatcttccttgtccagttatgattgataagttggaggttcagtttaaccaatccgactgtaactttgttatagttagtgcacaggaagattgttctgcatcaaattcacatgttcatgatggagctgttcagactcctctgacactgttcactgataaatggatgcggttgactcatgaagttaaaccaggtatcagttatatatattatatatagtttatttcattagatgttcatccacccgctctctgcacgtattgtaacttgtaaatgttttatttcttgaaaagtaacctgtaaatattgtcatattagtatcttaatctgaacatacagaaacaacaggacattaccagtctcatcgttttgcgtacaaccgattttaagtcatgacacttattagcaaccaaaacataagttgcgggtaaaactcttttatatgcgttcttagcgacttaaatgccaatgctggaaaatgaactacgatgaaaaaacatcaaaatcaactataaaattaagttctaaaatccaaattttggctgtggctgatagattgaaaatcaaaatttaagctttattcggcatttgctgatgttaacttttccccttctgttagtcctatcatgaaataacaatgtgagtactttctgcaggacagagtggaaagctggaatgtttggcggtgaaggcaacaataagtaaacgtcttgtagtttgctgccaagcggaaagtcctgtttcaatgggagaattttcattgtggaaatttgaggaccaagtagaggcattacctatgaaggacaatgtacttgctttttctgggcagaaactgatccaagttgaagagccagatgctcaagttgaccttgtcttagattgtcctggtcctgcattggttggagaattatttacagtcccagtgaccatattgtcaaaaggacacgcagttcattctggtgaactgaaaatcaaccttgtcgatgccaaaggtggaggccttttgatgagtcctagggaagcagaagaatctgaaagtcatcatgttgaacttcttggtgtctcagatgtgaccacggaaaatgggtcaaaggaagaagttgatagcataagaaaaatccagcactcgtttggggttgtatctgttcccacattatatgcaggtgattcctggtcatgcaaattggaaataaaatggcatcaagcaatgtcagtgatgttctatgtctcacttggctattccctggactcgactgaagaagcagcactgcacagacttaatgtgcacagaagcttgcaaattgaaggtaagatccccatgatagtcagtcaacagtttttgagaccatttaggcgagaacccctgttattatctaggatcagatcctcaagtgatgatgataaaaaaagttctcttgctttcaacgagtcaaatatgcttattttaagtgctagaaattgcacagaggtacctttgcggctacacacgatgactattgtgtctaatgatgatggaaaacaactctgctcagtgcaacagatcagtgggatttccaatgaatacgcagttattgctcctagtgaagaatacaaaggaatattttcagtgaatccacatactattagtccaagcttttttctaggtgaaatttgcctgagctggtcaagagattcaagcattggagagagtcaagatagccgtgttataatgaaagaaaggttacctgaagttcatatcgaggagccgccacttgttgtgaccatggagtgccctccttatgctatccttggaatccctttcacttttcatgtgaagatctacaattcaacatccttacttcaggaaatcaagtactctcttgttgattcccagaacttcgtcttctctggggctcacaatcatgctgcatccattctgccgaaaaccgagcatattgttagccataagcttgtgccgcttggttctggttcccagcagctgccaaggataacaataacttcagtgaggtattctgctgcactgactccttcagcctcagccgcaactgtctttgtatatcccagcgagccgaaattcaatttggaaaagggctattcgtcaactgatccgtgcgttagctagacttgtatatactcagatactctggcagctcttagctttgttccggagaagcgaggtatgctcctgaaaaaaacacgccagttttatcttaattcttgaataggcctggagcagattctgttggtgaacagcggttggatcattgcaaaagttttggcattcttttcaggtgttgatttcgtatacctttttggattgaccacatttctgtaacttacgatttttgtaccgttgattttggctaaggataatcaatcatacacacaagacgggctggtgtaaattagcaccccactagagacaagtggggaataaactagtcccatgtctcccattagaactcgagaaattttcttgtcttctgctcaggttctcatatgcttcttacgattcccttgcttctgtacactttgttttcatgggaaaaaccttcaccaacaatgctcttcggtgcttcattcgtactaaaatatattaaccaaataatgaattagatattatataatactacagtctaacactacatactactaatagtagtattagggcctgtttggtacaggtacagctccagctccacccctcctggagctggagctcagccaaacagtttcagttccaccaaaactgggagtggagttgggtggagttctctcataaaatgaactagagttgtgaagctaggtttagacagctccacaacttcactgcagacctaactcctgaagctaaatttaggagttggagttgtaccaaacaggttattagattgtatagtaagagtttattatttagcgactctctatttatagattagtagtagtaatagtattagatagtgtggtaagagtttgtttagcgaatctgaccgtacgaatatccgtttagatagtattagatatcagtcaattcaaatttgtacttagtatactagtattccctccgtttcgaaatgtttgacaccgttgattttttagcacatgtttgaccgttcgtcttattcaaaaacttttgtaaaatatgtaaaattatatgcctgcataaaaatatattttataatgaatcaaatgataggaaaagaattaataattacttaaatgttttgaataagacgaatggttaaatatgtgctaaaaaattaacggtctcaaacatttcgaaacggagagtatattttagaaccgacgtttaatccctgagagccagccgttggctgtgtacttcatgcctctctatgacaccatatggtatcggattggtgatagtaatccgtcgcgttgcagcggcggcggcgcgttccatgctttctccctttttgtttttttttcgtcagtttttgcaagtagcgctctataaaaatctcgcattatcttcttccccaatttgcgccgctactagtaggtgctagtctcgcctcgagcccaaatccagcctgctcgcgtcggccgatcgatcgatcataccacgggccgattcgtggctcgcgccgcgcggctggggtctaagctagggtttacgctcgcgaaaaaaaaaaagaaaagtgttgagcgaataatttgctcctagacctttgctgcttctcccctgtcgataaagccgaccacactgctcgcgtccccccgcgccgttcttttcggagattccgctcgcgcgcgccgccgccgccgcagccgcccgccggggagcccgggacgaggatggaggtcgtcgtggcgaggcagccgaaggcgaagaagcagataaacctcttctactgctccgagtgcgaggagctcgcgctcaaggtcgccgctagctccgacaccatccatctccagtccatcaactggaggtacgctccccgtcctcctcctcctcctcctcctcctcctcgccggtttcgtggagtcacctgattcgctgattcgcttccgccgccgccgccgccgcgcaggagcttcgacgacgggttccccaacctgttcatcaacaacgcgcacgacatccgggggcagcacgtggcgttcctggcgtcgttcagctcgccgtcggtcatcttcgagcagatctccgtcatcttcgcgctgcccaagctgttcatcgcctccttcacgctcgtgctgcctttcttccccacgggctccttcgagcgcgtcgagaaggagggcgacgtcgccaccgggttcaccctcgcgcgcatcctctccatgattcccaagtcccggggcggcccgaccagcgtcgtcatttacgacatccacgcgctccaggagaggttctacttcggggacgacgtcctcccctgcttcgagaccgggattccgctcctgctgcagcgcctccggcagctccccgatgctgacaatgtgcgtagcaaggccaccggtgtcctactaatttctttcaagtacccaattcgtgttgctactgctgacttgtgtgatttgtgtgttgcgcagatcaccattgccttcccggatgatggggcgtggaagcgtttccacaagctattgctcaacttcccaatggttagcttcttgttttgtgtgaatgaatgaacatgtcgaaattcggttatgcatgccattgtggaattgctcttttttttttctggttgaaagactccgagtttttactttgggctgtttgattataaggttgtctgcgcaaaggttcgggaaggtgacaagaggatagttcgaattaaggaggggaatcctgaaggccggcatgtggttattgttgatgatttagtgcaatctgggggaactcttagagaatgtcaggtatcaacatactgtctgtggctttgccatgatactacaaagtagtgcttcagtgacttaatttttactaatgttggattttcttacttccactttagtgggagaggccaagagggatatggttttttgctatctttgtttttagttgtctgacaaagagtaatgcctcctataatatacgtttcacatattaattgccaacaggcagaggtcctgaaaaacagagattaattacatgcccttgtaaaacctgatcttagcaaagtcagtcacatgcttatttttgcattttcattttttagtaggcttgatgttcattttactccatgtaattgttttaacacttttgaggacgtactaattcataaactgttgatgggatatgctgctttatgttgcatttctcattaatgcttctttgtctaattattttgcagaaagttttggctgctcatggtgctgcaaaagttagtgcttacgtgactcatgctgtttttcccaagcagtcgtatgagcgcttcactcacactaattccggtaattcgtgattctcttctctttctacctttcagccactcaacttcagttctcacccttttttttcccactcacagctgggtcagctgacaagtttgcgtatttctggatcactgactcctgccctcaaacagtgaaagccatcaaccaacaacctccatttgaggtgttgagccttgctggttcgattgcggatgcccttcaaatatgaactttgtttttggtaatgggctactcccatttttcctaaatgttagagttcactttcagctccagtaaaaacaaataatgtggagtgagttatcttaattatggctttggcctgacgtcttcataaacatctcaatatgtgatggtaaaataaggcatttgatgctcatctgttccttcttgagcaaagcgcacacaatcactgctttatttcctgacatgtatactactggaggctgagcacatctgcacaagtgctcgttttttgtcttgctcccgaaaaaagcgcttatttctgtcttaatattgatatgactgtttattaaaactcatgttttattctacattttgagttcttatagcaacacatgctggttgattagttggtactacctctgtttcacaatgtaagtcattctagaattttccacattcatgttgatgttagtagattcattaacatcaacatgaatgtgggaaatgctagaatgacttatattgtgaaatgaaggaagtatgttatttgggaagatgaattacctcttcaattcgttgtgcgttgtgttgtacgacagtgcattgtgtgctataggatggaatggatcacttcttttgaagacatcatatagatagctgatgtatagaaaagtggagcatacgtattctttccttctaactggctcctagtaaaagttgcataatgttctatcgagataattcatgctcctgacaagtaaaagtagaatagcctggtaatattttttcattctccgattattggtctggctcttttcttttctttttttgaactcatgtaactttatttaagtaagagaagtaacacagtacacgagtacaagtttgcatacagtggaggacactggaatacaaccaggtttgcagaaaagccccttagaactgggcaaattacacttgagcttaataaagtgcagaaaaggactttaaaaatagcaaaaagcaatggagtcctttcccccttttttgccttcaaccccaacgacgaaatccagaaacttgactctgacggtggaggatgcgctgcaggagattgaaccaacatgctgtcccaaacggggccttgcaaaggaggtttggatgttggaattcacataataatatcagcaacaacatataagaaattcgccggatccggatccggatcagtgaaagaaagttggcttgcagacaaaaatttcaaggatgaaccctataactattccactggcaggatgaaccctataactattccactggcgaaagttggcttgcagacaaaaattccaaggatgaaccctataactattccactggcaggatgaaccctataactattccacttccactggcgaaagttggcttgcagacaaaaattccaaggatgaaccctataactattccactggcgaggattagagagagaacgtagcagtttgcaaagaaaactgagaggcatacccgatttataggagattgagaccatctcggctagacttggaaatatcaaacgccttggagaaaaaaaaatccttcgctggagaagtagcagaggagaaccagccgaggaagaaattcgtcgaagaaatgaaagttggtcgacgctacctgtgaactcgcagatctggagggatcccgagtgatgactagaagaccctgagaacaaactccagagctagctccagctgtgttcatcttgctccggactcaaaaaaccaactacacaacgggagaaccccgactaaacaggaaaaacccgactaaactaacctaatactagggggaaggaccggacccctctccctctctccgccgacgacgaatcatcggaggaaaggaggaaaaggggccgaacaagcgacgatagagctgtagcttgaaagcggaaagtatagatggcgaaaaggtccgaggctcgacggtccggcccacgacacgacattttggcctggcctaagcacggcacggcccgacggggtagggcccgtgccggtccggcccgaccgccgggccgtgcctgggcccctcctccggcacgttgggccggtagccaggcccaacacacaatgaaagggagtaaaaatagacatattatatgccacggtccaaagaatagggacataaaatagacttattttagctatatatatgtcagcccaaagaggagggagggagtatgtcacagcccaaagaggagggagggagaatagacttatttaaaaaaaggcacgatgggccacccgtgccttcgggctggcacggcacggcccgactactggtgggttgtgcctaggccggaggtgcggccgatcgggccgtgccggcccgatggctggtgggccgtgcctagtcgtgcctaggccgggccgtgccgagcgggcctcatggccatctataggggaaagcgagggtctggctcttgaagggagcataatcaactagggcctctttggatccggagggctaattattagccctccagaatcttactatttagaagtattaaacgtagataactaacaaaacccattccataacccgtaagctaatttaggagacgaatctaataagcctaattaatccatgatttactacagtgatactacagtaatcatccgctaattatgaattaatatacctctttagattcgtcttgcgaattagcccaggggttcaacaagtagttctgtacatagactttattaaatacttctaaatagcaagatttcggagggctaattatttgcctagagaactgaatggctaggatgcacatggaaggcattactccctccgtccaagaaaaaaccgatctagtattagatatgacacatcctactactatgaatctgaacatatatctgtttagattcgttgtattaggatgtgtcacatccaatcctagatttattttttctaggacggagagagtacttaaccaataactataatagaaccagtagtactagatagagagcttgttggcagaactatagcttcacctaaaaagggagcggaacatactgaagagctatcataaaatggactagagaggtaaactgagtggggttcgagccgcttcacaactccactctaaagcaagtgaagttaaatttaggaattagagttttaacaaacagactaataatatattatagcacaaataaaaaggatatgccaaatatatacacctatattttaaatttatacttcctctatttcacaccataagacgttttgagttttaaatagttatgcatgtatccatgtatgtgtctttatatacatgtccaaattcatatgaatgttggtgaatttatatgatatcttttatttcacactataagacgttttgggttttaaatagatgcatggatccatatatgtatttcatatacgcgtcctaatttatatagatgttggtgaatttagacgaggtatgaagatgccaaaatatcttatattgtggaacggaggaagtatatgttagtatgttcagaacagatattggtagaacctaatattccttatatttgaatattgaggctccgtttgagatagctaattgtttagttttttaatagctactgagggttataaacaaatgaatttcactagtacaaagttagaaaagttatagacaagcattcaaagaaaatttcatgtaggaatttgagtcggctgtgacctcgttggggaagttgaggatggccttggatcagcggagctggaacatgacacggttgtaggcggcgcgtggcctcgacgacgatgtcgtaggtctcgagccggtggcgacgacgagggcgtgaggattggtggtgggcgtcgtcgaggaggtgggcggcagcaaggggattcctggcgagaaggatggtgtgggaggtgtgcactgtggaggtggaggcggaggaggtggcacgtgtggtcatcaactcctagactgcaccaacaaggccgcccaccgcatcacccgttgccggtgaaagtgcatctaggcccctaatgattttgatgattgattacaatgcgattagagaggactaacacttttattcaagcaaatgtgaaggttgttatgtcctcgacatgttgtaatgagatgcataccccatgaatgcgacatcacgatgcaatgcggcaatgatcaaatggtatattgtatcttttaccttacattgtgtcgtaggaatgtcgtactattaagagcgataccacatgcatattattggtagaatactagtgctcaaaatgcttcatctttgtgtgagttgaaaaacctaagtaaaaatttcaatcccgagttgtttcacttgtcacaacacttacaccgggtttctttgcaagtttttcaacatctcttgaaggttttggaccatgttttatgttgggtttgacccacgaaactagcttttcatagagtccaagatcttcgaaatcggagttcggagtaaaaagttattgtagttttacttgatcaacatcagactatccgatttgaaatcagactatccgatttttcacagaacttcactctctgtcttgatttgaaaaaatcctatcgagtgagtttttctaagtatcggagtatccgatgtcggatcagatagtctgatgatacagagactccgaaatttcatagaacttgagtctctgtttgaggacgaagtttttgcttctaaaatatcagatactccgatttaacatcagttagtctgatgtctcggaaagtccgaaatttcatggaacttcgttctctgtttctcgttgccttggaggtttaaaatatcggactatccgatcttgtatcggactatccgacgtgggctgaaagattcctctccaacgaccacattttttttgggggggggggtctataaataccccccacctaacccttttctagggttacccaactcatttcattctcattcactttgggttgaacttggtgctaaggtgctttggatctttgagctctttctccctctctcaaatccctccttgttctttgtgtggtggatcttggtggttgtggatttggtgtttgagggcctagtgtgtgtttcactcgatattgagcactagggtttgaccaagagttgtgtggtgtttgttactcttggaggttgaggactcctagacggctaggtgtcactcccgagccaccgatctatgtgtggttggccgggagaagtttgtgaaggccggatctcgcctccgcaaggaaagagataccccttagtggaaggaggagtgcttagtgcaacctcttgaggaaagggttagcaaagacccggctcttagtgagctcctcaacggagagtagaatcccctcaaggatttgaactccgggaacaacttcgtgaacttcatcattggtgatctcccttcatcctccttttagctttgcttaattgtgccactatagatctagttgctgtttgtgctttactcttgtctgtgtgatagatctacttgttgtgcttcattggtggatcagacagtctgatccaacatcagactatctgatatttttggatagtctgactgtggatcagactttccgaccttatttcagttttagcttccgcataaagttttaaattagcctattcacccccctctaggcctaattgaccctttcagccggcctccttcgaacccgctggctggccggcccacctagacgagggtagaagagaaagagagagagagagagagagaggggaaggaggaggaggaaaggagagaagaggggagagagagggagagggtgatgacatggtcacccaggtatggccaccactatcggtgatatgggccagggtgtacaaagattggagggaagaggctgcccccagtgtccacgtggcactcctcccagggggtcgggcccaaggatgggcggcggccatcccctccaagcccgaggggtcgagccgccacgtgtatatggttaggtgggtgcctcacagcgtccacctaaccgcatttaaggcagttgcagcgggcgttccacgccgtgccgagcgccagaccggcctgtgactggtcagtgaccggtccatgaccggccgaatgatggatgggacgactgcagagcgctcatgccctgaccgcatgtcaggcggcgtgcagcgggttatgccccgttccatcgtaatgatgaggggctcttagccactcatcccatccggtgtggccaggcccgagtttgtattcccggtgcaagcctgcactctaagtccccatccattaaatgatgaatgacgcaggcgtcccccatgtcagccggcctgatgtggtgggccccatatggcagccgatgtgcgtgtggcttgccatgcctagccactgacaaagtgacatgcggcagacggtttgccccgcccagtcaatgaacaggtgacaggcggcggcaagttaccccgcctcatcacatcgtgatggtggggtttttttttctagcccctagatccgcccagagctggttcatctgctctggtctaaagccgacctcctgtttcccggtgtaaacaggagcccaattaagagtcttcatccattaattggcgaatgacacaatgctccctcgtgtctagcggctcgatttgatgggcccatgttgtggcggtcgaggatgtggtcgtcatgtcaatagaataaaacgtgctctttagcataatcaattatgtcgatgatataggcccgggggtatcatgtttggagggaggaggccgcccctaaacccacgtagcacttccccgaggagggtcgggcccggggtggagtgacagctgcccctccttgcccgagggtatcaaaactagaggaaggaggctgcccctagtgcccacgtggccctctcccgagcggggtcgggcccggggtaggggggcggccgcccccctccgcgaccgggggtcgggcttcctcgaccccctccgcgggtcgccacgtgcgatgcgttaggtggccgcccccaagagcccacctacccgcatttatggcggcatgcagcgcgtctgaccggtccgtgaccgatcgaataaccgatgggactaggggtagtgcacctgcgcactgtccgtctgtcaagcagcctacagccttgaagtgccccgtctcatcataatgacgagaggctttcagcctctcattccagctggagtcggtccgcccgctctggtcaaagaaaggatcccgtttcccggtgtaacaggagcccagaagtctccatcccttaaatgggagatgacgagggcaccccccgtgtcaggtggcctgttctaatgggctcaccaccaaggcaatgtgcatatggcttccgagctaaggcacaagacatgcatttaatgtagagaacattttccctcctctctaggtagctcttatggcatatgtggtaaccccttaaggtacaaaaggaggtccaggcctacgaaggaggtggttgaaacctaaaaattctgaagggaagctgagtcttagcttcctcgctagagattcagagactttgtaatcttagaaaaattatcatacacatgagtagggtattatgctccttagcggcccgaacctatctaaatctcttttgtctcacccctctcgagggcccgaccccctcatttcttcaaatacttccagctcctcaattttcatccactgccctaggccgaactaacaaaggaggagcctcacggtcccccgctcgaggagttcatcctccgataaattccttttcgccttctcccctaagtaatccggtaaactcctgtggtgcctccttaggctataaaaggaggcccatgtccttggtggggggatcaaaagattagcttttgcataccaactctagtttgtacatccgagattcagagactttcaaagctcaaaaaaatcatcatacacaggagtagagtgttacgcttctcattggcccgaacttgtataaactccttttatctcattgctcttgaggggccccgaccccctctacagcacacatccatccaaaccctcaattctcacccgctaccccccgcccgaattaacaaagggggcctcactcccccgcttgaggagttcacccaccggcagccacgtaggacaaaactggtgtcaaccacctaatgacccagagtaatctgtttttgtaagttatgactcagggtgatccggttttgtaagttgagggatcatatatatctggtttttcagttgagggacgatgttgtaattcggtgacaagatgagggatcttatatatactttttccaaatggcaaacgctcccggttggttcgggactagccccgattttggcccagctactcaggcccaataagcagaaggagaagcgggcgctgcgcttaggtctcggtaaggcaatgcgcttcgcggcggcgctgcgctgctccctcgcacgcgcgtgaccgcgccgccgccgttgcctcgcctctcctcgcagcctctctctgcctctcctcgtcgccactgagcactgggtctcggtgccgccgccgccgtccgcttgtcccgagccgcgtaggccggaggacgggggcgcacaccaccggtccccgccgcggcgccgcatcggcacagccacagaccaccgccgagcgaaggcgtccatctgccgcaccgccaccggtcgccagctccgggagctcgggaaccccgtctgactggctccctctcgcactgtcgcctgaccctcatcccctgcccgtcgctgtcgaccgccgttcgcggcttctctaccctccgcgccgcggctcccggctgccgtctcctgctcctacaggttatacctctagctcatatcttcattattctcactgtgtttgatcaaggaagcatttgccattgctaaatttgtgatgtgccgcggacttattttagtttgtaggattggtaaagacatgaagaggagtggggagtacacattttgaactatctgtattgtaatatgtgcacattttgaacttgctagttaaattagttgattactgatgttataagatattattggtatatttgttcgccttttacctgaatttgtactcatgggatttgcggtgatacaaaattttggtatgtgatgtgaacttgtgaagcaggaccaccggacgaaaatttcttgttacgccactacttcataagctactgcgacgatctctcttcctaggcacctccacccggtggcctggctacctgctacaccgattcaccctttacttgggtattgtttcccccatttgcaaaatgctgcctaaggtgagcttgcttttttcccctcctcttttcttttttcttttctgttcgtatgtgcttgaatcggtcactcactttttctatacattacgattaattgatgttttgcatggtctaaggcactaggcaaaactaatgttgtactgaacttgctctctctttggtttctcgaaataagttggctgaacccctgcctgcagcagcccgtggtggtttcttggttctgttgttataaatgcttaattgcgcaagtgcttacatggagtgcttatatagtaaatagaatcagatttgtgttgttcatattttttgtgtgtgatgcttggcagttgtttatgtataaaataataggaaaaggtagttgtctgagcacttgtggtaccagtagtgattgatcgtgtcctgtttacttgtagtattgttaatatggctatattgttagtatggctgggttctctttgcttttgtatcaagtaggagtctgcacgatgctgcaatcctgtagatgcagtccctaggctacgctccagttagtgaaggctcagtactgctgttctagtagttctagtgtgtcgagggaaggatctggtccgctggctctgtgtgtgtgtgtgtgtgtgtggaaactacttaccgtaggagtattgacttttgtaatgtcttgtctcctaaacttctcccttcttcctaccatgttttctgtacttcaatagaaatgggcatgcccttatcaaaaaaataataatctacacttgagaaaagaattttgcagtagacaatataaattatatatgagttctcgatgatatggacacatccttcttttaggcaccatatttataagcaccaatcattcacataacctcaagttctttatatacctcccattgtacatgatctcaagttttcaaattcttgtatatggttgtatgcttgtttctttataggaggtagatatcaaatgatcctaatggcttttttttaatatgatgtttcattaccaggatacttttgataatctccaagccaaggttcaaatgtgtttcgttaggataatagctatgagtgcaggaaaaccgactttatttgctccaggaatagttattgcgaagaagaagctatcatgctacgtcataacagacaaggggacattttgttatggttctgaagggctctatgctgctgtttttcctggcttgaacatggagagtgtggcgattaactttaccgatgtatcaattgctgatagttgtctctttcatgctaagcaaaccaaaatgcactaatccattagctgctgtgaaaatctgtgaatctggaccgttgattaatgaggatgtttacaccttgggatatcagaatccaaaagtaccttttatctcctggatcggtccggtgagctaaaatccttatttttatctaatttcatctgtcttacttcctctgtttcattaacatcaatatgaatgtgggaaatgctagaatgacttacattgtgaaacggagggagtattaaatgattatattagatttgttggttcttatgaaatgcttaattagtcctattaaatgattaaattatatttataggctcttatgaaatgtttaattaggtttgtaagaaaggcggattttactcatgattgtgctacttccttgtgcctcatttgggtcccctgtctttactgttgatggtcttttggttgggatctgcttcgacaatagaggtgctgtccgggcctataaggtgcaatctattatacaacatgttcagaagattcaaacacagataaaaagcaaggtgcagtattttgaaatcttttgcaatcaataacatcacaaatttctcttatttacaatctcttggtttttgtgtaggcaatcaaggacattttgcagccttttatggaccaaaagaatgttttattagagaaaaggaagccaccagttgatactagtgccggagcttcaaaaaagagtaaaaccacacgttgatagcgtcagtctatcagagcttcgaaaaaagagaaaagcccttagcaatgcacataaaagatgaaggcgcaagctaacagatagacagtggttacgtaagtttctagtgcatcacaatatgtcaggacatcttgttctgatctttttgttcgttttcatcaatttagtttttttttgttaattatatacttgcagtttgtgcgtggatattcgcatgctctatgactcgtcatgcctcaatgatgcttcttcacccgttttcatttggctgatggaaaatcttttggaggccagcttgtggattgtaggtggctgccacaaaattgtgattcctttctaggggcaatccagggctgttaaaacctctcaagctttcaaattgtagcagctgtgtggtgatatgcttcctcagattacagattccggataccctattggtttctttatgcttcctcagatttcagattccggatactctattggtttctttatgcctgacccgcagaactgtttattttttgatgcttgcgttgccctgtgccctactcgcttagtgttgtctgttcttgtgaaacgtgttttagtgggaagtctagtaaaaaaaacaggtttagtttttcattctgttaacatgtatttaatacatcctccgtttggattatataacacccccatcggtttgcttatgcggttgcttatcgaataaaaatttaaaagttacattatttttaaacttttttatttatacacgtgtttttgaaagatctacgaaaatactctctgtcccacttccccataagttgtttttttatgggattggatgcaatatacaccatcgttccaggtgccagaccttgcggtggcgcggttcatagtcacattactcgctggttgtacaattgaggaatatgattttaacaggagcaagaaatgaggaaggcaaaatagacttaatcctttctggactgatgtgtgggccttgtttttagctgggctttttctttagagtgggctgccagcatgcacatgggcctcaaacccacatatatcactttaaaatttgttttaaatttacatatacaaagtttatagatataaactttacacgtgcaaagtttaaatgcacatatatgtaaaatatatacgtacaaaattgctatgtatagttttttctgatgtaataaaattctatatatatatttttctcgagactaatttaacacaccgttgaatttgtttcaaatttatatgtgcaaaatttgtacataaaaagtttgtacgcatgtacttacaaaatttgtacacatataatatgtctatacatgaagttttatatattaattattttgcatataaagtgtatgtataaattttttgggctggaccatcacactattaggatgaaccactcaaggctcggtggagagatacggaatgggaaatgattgctatcggctaaagcggttgctctgcatggaaacgtggtcgtgcatggcgaccgaatcgcgatcgatcgccgattagacctaccctctaattcaacatgaaatttcatcgttaatgcaaagtgatgcaagcacaagcctcgacaatgatgcagacaaggtaaggcagctgcttgagtttgatcttctccggtttctccttgatcttgtccttctagtccacctccaagttcgtcagcagctccaaattctgaaaaatctgcaaaacaaacccccaaatcagaaacgtcatttgatggtccaaattgctattggatctgaaatatgtagtttttcagtgcttcattggctgtttcgatcgtgaattcgtgaggcctagaatttgtttggtcattcgtttgtgatgcaaaatttgtaaatagaattctcacaccatagcgcgttacacgttgttttcagtagggagtgtttaaatctagggggtaaagttttggcatatcacatcgggtattatatatgatgtcgtaaagggtgttccggcactaataacaaaactaattacagtatccgtcagtaaaccgcgagacgaatttattaagcctaattaatcttgcattagcacatgttattagtagcaccacattgtcaaatcatggagcaattatgtttaaaagattcgtctcgcaaagtagccgcaatctgtacaattaattgttttttagcctatatttaatagttttatgaggtgggtgtttaaactttcaatgtaatatggtgtaaaattttagggtaagatataaacaaggccttaatgtgcaatatgctgagagctattgaatattgctggtgagttgcacttcacaaactcttctctgtgtaatatttgcgcaatctaacagtacttttatttgatctgttgctaacttgttactactacttcgatataaaaaaaaagattggggcttccatttctcttctgttttgctggagtatggggttttacttttgaaattcgtacttttgtttaacaaactgtcatgttccttctgcacattgttgaaactaatacaaagtttcagtgctaaaattattcagatcttcagagctatgaaaagcacttcttcgtaaggaatgacttaggtggtgtttggatccagagacttaattttagtctctgtatttagacactaatttagagtattaaatatagactacttacaaaactaattacataaatgaaagctaattcgcgagataaattttttaagcctaattaatccataattagagaatatttactgtagcatcacataggctaatcatggattaattaggttcaatggattcgtctcatgaattagtccaagattatagatgagttttattaatatgtagcatcacataggctaatcatggattaattaggctcaatagattcgtctcacgaattagtccaagattatgaatgggtttttattaataacctacgtaatatttataattagtgtccaaacattcgatgtgatagagacttaaaaatatttttaatcccatctaaacagggtcttattcttcttcgctactacctgagagagaaagaagcagacactaaaccccaagaaaagaagtgagtctgagcaatgttgccaaaaagtttcggccaaaacgggagcagaagagcaggagaatggctcaccaagaagtacgatatcggcaatggctcgtagagaagagggggaagatggataaagcggaggtgctttagcataaaggaatctcaaagtgacctggccattcaaaagaaaccaaattgagattttcttttttccctacaaatgcccgctaagaactcggctatgcacgaacacaaatgtctgtgcctatcgggtgagtgagaatgcagcttcaaatctgaaccctccataggaaaaatggatggctaccatcacatgcattcctcatcaaaagtgcgtcgattgaggggtgcggcggtccgcggtccgcggtccggcattgtctcggggaaaaggctgctagcggttacatcacatattcacatgcattgtcatcctgaggctgtgaccatggtccatggcttacaagcaacgctactactaccttcccgaatgagtgactgcctccgcctagctgctagcgggtcacatgcatttcatccggcccaaatgagcgactggcccatcatctggcttgttgcagcgagagacgtaatggaatcattgcctaaaacagaaatgagtcaaaaacgcttttgtacatctgcctagcagctcagcttgaccatacttgccatggagcttcaaatggtagaatgggtcaaaaacactttcaaaaagatcaacggccggatgcccatgcatttaccaaccgggtccggctgctataacaagccgagctcgcacgagccaaggctgaccttcgagcttaacacaggctcaacctctgcgaggctccagctcgattcgtctgagctcgttaaaacatgaacagacaattaagtttatctagagcaaacaacgttgtctcaatattttcattctcataatcaacagtacaccgagacgacatgtttcaacgccaaaggaaaagaaacaacacattgtctcaatattttccttctcataatcaacaaggcacgcaagaacatacaccaagataactggactgctaattagttcagtacttcaaattattacnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6952 - DNA, 638 bp, Oryza sativa
tttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaa

SEQ ID NO: 6953 - DNA, 700 bp, Oryza sativa
tcttgcacctgcacccgcagcgtatgcttcctatgtagttacacccctggtcatgttttacacccagaatacagacattttctccataattcctgtgtaattgttcctgcaaggctgagttgcagcaacaagcaatcatatgcaaattttcagtcaagattatgtcatatcagtgcatgattctgtaggcacaagtgcactgcacatattaacccagcatgctgtggcatccccttggctacctccacctccacagtgtgggagaggggtacctgaggcccaccagagaataacaccacaagggcccaccaaacatattgtaacaactcacctccctggtggcctagtggtgcggcagggacacccgccatgctgctcctttgtgtcccctcaggcgccggttccttaggatgcgcacgcagcgtgcctctgtgagatttaaaggcaaaattcaaggactatttaagggcatttctgtgtgtgaatccttgcccgttaaaggtaatcttattgcgagttcctggtgcttctgtgctatatagcttctgttattctgtgatctgatatcctgttgtgacccctgcctgtttttggacgattctgacttctctatcctgactcttgcctggtaaccgacttcgcttatcctttatcccttctgattgatctcctggtttaacccttgcctgtttgactccac

SEQ ID NO: 6954 - DNA, 11893 bp, Oryza sativa
aaatggccataacttggccatttgaactcggaattggaccgttcaagtctctaatttttccttaagaagtcaagaacccattttcgtgtagatgctgcagcttcggaggatccgctcttcgtggaagttgaagccggcgtttgggaaagcgagcaaggcaaggcacatcatccttgaacatattgaatcccagtttataaaattattctgatttgaattattgcattatcgctttatttaaattcccgcgttatcactgttttatttagccatgcctatttatcattgttaagacattattattgctattgttattattaccttgttcaccctaggaaaataaaaccccaactagtgggtactctatttatggttccactagtatgaacttaggtagatgcttcgctggttaattaggcaacattaggtggttttataactttagactttgggaaatctcatatcatttggacattatggaattgttggattatggtggaattggacatacccctctcttcctctttcaaagcccctaaaacctgtttttcggtggggttttggtgcatgccagttgtgggaagtagcaccccgaccaatataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggtacagggctggtgtcctgctgctaggggctcaatcctgcctacctgtcccggaggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgcccctcggttatgggcaagccgagcaatgtacccaagttagtgttttaattcttaaaacctgcttaacaactaaaatgtggaatggttggcctgggttggcttgggacgagctgggacccagggtcgagttgccagttcggtctgaatcatcgtaggccttgggttaaggcaggttcgtgtgggtccacggccttgattaataatattgtatagctctaggatcgtgtttacaaaatagctttgggcaactaagtgacttttaaatgctgtttactgcaaaacttaacccctatattattatccccttgtacccccttgcattaattatgcatctccggtgtggcttgctgagtactgtggttgtactcattcttgctcaatcttttccccccccccttcagtaagagaagctttggagaagaagtcttaggtggagtcctagcttataccccagttgagcgcctgtgaagatggagccgtaggcccgctagtccgctgctgtttattttttatggtcaggccttaagtgcctttgtaataatgtaaatattatcgatataataaagatgtgccttttgtatcatgtttgttcggtgtaccccggcttttcctgggacggggattaatacactagcgttcgggaaaaggcaattttcccggtcgcgacaagtctttagtcctggtttgtaacaccaaccgggactaaagttatgatctttagtgatcccggggggcctgacaagccctgactgcatttgaaccgggactaaagatgttctttagtaaccgggactattatggaattcggccgaccgacgaaatatagtttcttcaccagtggtaggactactgcctccaccaaagttgctgatcggtacacaatgactaagggtcatgatcctcatgacagcatccccaagggtactgaaattactgatcctgacccagagaaagccatccccaaagaagaccgacgagattagtgagtctgatatctaagcacaccgcctcgcctttacttctccaagaatcacaagtggttaatttcttcatttttatttttaacgtgtgcagtggttaatttgttatttttttcgatcaacatgtgcaatacacgtatagttgattaattacttgatttgctggaatgcaaaatgtgatgtaacacgtgcattaatggttaatttgttcttatttttttatcaacatgagcaattcacccaccatcgtattttggtttttctaaatactaattttgtcatatttgtattttccatgtatccaaaacataaatgaagagtaaattaaatgtttgatcgaattcaaggatcatcttaatacttattggttcaatgaatgcgtacgtaggcaacactttacactcggccttctccgtatatactttcttgcataatttgcatatatgtctatcaggtgtagtgccacccttatccaaaaaaaaaaaaccaaatcggctagggtttcaactgcaagacaatgagaggcggcgaggtagtggttaacggcgagaggcggcacagtgcggcaaggttcgtgacaattggtggcacaatgcggcttacacgctcgggatccccatggcttctccaagtggatgcaagggggtatatcaaatatttgtgaaatgttgtgatgcggatgaagccaagtgcataaaaattgcctacatagcactccatgttgacggtcagccataatcaaaagacgattgaatcgagggtggtagttggtacaataaataaagtgtaccgagctaagtgatattatcacacaagtttaaggttcggccttatatttcactagtttttttttttgaaaaatgttgctatattcttatataaatttgatcaaactcaaaaaaagaaagttgtcttgaaaaatttaaaaatatcttatagtatgacggggagagacaatatcttagtttgatgggttataaccccagaaatgaagactttattcaacaaatatttttggaacgctagaggacggagtatgtcacaatctcggtgcccgcagggtctttgagactcttgcctcggactggtaatgcttcccaaatcaattcgctgtcagcccacataggagatacgacttagactccgtaccggctacagcccgtgcagccacggcctcatcgcagcgattccgcttcctcttcttgcttgccgtcttcctgacgtggcaaagtacccagtagtcgtcgtcgtcttcctcctcgtcggcgcgccggtacgtaccgggttccgtgatctcgtactccgccaagacccaccctcccccgaaggtgctcagccggccgccctcgtcgcgccggtagaagcagtagcacgtcttgctccacggcacgacgacgccgaggtcggtcaccgacttgccggacccggtccagctcttcttccacagcccgcccgcaccgccaccgcctccgcctccctcggcgacggtccgccgcacgttcggccggcggcagcgcctccgccgcacgaagtagaacgcctcgccgcggcgcctgtcggcggcgcccccgtgccgcgcgacgaggtccagcggcgccgcggcggcggggtcgtccctgacgccgatgacggggacgtcgccgtcggcgcagtggaagccgcggagacgcgggcggaggtggcgcaggacgagctcgcccaccgtcggcgtgtcctggaaacctgtcgcgcgcagattatcggacgcctcgctggcgtcgtccgggggatcgacaaccattccgtcttcttctacttcctccttgaccttgctgggtctccagcagatggttgttggttgcgttgccgcggagcttggggatgcgcgggagtggtcagctgcagcagcgcagatcgccatggcgcgaaggcgaaaagagcgcgcgcggcgtgtgcgtggcgtccgtgtccgtggcggcggcgatttttatgaagcgaatcatctggtttgttgtggcccacgatggatgcaggacaccgaactgaaattggtttcagttgtaaacctgatacgaaacggagtttgaagtggagtcctgttacagtgtgagtaatccggtttagagtttagaccatatgtatcaggtgctgcggcctgcgaaaccagaggtgggctcgggtcggaggcgacatgggccacggcccagtacatagagatggagaatgggagacgaaagggacgaaatggtccatttgcgaccctcaaccatgggctgattttgattcgcatttctcgaatttttttatttatacattttttattaaaatatttacgaaaataatttttttttaatctagtcacctctcgccctttccagagagcgataagggatctaaatgcaaattttccagcacagcttgttagctctataattttataatttaaaattacattatataaagtaaaataaaataaaactttatatcaaaattgtagagcttgaggagatctacaacaacaacttttacatttaagatcttttagatatccaaatatttgttacaaaatataaaacctatttaaaaaaatttcagatctacattttaaacgatatcggatggagataaactttatataaaagttgtagatctcgatgatatctgcaactttatagtttatcacttttccagttaaaatcaattgaagtgtcgaataagcattattagtatttaagcattaaaactggtggaaagggtttgaacacaaataaaaaaaatttgcatttaggtccctatcaccctttggaagggcgatttttaaaaaacgcctttccagagaggcgactagatttgtaaattttcaaaacaaaaaattattttgtaaatattttaataaaaaaatgtaaaaataaaaaaaatcggatttctctattgactatcacaactgttataaccggatcattagtcctccctcactggttagcaaggtgcttttgaccgatataggacctgcatagtattacagtcagcacagcacatgacaatgctttaagctgatatgacatctatgtggcattatcagagaaaaaaacatcaataagatccacatcagtcaacctcatcttcttcctccaactcttcatgtccttcatgctctctctcctacaccctctacggcaaccctacatagcaatactagcaaggaagaagacaagacatgcagcggcctcaaacggtacggtgatgacctaggcagtagcagcagccaataaggatgatgcatggttacagggaaaggagcgattgtgttgatttggtgggcgactgcatcaatgacttcaccagatcgacagtgagctctagcgcgttctccggtggccaccacctccgtgtgattctctagcaagatgacgagatggtgtgctcaagcctctacctctccattgctcgtggccaccacctcatcgcccttcccgttgcctcctcatgaccagtggtcgagctcgacgagagccctattcatgtgcctccttccttccttccttccctcgcacttgccatcttgtgttgtgaccaaggggcgtcctcacctcaccgtttgtgtccctcatcatggaccttcgccgctgccatgtcactgttattgacttgtgctacacctaggatggcatcgccacctcaccgctactaccaccgtcctcaccaacgagtggaggacggcaatacaggggaactgaaggagtagcatgggcgtgctgaggagtgagccgaaacggaagggtgccacggccttcggctacacaacatgctgctccacgccttcccggtctggctcctccatgatgtcgatctagccattcatggcacctgagctcaccggttggcggttgctcgaagaggtcaagctgttcggatttggatgggccacaccaggagccgcttctcatcctcctctcttccttcccaagcgtaagagccacatagccgctggccttatcgagagcatgggtgtcaatgttgaatcggcctccttggtccccaattgtcggctcaatctgctgccccggtggcagcaactgcagaagtctctgttgtccggttaggctccaccatacgctatactactgccactacaggttagagagggaagagaggactgatgattgtggtagagaaagtgggtcactttactttttattttagagaagactgatgattgtggtagagaaagtgggtcactttactttttatttttcttatttgactgatatatgggtcccacataattttttatttgtatgataaaaaatatcactgatatgtatgtcttattttgttttataattgtcatataaaacaaaaccatcgttaaatcgttcgggaagataaaataaaccgtttcactagttggaagtgcctttatattctaagggtgtgtttagttcacgaaaagaaaattttgaggtgtcacatcggacgtttgatcggatctcggaaaaaactaatttcataactcgcatggaaaccgcgagacgaatttattaagcctaattaatccgttattagcacatgtgggttactgtaacacttatagctaatcatggactaattaggctcaaaagattcgtctcgcgatttccatgcaaaatgtacaattagtttttttctttatctatatttaatactccatgcatgtgtcaaaaattcgatgtgatgttttttgggctaatttgtttagaaattaaacaagtcctaagttctatggttgaagttaagggttgcaaatcagatacgcgtggatgggcgacgagtgtggcgatgcggtgacagcccacgccccacagcctcagcagccggtggcctgacctcaccaccaaccggcggcctatgcgcggggagcgagcgtgacgatcgatcgagaggtgatccacaacaagtgtccacaacacatcgtacgcttgccgacactactactactaaataatcaatcatgtgtacatcagtgctccgtcctacgtacgcgatcgatcgagttagtagctagtgcgagtgcgacacgtacgtgcatggacgacgcgcccgaaactaaggcgaaagctcgaaaagcatatcaatcacactccagcatgcattcatctaattaaaccgtaccatgcattaagcgtacagctagcttcaaccacaagtcatgcctagcttagcctcgtggctgctgggccaacacacaagtacacacaaccaccgtccgagatcgaccatactgattcactgctttggcttaatttggtccacacgacacgaacaacatcatcattatatattggagtttattcttttggattcgtgtaccggtgcgtgcactgcactggtctagctcgcaggctatctaccaattaaactttggcccgatgacgtacagctggatggctagctgttaggtgttcgactccggtactgtactagtgtgttaggaacaaacggttcgatcgatcgctttgtcgaccagaccaccatctggcgcctgcagcacagtcagcagcaacaagccgattaatggcaccgcccttggctatgttgctggtttgatggattttttacacatgcgtagccacaggcccacatgggcgagacaagtacgttacacgtggacgcgaaagcgacgcaggtgcaaacatgagcaaattaaagcatgctaatgtatatttttgttcgatggtatcagtaaggtcaattcttgtcattgttcacggctttgagtttaggccgtatcgaaagtaaaagaaattagtggtaggctgcaaagataaataaaaaaacatggtaattaagccagaggccgcggcaacaacaacgaaagaggccagacaatcagccaccttacaggttataagttcaaatagagacaataaattgatcaaagatttacccaaaaatgtcttaataatctgcttgaacagagctccgtcgaggatgcgatccatagcttgtgatgtaattgctcgtttcaggtatcaatctatattttcccaaaatacttgtagctttgagtttttatttgtaacgtttgatcatttgtcttatttaaaacattatgaaaatattatttattttgtttgtaacttgctttattattaaaagtactctaagtataactcctattttctatatatgtattaatttttccaataaggcgaatggtcaaacgttgcaagcaaaaagtcaaagcggctactaatatagagcggaggtagtagttgatacctacttacttctaaatctcaatatgcaaatatgtcacatcatcacccattagtaattattatctaaagtattttaaatcacaatgcaagtgtaccacatcatcacctactagcaattattatctagattatttaaatctcatgcaaacgtgacataagattatcattttattgtatatttagaaatcaatatgtaagtaatgtttactcatcatttcatattatttaaacatatacctattttctataatgtaatatatattcattcacatattctgtagcaaagcgcggggtatgaactagttcttgccataccgagttgcgccactctctccaagcttttcagtttgcttttaatatatattaaatgccgggcctttcttgcaatttaagcataaagaaaagttaactttcttttttgacaaatggtccaaccatgcatattcgtgattcgtcccacctaattgatgaaattactatatgcttactatatgctttttaatatacgactagtgttgacttttaccattcgtcttatttagaattcttatgtaaacataaaaaatataaatcatgcttaaaaaacctttaatgctataaaccaataaagaataatcctcaaggttcaaaatctgcggaaatcataagctccgaccgaagccattattggagattaaggaaatttgtgatcgttcgctcctaaggtaaagccataaggacatgtacagacgcaaatcagattgggtgttggagatttttatgggtaaggagttaaaggacaaatggacatcaaaatatatagttgctacatgtcttatatttgttgttgtatcgtttgtgtctagggttagacgcatggacaagcctgcttagtcgctgtcctatacaagggctggatcttgtttgtttgattgctgccccgagagatctttccactcgcctggcctaagagaacttgcctgtggtttggttgcagtaaattaattgtcagctaatggaaccactaaaatatttttcccttaacccgaattgttttatgactactgatttttttctcaggcacgtttagccttagttcttcgagaaaacagaaaccaaatgggcaagcctcatcagattttagcaccactttttctcagtcacacacttcaaactcatcatacttaagtgtgccacatctcatatatgataagtttggtccccatcggttggctttttccctaataagccaaaacggcttattagggaataaaaataaatttgtaggtaaaatttttatatatgtgttcttatgacttaaaagccaatggtgaaaaagaaactatgttgaaaatatctcaaaattaagttagaaaatttaaattttggctttttctttggctgattattttttataagacggggagaatatataactagcgtactatagctatagatggccatatggcccgcagcccgacagcccggcccaaggcacgggcgtttggcccgacccaagcacagcccggcccgtcagtgttcgtacccatgccggcctggcccgacagccgggccatgcctgggctcccgcagcagcacgctgggccggcacggcacgaccgggctagcacggcccaggcctatataacggtaggcacggcccgacgaggcccatcgggagccgctgccgcgcactcgcacctcatatataaaggccgctgcgtcctcttgcctccgccagtcgtctccctcacaaccctaaccctaaccctagccgcctccgccgatccacgcacgcctccccctccgcctccgccaccatcttgaccgctccgcctccgcttctgcctccgtcgatccacgcctccacctccacgcgaccacgcctccatctcgtcgccgtctctgatgaacgcctcgccggatctaccatcgagggtcgccgcctcgccggatccgtgaccttgtctcatctcctcctctccagtcttcggatcgtcggccgtgctctcgatttcctctttctttctcatttttttgccactctcgcccgctcgctgtttctccatgagctctttgtcagatcactccccaaacccagtctctgctctcttcttctcgtagatccgtcgatctctatcatcaacggcaactccggtgctccggatgcgcaggtacaccgtacacacctatctctgctcctctcccctctcttggttttctacttctctctggtccctaactgctctcttctcccattttgtgtgtcttgcaggtcgctgagcggtagccgccgttgaggaaccggagtgccgacgatggacgatccatcctcttgcaaccacgagttgaggttgatggggatacggggtgatgacgaagatgacttggaggaggaacgcgtgcaggtgttcggaatcacttcatcacctcctcacttcgatgggtcacagccggagacggagccggacgtggacggtactggtggcagggacggtgatggtggcacaggcgcgccgtccggcaccgactccagtgctaccaacaagcggccaagatcatccaaggtgtcacaccccgaagttctcctcccaagcctaaatttaatttataaatgaccccaagaaaatacaggtgcaaagcaagagtaaacccttttaaatcaatgcaaataataatcggaattggcatgtggaatttttcttgagttctacatgtcgaaattcactaacaggatttttagtggaattttcagagccctagaaataattttaaccaattaaaattgagcaagcaatattttttaattccagggaaaatcctttttcctttttctttttctttttcctttctttttcctccttttttcgaatgggccgccggcccattctctctttcctcccctcctccttgctgggccggccgcaggccgaggcccagccaggccggccgcctccctcctctgtccggggtcgccgacaggtggggcccacctgtcgggtccttcccccacctccagccgacgccgcgcccgcgatcgccgcgcccgcaaccgccgccgcgtccacgccccgcctcctccggtccacgtcggccacgtccgcgcgtgcgccgcgtctcccgcgcccactcctctctctcccccgctcgcgcctgcgcccgagatggccgggattcgattttcgaatcccgcctctctctcctcccccactctccacgttggccggcgaaatctcgcctctcccggccacgtccgactccccctctccctatttaagctccgacgccaccccctctctctttttccccatttcgccgaactctcccgagcctcccatcgctcccgcgccgtgcaaccacctgccgccgccgtttccgctactccggccgccgctagccgccgctagggtcgccgccgcgccgcgccgtcgccgccgtcgggttcgcgaggctaaactctaccccggccgctccttccccgtcgagtttcgtcgccagaattcgcaccccctcgcgctccggtgagttcaaccgctaccgccgccttcggccatgaatgccggtcgccgtggttcatctccctctctctaatctctctctcttccttccttagggcaccccgaaacccgtccgccggttgccgtcgtcctcccgtggc

SEQ ID NO: 6955 - DNA, 27047 bp, Oryza sativa
cctctccttttgttcgttaggaggctccggagctcgtcccgctgtcgccatcgtcctccgtcgctcgccgtcgtcgatcgttgtcggtgaggcctctcctcctctttctctctctctcccgcaccgtttagccgccgcttagccacgtagctgccgcttcgccgcgacgccgccactctccgccgccggccagtcgccgccggccgccgtcttgcgccgctgccgcatgtgtgccgcgccgtcgcgcgccatggtcgccgggccggtttgcgccgtgcccgcgcgcaccagccatcggttcggccgccgcgtggcgcgccgctccttcccggtccgtggacccgatccgccgtggaccgccctccccgagccgctgaccggtggggcccgcttgtcggcgcccttcctccctctccgagtcactgccatgcgggtcccgcttgccagcgccgcgccccgccttgatgacgtcagccctggaatatattgcgcaataaatgatttaagatttttcttttatagtaataaacacagtgaatcttctaaaattcataactaattcatccgagctccgtttaagcccattcaagtctcagtaaatcaagaaaaatgtgtagaatccattaaaaatggtttcgttctctgtttcagtagtcttatagtctgtttgcaatgtttgctttgtatgtcgctagattccggttcctccgacgctccggtgtacttcgagatagtcaccgaggttcctccagcagcagagcaaggcaagtcatgcttgtcacttgaacatgttgatcctatattgcaaatgctctattattttctttcaaatattgcattgttttataatgttactaggggttgtttacctattgccgtagccatgctattgttgtaccttgtttctttgtcaacttggggttctaacatggttagagttaggactagggattgcttagccatgcctagttcaactagttcacattggggaaaatcctattaatgattagactgtcggttctaatggttttgttgggttagtgacaccgctttggtgttggttaattaaaatgaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagttgggacgggccctgcgacggcctctgtcgcttccggattcacctaggcacgagaggggactgcccgctgccttgcgaggagtgggggtgaaacctgaggtgtggtgtgcttggctagagggggttatgtgaagggtcttgtcacggcctctttccggtatgtcgtggtggcatgtcggcacacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttgaaactggatagttttggtggagggttgggcctgttgcaaagtgggatagcgttggacagtggatagttaatattaattaattattacaactgtttaatctttcaacttctgtttataaatgctcgctttatgcaaatgaaccactctagctcttcttttataattctctacatcatacccctattccggtatgacttgctgagtacagtgggtagtactcagttttgctctatttttcccaaccccagagtacgagtatgtgtcagatggaggtttctctgaggagtaggcttcgtccgtgccgtcgaggatgcctgtggagtggtgttcccgctgcagttctagtcaaggcttagctcctgttgtctttctttccttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacaagttggtatcagagccgaccttgaccgtaggacaagccaaatggaaaaacctaagagccctctgaatccttttcattgcatatgttctttgcaattggatttgttccggaaaaattgggatctgttcttgtggttcaaggggaaaaatcttggtcgctcgtttaagtgagatttgtcaaaacaagtcagtccagggtttttgtaaaactattgagatttattcgtcagtcagttgggatttaatgggtgaaatgcattaggtcctagctcaggaacatgggttgcaaggtatttatgctcttactgttattattagtatgtatctaatttccccaatattttatcgttatgtgagtctgtcttatttattcgctctcatgcaaaacgatctatgcataaaattttgctcttattcgattctcttatttgagtcttttattgctttatttaaatttggatttgagcatgcattgatcctactcctttgtcttctctagatggccggccacccacccaaccaccgcggagaaggcatgattgactttgtggcagagttggcacgtatgacgctggtggtgggctaccccaacgcgccagagtacacgactgttccaccgctcagtggcgagcttcctcaccgtgttcgcctggaggttcacggctacgtgggtacctgcctagctaatatggtggttgaggcatccggaggcacagcagatcacgcctgtcaggaggcagcatacctgatgatggccagactacgggagcgccacaactacatcttccacgacacggcgtaccgatttcaccctcgtcgagccagcggtgatgatgtcagtactttccgtccgacagccggcgagaacgacactacctttggtcacatgtgtgctgtgatgaggggattggataggatgcactcagacttgcacaaggcgtccaaggccttgaatgatgggaagctcatgaggatcgtcgctctgaaggacgagatagcgcgcctgaagagggataatgctcagttaaagggtcttcccgcgccaggaggagtccggatccgcactacgccccacaagaccacgactgcacccgtgcgcatccagcttgcgcccaagaacccacctccatcagcagctcccgcagcacctccagttccgctcgcagctccggtagttcctgcagctccagtaccagctctagctcccgttcacgtgtcagctcccgcgtctgctctctccttcgctccagcatcagccgctaggggtccagccagtggcaacggaggttggttgtctgctactcccagtggcagctgcgatctcagcagcagtagatccagtggctcagagctgggcagcggcgagacttatctgccaggctccaggagtcgctcagagggacctggtgacgagcaggacgacgccttcgactccaccgaccgtaggagccgttccgagcattaggctcattttccattagtttatcgtctgtctagcatttgtttgttagtttgtgtatttaggttgcttgcttgtgggtcagtcgacggtcgatatcatgtgcctatgatatggctgtcttaataaggatttttgcttgctttttaagtgttttaattcagatcagaacaattacagtttaaattcctatataataaagcttagtttttgagcctctatttttcttcttttcccccgtctgcttttcctccagatggtctacaccaggaatggtagccgcgcaacaggtgagggcagcaacggcgaagagcgcactgagggtgtgcatcccaacagcaattccggcaatggtccgccaccacttcccgagaatccgacgctagcccaagtgatggcacatcagacttagatgatggcagccatgatgcagcagatgcagcagcaacaccagcagatgcaccagcggatgctgcagcacgccgaacagcagcatcagtagtttggtccccctccccctcagtccaagttgctagagtttctacgtgtcaggccacccaccttctccagcaccaccaaccctatggaggcgaatgactggctccatgccatagagaagaagctgaatctcctgcagtgcaatgatcaggagaaggttgctttcgccacacaccagcttcaaggtcctgcgtcagcttggtgggacaatcacatggccacccgcccgccaggcactgaagtcacttgggaagagttctgtcgtagcttcaggaaggcgcaggtggcagatggggtcgtggcacaaaagaagagggaattccgggcactccattagggcaacagaactgtgacggagtatctccatgagttcaatcacctcgcgcgatatgcaccggaggatgtccgcactgacgccgagaagcaggaaaaattcctagcaggtctggatgatgagctaaccaaccagttgatatctggagattacgccgatttcgaaaggctggtggacaaggcaatccgtcaggatgatcaacgcaacaagatggacaggaagaggaaggccgctcagttcagggcacctcagggaagtcaccagaggccgcgcttcgctcccgggcagcagggtggacctaccaccatgatcgtccgccagtaccgcccgttcaaccctagcaactttccccagggcgccagtggcagtcagaaccaccatggaggtcagcccaaccgcggtgcagctccacgcccaccaacggcaccggcacagtcaggcccgtccgcgcaagccaagagggagactggagcaaaaccagggtcctgcttcaactgtggcgagcttggccacttcgctgacaaatgcccgaagcctaggcgtgccgggccaaggtttatccaggctcgtgtcaaccacgcatctgcggaggaggcacaagcagcaccagaggtcgtactgggtacgtttcctgttaactcaatccctgcaacaatactttttgattctggtgcaacacattcgttcatttcaaagaagtttgtcgggatgcatgggttaaggaaagaagagcttagcacaccaatgagggttcatacctcgggaaatagctcaacctcagtcagttttagcccttcagtgctaatagaaatccaaagatcaccatttctagccaacctcattcttctcgaatccaaagacctagatgtcattcttgggatggattggctgaccaagtttaagggagtcatcgattgtgcgaatcgcacagtcaccttgaccaacgagaagggagaaacagcagtgtacaaatcaccagactcaccaaagcaaggggtctctttgaatcagattgaggcggaaatcccagtggacaccgtgaagaagaatttgaggaaattggaagatatacccatagtctgcgagtatccagaagtgttccccgaagaccttactaccatgccacccaagagagagattgaattccggattgacttggcaccgggaaccgctccaatttacaagagaccgtacagaatggcggccaacgaactagcagaggtcaagaagcaggttgatgagcagctgcagaaagggtacattcgaccaagtacttcaccttggggtgctccggtcatttttgtggagaaaaaggataagacgaagaggatgtgcgttgattatcgcgcactcaacgaggtcacaatcaagaacaaatatcctttgccgcgaatcgatgatttgtttgatcaactgaaaggagctaaagtgttttctaagatagacctgcgatcaggctaccaccagttgagaattcgggaagaggatattccaaagacggccttcaccactcggtacgggctatatgagtgcacggttatgtctttcggacttaccaacgcacccgcattcttcatgaatctgatgaacaaagtgttcatggaatttctggacaagtttgttgtggtattcatcgacgacatacttatctattcaaagtccgaagaagaacatgagcaacatctccgtctggtactcgagaagttgaaggagcaccagctatacgccaagttcagcaagtgtgacttctggttgacggaagtcaaatttctgggccatgtcattacagctcagggtgtggcagttgatccatcgaacgtagagtcagttaccaaatggatcccaccgaagaccgtgtcgcagattcgaagttttctaggactggcaggttattaccgccgattcatcgaaaacttctccaggatcgcccgacccatgactcagttgcttaagaaagatgagaagtttaaatggacagctgagtgcgataagagttttgaggagctcaagaagaaattagtatccgcaccagttttgattctgcccgaccagatgaaagacttccaagtctattgcgatgcatcccgtcacggacttggatgtgtcctaatgcaagagggcagagtggttgcgtatgcctcgcggcagttgcgtccacacgaagggaattatccaactcatgacctggaattggcagcagtggttcatgctttgaaaatctggaggcactatctgattggcaaccgctgcgaagtatatacagaccataagagtctgaaatacatcttcacccaaccggacctaaatctccgacaacgaagatggttggaactaatcaaagactatgacatgagcattcactaccacccgggtaaagccaatgtggtggcagacgcattaagcaggaaaagttactgcactgccctatgcatcgagggcatgtgtgaggaattgcggcaggagtttgagcatctcaacgtgggaattgttgaacacgggttcgtagccgctctggaggcacggcctacgctcgtggatcaagtcagagcagttcaagtaaatgattctgaaatagcagagctgaaaaagaacatgagagtcggaaaaacccgggatttccacgaagatgaacacggcacaatctggttgggagaaagattgtgtgtacctgacgacaaggaactgaaggatctgatactcaccgaggctcatcagacccagtactccattcatccaggcagcaccaaaatgtatcaagacctcaaagaaaagttttggtgggtcagcatgaggagagaaaagctgaattcgtcgcactctgcgatgtttgtcaacgagtgaaggcagagcaccaaagaccagcaggtttactccaacctcttcaaatcccagaatggaaatgggaggagattggaatggactttataatagcactgccccggacatcatcgggtcacgattcaatctgggtagtcgtggatcgactcactaaggttgctcacttcataccagtacataccacgtatacgggcaaaaggttggcggagctctacctctcgagaatcatgtgtctacatggagtacccaaaaagattgtatctgatcgagggagtcagttcacctcaaaattctggcagaagctgcaggaagaattggggacccgtttaaatttcagcacggcctatcacccacaaactgatggtcagaccgagcgagtcaatcaaatcttggaagatatgttgagagcttgcgctcttgattttggtggagcttgggacaaaaacttgccatatgcggaattctcgtacaacaacagctaccaggccagtctacagatggcaccgtttgaagctttatacggccggaagtgccgcacacctctcttctgggatcagacaggcaagcgtcaactgttcgggacagaggtattagcggaagcagaagagaaagtcagaatcatcagggaaaggttgaggattgcccaatcttgacagaagagctacgcggataaccgccgaagggagctcacttttgaggcaggggattacgtgtatcttcgtgtcactccgctccggggagtacaccgttttcagacgaaaggcaagttggcaccacgcttcgtgggaccctacaaaatcttggaacgaaggggagaagttgcttatcagttagaacttccatccaatatgatcggcatccatgacgtgttccacgtgtcccaattatttagcaaattacgagaatgcttcaacacgttggcattatcgtaatttgctaaataatatttgacaaaaaaatcgagggggattttttttatatattttgaaccagtcgatttgcttgcagactcgtgcgcaactactcctctagctttagtgaccgcggtggctcaacaagctagtctttagaaggaggatggaggggagggcagaagagggggaaatcgtcatgcttagagggatgactgtgaaaggcggtaaacataggcaggtcagcgagacgatggtaccgaagctgtagagatgaaggagggtggtgggccactggtagcaggggcaaggcaaggagagtagttaggaggccggtagtggtggatccgatggctcccgctgctggagataggaagacaacaggcgagggcatctaattgctgccagcttgaggaggagggggtggcggataaggcccaccgaggcagggggtcgccggcaccattggcgacttctagccaagcgcgaggtcgagtaatggacgggcatgctgatggaactaggactttaagagtgaggaggggggagaggtggggttagagttagagtactctacaaatctcaaagcaatcgaatggtgcataatttataagattttcttggagtgtttttgtgtgaaatgcaaataaattatcccttttttaagtttgataaccaattgattatccatggattccatggatgatctatactactattaaaagatagtattggtggtggtgagtctgccaccagcaccatcacttacatgtggcccatgatattaggattttgggcagtcgtttatattatgtagactgcagatctttaattttctaagcatgatatttttgtttgtttcttttagatgaaaggttgtgtttcaaccaattaaaaatatagttttttttaaccaggacttaatattgctattttcaatactgttgcaacgcacaggcatttggctagtatagtaataaatatataaaaaggcattaaaatgttgttttaagagtaatattggagacaaacaaaaaagggtttgttggaactatgccaccctatatttgcaaaatttgagatataccacccgtatctccgacatgtaggacccacatgagtcaatgacatgtggaccagggtggcatatcacaaatttcgcaaaatttgtgtggcatggttcaaattgtcccaacaaaaaatgtgtaacatagaccaaaagagactccatgtattataacatcataggagatgcaaagatactctatacattataatatcgtaagatcaaagtactctatatattataacatcgtaagagatgcaaatagacgagcacatcacattgactactctaatatatgcatgatcatattgacaagaattggtaagcagagttgtcaagggatgtcatcccgacgtcaacacgatggcctactactagagaggaggaagaaatagatctagcctattgcttgttttcaatttttgatggttcaactcaacgtattagatgtttcactagttaggtaaaaaatgttgcagtgattttttttggtattctttttgccgaaatcattcggatctactgatgtttcagtggtccaaaaccgatgtgtcatatgttgtaccaaaatgtttcaagtgtaagttgattgtgtttcatcgtttagattgttgatgttcaaaagttgagacatttttgttcgaggaatgaaaccttttttttctaaaatgataaaacatgcggaacactttgcaacattttacgtctgatctgtagtcgccaccgtaaattataaattaggttaaaaagtgagctactcctataaattagttcaggaattactctcatatatacatagccctctaatattggtcggatggaatgttagattttcttttacctcaccgcctcaccggtaaacgagtcaccggctatcctggccgggcaccccggtctaaaaggcccaatcccatatgtggaacaccgaacgtccctttggacggaccagattgctccgacctcaccgtctctcttctttctccccaatccctatagctctcgcttcgtcaaattctccggcgtttccagttcaaaaataaaaaataaaaaatctccggcgcaaatcctcctctccgccgccgccgcctccacctccaccgctcgccccctcgccgcgcctccactcctcacaccacgctcctcctgacctcctccctcgcgcttctccggcggcgcctcgctcctctgcgcggaccgttgcccctggccgagcgcggcgcggcgcgggccgcccgcggggggatcgggctcgggtagaggcgggcgacctggcgggggaagtaaggggtcgcgcgtggcggggagatgatctacacggcgatagacacgttctacctgacggacgagcagctgcgggactcgccgtcgaggaaggatgggatcgacgaggccaccgagaccgccctccgcgtctacggctgcgacctcatccaggagagcggcatcctcctcaagctgtatccttctgcccctcctcccagatccccccaccttttcccgccttgttcttatgcccaagtcaaatcgttaggggtctctcaagcatgctagggtttccagcggttcagtgattaccatccatgtttactagcgctcgctgaatcgcaattgatagggttatttggtttgcttagttttagttcgaacgttgtgctttggattagggttttggttttgtcagattagagatgcttctcttttatattatccagctaaactaatgaaaatgtcaatgttttctctttcttttcggagtcttatgtttttttttcaatgtagaccaatacatcatttattcagtttgatgttctcaagaagattaacattatataaggttacacgcatcactgaatcttgataattttgattccaatgaaaaaaaatgcaaataaatgtgttatgtttctttgtttatgatataggagaaaatgaggatctcttgggcttacttaaggtgataagttgttccaggacggttgatagttgccattgcattttgtttgtagaattttgtcttttcatgccattcaggtcatctgtttttaacaaagttcacaagcttgaaatctgtaaatttttgttgggcaaggaatcaggatgatatgggtattaatcagtgtgctactcacatatattaggttatgcactgttgcatggttttttctgtttaatgaaatatgatggaaacagttgtcggttgctgggctgaatgaagtggtacttgtagtaaatggtgctcgctacaccatcttatcttctgccttgcagaggtaaaataaattggatggaattgatagttgatgtaaaatacataaaatttgtcttctcaagccattcaggttatcagattttcacaaaatgcacaagtttgaaatgtgtaaatttttattgggtcaggactcaggattatgtgggtatggatcagtgtgctacccacatgttttaggtatgcattgcctcatgatttttgctggttaatggaatatgatggaagcagtaggagttggttgctagggtgaacgaagtggtacttaacttgtagtaaatggtgtttgcaacgccatcttatcttctgccttgcagaggaaaaacaattcggatggaagagagagttgttgcatatattaggctactttataaattatatactataagtaaaaacctttttctcatactgacctatttaggagagggaacaaatctataagtcaaatagtggatggatcacatgcgtgtccatgtttttacatcgattacaaatttgaatattctcatatctgaggttgaatttagatatcatcattgttttaacatgaaatgatccaaaatgccagaacatgaaatgtgcatcctatggagtatttgggaagcactgaaagtacactctgtggagtggcaaaaatgtttttcactctgttttgttagacatgccacatatatcttcattgcattttctagttaaaatagaaaagagcataatacaacatatccaatggaaaacattaaaccatatttgcatctgtcaaatctagatgagtggcttatgaattgggtagcacaacaaagaaacaacagttgtggtcaagccaccatatttgcatccattctatttcagatgtcaaataatttagttagtcagatgtccaaccaaactaggggtatcaatcggatacgaattatctgtagactacacaattctttaggttaaaatatggtttattatttccatcggttaaatagtttttccctctatttgattgtgtatatgtgttctacatttccaaataatgttatctgagccgtttgtattcaataaacaatatacatattttattgtagtttgcctaacagttttttctttttatgttttttccctgttcactcaatttaatataattattagttatgttttctaagaggttaaacgtccttaatatcatactgctacataaattacatggatattgaaaatccaactgaattacttatgtgtttgtttcatatttttattcatcacaacaatcagttttcctttttagtccgtgtgagcgtatttgaatatcttttgttatgtgcttaaaacatgagcatgaatgtgtaaagaccttactcgattcttattagatctgttgacatccctaccccataccgtatttcatgttgccacaattgatgtagcaaatcttcaaagatatctagttgggagatagtgattttcataattttctatgtagcttgaatttagctaggccccattcttgcaacttttattttcttttcttttttaaaagtataatatttgcatgtggtggattccttgacgcaccaaagaccacaagcagtgatggccacagcacaagtattgtttcatcgtttttactgcaagaaatcatttgttcggtttagcgttaaggtaagcaaatcttttgtctcagttactctgatcaaaccagtctttgattttatgagttgaaccaatgaatatctctgtttatgcttgcagagagttgctgcaagctgtgtttggctggcagggaagttggaggagagtccaaggagatcaaagcatataatcattgtcttccatagaatggaatgtaggagagagaacgtaccaatagaacacttagatgtgttttcaaaggtttatctgtttctttactctctgtttattttaaatattttttgaacctttgtgcacttcaaatcttgatgtctctagttcttgctctcttgctgctagagctgtaatacctatgcttttttttagaaaatatgtaacttttataaagaattatgctaattgaaagctgtaactatttgttgcagaaatactcagacttgaagcatgatctggtaaggacagaacgccatctgctgaaagagatggggtttatttgccatgtagagcatcctcataagttcatatctaactaccttgcaacacttgaagcccccgaactgacgcaagaggcatggaaccttgccaacgataggtacttcatttgaactaaacttaccttattgtagttagatattcttattgaattttatgcagttcaattatatcttactcttaagtcttaactagttttttatagtccttgggaggtatttctagttgtagactattaaggctgtgttcggcagcttgtgttcccaacccctctccctcgttttctgcgcacacgcttttcaaactactaaatggtgtgtttttttgcaaaaaaaattctataggaaagttgcttaaaaaaatccatttattaagttaattttagctaatacttttttaattatgcgataataagctgttacgttttccatgccggagggatagactcccaactggcacaaacgaacacagcctaattgtacctgttatcttataatacctcccaaggaccaaaaataataatatattctaccttattggtgaaattttgttttagtttagaattattggttctcttaaaagatttttccagcattgctcttgacttttctcttatagtactttgtttgtctcgcagatccttaccatttctaattaactattgaaaagcttgactaagtgataccttttattttctgtagtcatctgtctgtatcatgtcatatatgtacatgaatccttaatattctgatcagtgtaaattatgaatgagttgcctgtagtttcagaatgtaccaatttgctaattgcaacagcaaaaatcaaataggggttaaaatgctcaatgaactgtattctggacatatagttctcccttatgcaatcatatgtataaagttgtatatagtgctctggcacagaatgataacagtgaacaaatatcaaatcttcccatgacagtgataagatccagttaacctagtgcaggtttgtagtttcagcaatatgaatgcagcattgttaaaggtgcctttagaccaaaacaagccttcaataataatcgcattagcttttggattttgaaaacttagtcacatatgctggcccaaattacaaggagtatgattatgctgtagaacttgtgaatgaacttgatggccaatacaatatttttttataaaaaatatgagtatgttaccaaaatgttgttagctgatgatcagccttacacttcattggaagattatcatgtatgttgtatgaaaatctcatttatatctcttagcttcagtaagataagtggaagagaagaaaagaaagcaagggaaatgtaacgtgttagcactcttggtctaatgcaaccagaatttattgtgcctttaccgagatgacttttattttttttttcatgtaatagtatatttagatgaccaacctatttgccaagatgatgcctgtcagccatctcataaggaatgcatgtgtcaaaatattttaaaacttcaagtctgatcagtcaggatttagtgtaccataaaatagatttattatcaaggcttactgcttttgccttgagctttttcaatcatactgagagttgagttcaatttgcacttctaattcaatgcgtattttgcataacagcttgcggacaactctatgtgtaagattcaagagtgaagttgtagcatgtggagttgtgtatgctgcagcaaggaggcatggcgtgcccctccctgaagatcctccctggtggaatgtgtttgatgctgatgaggcaggaattcaggaagtttgcagagttcttgctcatctctacagcctccccaagtcacaatatatacaagtgtataaggacaatgattccttcacgcataggaggacttctgatacaaatgcttcaaaggttaaaaagaatgattggactcgctaagtttaatttaaaaaattgttaccgatgtcatttttttgtactcacgtgcaggaaagtcctgcaacgactgttgcaagcgataagggtacccctgtaccgtcaagttctagccaggaaaaggatgcactgattaaggcagggtcagataaggtgaaagaaaaaggtgacgatgatgggaagacgttaccttctgaacccaatggtaaagaaggccctgcagtgaatttgaagagtgagaagtcagaatccaatgttgatcgctctcgggaaagagaaagagatagatcaagagggcgggaccgtgatagcaggggccgggactctgatcgtgatagcaagggcagggactccgatcgggagagggagcgtgatagagaagcagacagggataggcagcggagacaccattctaaggacagaagttcaggtattgccattgatttttctgctttggctctttttataagcatgttacgttttcctgatgttgcatgatgcccctccaatgcaggatactctgacaaagagaagtcaaggcaccgctcatcaagaggtatgctagcacattagcggccctccagtggaccatatatagttttcttatctgcttcattttggctaccttttcagatcgtggtgatcactacagttcgcactcatctcgtgacaaagatcggcacaggcggcagtaatctagcagagctcgaaaacatgtaaactgatgaagtacacgttgcactatcgtggtaaaattgccattgcaactgggctccggggtgtttgttatgattgttaaactctttttttatttgcaacagaaaaagaattcttcttttgtggtgagtatcagacttcatagacttagctttgtatgacgcgtgggtctgggcatgaatcacttgttatgggagaaacttattcttgctatgcaaatctatatatcagttgattctatactatggccacccagattttacatagaagttgcctaacccttcgatcctcatccatgtcgtgagttggattagcatagggattaacacttggattagtgcttggtgccctcagttccctgcctctccttgtggcccaaattgttggatcacccactacctccaggtgtctgccctgccagcgcctccttccactgctcctccccctttgtggcccaaattgttggcccgctcactacctctaggcggataccctgccttgccaccgctcctccccctgatgcactgctatgttgtcgatatccttagctaggcgctccccccccccaacccccacccacccaaatggtccaaattgtcaggctgctaaccgctgttgtggtcatcctgtgtccggtcccgttaccggccctcaaattcgcatggtgtcactgtcgccaagcgcagcagccctcaatccgcctgcactgttagagatcgctgtctcaacgattgcatgaagtagggctttatctgtgggaggatcctacttgcgctatcgtgtccttggggggactcgatatcatcatctctaacaacgctagcagatcctctccgctagtgccacctaaccctatgaaccgcactcatgccactgcctccgccgctgtcacctgtagcctccatgccaccaccaattgaaggacaagtgccattctgaagattatactaaaagcagtaagacaagagcttgggatagtgtccaggaagacgacagataggtacactcttgccaattattgcagataactcaggcttttactttgtacaaatcagaagagaagaaaacattttctttaatgcactgttgggagattttgtatcatcatccaaaggggaatgataggttgtcccagaaaaagcagaaggctcatgtcgatcctttggagagaccatctgcatgcacaaactcaaaactctagtgaatttcattacaaccccgacattaatacctctgatcctttggtgagaccatctgggaagaagctggaaaaggcaaaatgcgcgcgaggtaatacttcttcatgctcaagtgagagtagtcctgtagttattgcattaaataacatatggttagagaaaatgtagatgagtgcacaatctagggagaaaagaaatgaccggttggctgaagttatttcacaagagaaagaaaggttgaaagtagagaaacgaaagttagatttagaaacccatgaaagagaagaaagaattatgaacatggatcttagtgctagatgggccaagaaaagcatattacttgtgtttgcagcaggagatcatatcgtgtcatatggattgagttcatgatgtatggatatatatgtacggataaggtataccctctacccttggatgtacgctatatggcaatatggtacatctgcgcgtgtacggacgttctctgtatacgcgaaggaaatttatcacgaagtccaccaatggaaaggttcctacccgtataggactaggtcgtcactgtatcgtgcagggtccgatgtctccgagtcctacttggagaccacctgacctgagatataaaagggaccccccgggaggacctaacgcatcgaatctcatagccaatacaacgaccacagcctacgaagccagagcctacaggagccaagtcgccaggtgatctagtcgaatcaactcgactacgatctcatcggtatcatcaagttctattattccctttgtaatttgtggttctctccatataatcccatatcaactggattagggctattacctattaaggggcctgaaccagtataatctttgtctcttgtttccttgatgtcgtattacgtagatcatcgtaccaacgtacctcaataccctctatatccggtctacgggtacccaccgtcgacagtggcgcgccaggtagggggccttggtgctcaaggttctactattatgacatcaagcttcgtcaacaatagcgtcaacaatggagtcaagcaaaaatctactgtatgatcggcaacgatctatacaagaaggcgccaaacgggttacttcacaaatgtgtctcgtccaacgacggcaaacacctcctcctcgacatacacgaaggggtctgtgggtcacatgccgccggtcgtacattggtcagaaaagcctttcgacaaggatttttctagccaactgccctcaaagacgcttgcgacatggtacaacggtgtgaagcttgtcaatttcatagcaaacacacaaagcttccagcgcaagcactgcaaaccatccctctcacttggccgttctcgtgctggggctcaacatacttggtccattcccacgaggacaggccggctacaaattcctgttcgtggcgatcgacaaattcaccaaatggattgaggcaatacccacgggggaaatcaaggccgacaatgccatcaaattcattaaaaggatattttgtagatatggattgcctcaccgcatcataacggataacggctcccagttcattagcgccgatttccaagattactgcatcggactggaagtcaagatctgcttcgcctcggtttctcaccctcagagcaacggacagttcgagaggacaaacggcatagtactacaagggatcaagacccgtgtctacgacaggctcatgtcacatgacaagaagtgggtcgaagaactcccctcggtactctgggccgtgcgcaccacaccgacaacgtccaacaaggagacacccttctttctcgtgtacagctgagaagccatggtcccgaccgagttacgacatcagagtacacgagtacagaagtactccgacgaggatcaggaggaacagcgaaacgacgatgtgaacctactcgaggaacatcgagaacgggttgtcgttagggcagctagctaccaacaggccctccgccggtatcacgagaagcgcatccgagcacgcatactttcgatcggcgactacgtcctctggcgagttcaaagccaagcagggtgaaacaaactctcacccaaatgggaaggaccgtacacgatcacacaagtcttgcggccaggcgcattcaagattgcagacggcgatggtcgcgagttagcaaattcttggaacattgaccaattgcgtaaattctatgtataagtcaatagtatccatacttgtaagacatcttacaacttcaataaagcctgtttcaaggtacagatttcaatcaaagtgtcccttcccgatgattccttacccagatgacacctagcgttgaaacctatcctcatgttcctttacgccgtcctgacaaggcctccgaggaacctaagggaacttcggctgaggacgcccagagctgataatgccttgtcgaatcctttagagacgaaagaccatgtaagatctggtcatgtaagagttctcgccgtgcgtattaaccaagccgtgtaattggaaatggattttccaactttacggctgggggctaggattagtgcttatgcaactaaggcaagtcggtccaagagccttatcttccgagaaaaattctccgacgataaggctgggggctagggagagtgtatgactcaagtgactgatcgaagtcacgaagtgagaagacactcgtacacaccgcatccagagtaagaaaagcttagttagatagatttcctttctacttcacaagtatttcttacagtctgcaaaaaattccgaaatatattacacttttcctaagatgcttgtcacagatataaaaagagtaccaggaaggccaacgccaatccattgactggaagactttctccgccagcggcgccatcaacttcgctaggttgtctatctccgcgggagtcctccgagaatgagaaaacccttcgtggaggaactcgaggtacaactgcggacgatgatctcgtatacacaccagcacgtgccctccggcataccggctcgatcgacggcactcctgcttcagggcctcgtcgatacgcttgccgatgccttcgagctgagcacaggctccgtttagccacgagatatatccggccgctgactcctcgggatccccgcgaggtactcggagttccctgcagacgacggccatgactgtgcaacaactcctgaggtacgagttgaaccacaccttgcgacctctgagtgcctccacagcccggtcctttttcacttccaacatagtcctctcaagttcggcgacctcgaacttcgtcctccagtattggatgtgacggtcgcgatcagcaagcgcactctcgaggtctgctcgacaagcaaacaactaagttaagctgttctcctcttttgagagcacggcaagttaagctaatccagatagaagagcaaaggagatggaaacaaaaagaaccaacctaaaggagtcgtcgtcatgcatgtctccacgggcagattctggtctatgtcgtcttgcggcacatacggctcaagcgcaagtgccggaatgattacaggcaactcaggctgcccgcgttgctggacatcctcgacatcgacatctctacaaacaacaacaaagtactcggaatcaaaatgccaaagaaaactaaggtgataactgcacacaccaaggcagttggaaccaacaaattgttttacaatgcatgattgattaaggagtacaggcgaaccgaagtcctactcttcaaaaagtgggagaatagactctcctagatcactgacttcttccatcacgtccttacgcgcgtcgttagccgtcccctgatccaaaatcctttggagatcgagctcaaggtgcgccaaccttatgcacgcgaggacatggcacgtcccgatgtagatcccgttggacgtctcctctctgatcttggtcgcatgcttggaggggatcgcctccatcaccgtcgccagttccgcgagcgaagtcgtcagcgagaactcgtcgggattcaccgggatggtggtcgtgacaccgcactccccggcgagctggtgcagaccggtgtaggtaacccacagcgagccacggatctccgacaggttgttctcgagctccgacatacggtgctcaagcccctgccgttaccgttcgttgccggccaccagctccctcattttctggaggtcctcgcgaacctccgtcagatcacgcgtcagcctgtcggcgcgttcgttcgccgacgatgccgcagccgccctcgcatccgcaatctcgtgacttatgccgcgagcaccagcctcgaggatgcgtcccatcttgacttggagctcctcccaggtgaggacgacagcaggcgggtctcgagcgggcacaagatcgctggctgggccgctggacgtcacctcgcggctcctgggcacaaccacgacatcggtcgaggccactgcaggagacgcgcttgagttccctctagacccatcttgcgtagccttcgcccgtgctgccctacaaaagattgccatggtggtcatcataacagtatgccagaatccgatcaaggcaagggcctcaaattttgtccagttacttctcgccgagtgtcaccggcctctgtcgtcgtggaggcgggggagacgcatccgaggcctaggtaaaccgagtacgatgtgagagcgacatcttccgactacacaatcgataaccaaagaggcttaccgatggggtgggcgtcttccggcggttgccgagcacggaggaaaacttcctccctttcctcagaacattgccaccactggtcgtggcagcagcagcggcaagggccccgtcggacgcctcctgggcaatgccctctttcaacgaagctaccgcctactggtccacgagcggcccgatgatgtcagccaggaggagagcctgcacaacatgaagtcacaatacgatctaagagttaaaaggtaaagggtcatcgattacactcacgttgattgcgtcttcgcgctcagccgcccctttctcgcaaagaggggtggggacgttgctcgccgtcgtggggccactgaccatcacctggccaacacgatgctccacggttgcgctattcaaacctgtagatcgagaaccaaatttcgataagtcaggaggaatgcgcatgaaaggagaggaacccagaatacaagaaaaataccccgaggagaaacccgggtcgcgtcctctggcccagagtagtcaaaggctggatgggctcgagcctggagcggctggatccgtctaccaatgaagtcggcagcgacttcatacctcgacaaccctcgtactcggaggtcatcgatgatatcgatgaaagactggaggaatggggtcaaggcgggtttggcggtccaagacggaatcttgtctggttgctcctcaggaacaatgaagactggatccgaatcttctatctgaagatagaaccacctcgcccgccatttgctatgagaagaggggcactggaaagggatgtatcgcgacttcaggccatcccgaagtcgaaaaccagcatacccggatacctttttaggttccatccagtgcaactcgtagtaaaaacggaagaggtcaagaaacggctctaccccaatgtaggcctcacagagatgagaaaaaatgctaaggaaggctatggagttggggttcagatggagcagagaaaggccgtagaagttcaagacaagaaggaaaaactcagatggcggaggaagaaaaccacagagaatatagtcctcaaccgcaaccatgcggcccaagacgggttcaggttcagtacctcctagttccctctccatggtcccacgactggggagagcgccctcctcctgcaacttcttcaaggacgcactggtggaagtggacttgtcgaggtccatcgccgctggagatcgccggagaagaaaccgaggcgagcgagttagggtttgcatggaagcggagaagacgaagagcgtttggaggctaaaaagtttttcgcaacagccggactctaaaatggattcccaaaacccccttaaataggcgcactatcgacggtgcgaattccaaggaaaggagagagatggccgccggaaatttctgggtccgttgcacgaggcggtttttggacttcaatttaaattcacttataaccgttgaacttcggatggtgttgtcgaccactccttgtctctacggttctcatactgagatcgaccagttgagaacgacagcaacttcgacatcagaagtcgcgatcggttacatgagttcatttaagcagaagtcgggggctactgtcagggttacggataaggtataccctctacccttggatgtacactatacgacaatatggtacatctgcgcgtgtacggacgttctctgtatacgctaagaaaattcatcacgaagtccaccaatggaaaggttcctacccgtataggactgggtcatcactgtatcgtgcagggtccgatgtctccgagtcctacttggagaccacctgacctgcgatataaaagagaccccccgggaggacctaacacatcgaatctcatagccaatacaacgaccacagcctacaaagccggagcctacaggagccaagtcgtcgggtgatctagttgaatcaactcgactacgatctcatcggtatcatcgagttctattattccctttgtaatttttggatctctccatataatcccatatcaactggattagggctattacctattaaggggcctgaaccagtataatctttgtctcttgtttccttgatgttgtattacgtagatcatcgtaccagcgtacgccaataccctctatatctggtctacgggtacccaccgttgacaatatactatttttactatttcttaataggttgtgaacttttatgttgtatgccgtgtaggctttgatgaattatgtactgttgcttgtaaaaactttatgggttgtgaacttttatggtgtatgctgtgtaggctttgatgaattatgtactgttgcttgtaagaactttatgggttctgaacttttatgttgtatgccatgtaggctttgatgtattatgtactggttattgttagaacttaatggtttgtgacctttatgttatatgcaagaatgctatgattaattgtgagcacatacaggttgcatacataattaggattgcatacataattgaggttgcatacattattgatgtattgcttacataaatgaggttgcatatataattggagttgcctactacataactgggaggttgcatactacactagttcctacaatgaaattgccatagatgctcaactagatcttcttgaagctgagagtgagtctgtctatttctaacgttatgatggttctgaataaagtcccacagctcagctataggggtatgcaaaggtgtgactcgctctccctcatcatcatagttgtagtcaaaaccttctttatccctctcatcttctactatcatattgtgcaaaataatacatgctgtcatgatttcacttaatgtgtctgcataccaaaatctagctggcccacacacaattgcaaaatgagcgtgcaaatctccaaatgcacgctcaacatctttgcgagctccttcctgttgttgggcaaagtgtttcttcttattcccttgcggttctaatattgtcttcacaaaagtggcccatgagggataaatacgatctgcaaggcaataacccattgtgtagttgtggccattgatgtcacgaccggaaataacccaacgggcgttccttacgtgcgtgcattattccttgtcccaggaggcaaggtacaccaaaagttgatacaattcagagtttaacaagtggaagcgtaattaattaatttattacatgggcggcgaagacccagcacacaagaagacaaacgaaaaacagcggaaaactagggcgacgaccacaggcggttgacggcaggcacgagctagacaccaaagccttcatcttccaggaactcctcttctgagtttgggaaaaattgagcaagactgagtacaaccaccgtactcaacaagtcacccacaagtgcagaataaatgcaagggagtacaagggggttataatatatagggttagggtttgcagtaaatagcattaatagacacttagttgctcaaagctattttgtaaacacgattctagagctatataatattattaatcaatgccgtgaacccacacgagcctgccttaacccaaggcctacgatgattcagaccaaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtggacatctttacccacaagacacatcttcctcacgtgtaaccacgtgccacataccaccacggtatacggacggaagacgtgacatagttccaacatatcctagccatagacaagagtaccgacccaaccccacctacggccggaacccctgggacaggtaggcaagactgagcccctagcagcaggacactggccctgtgccatgacatctcgactaccgggccacagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagacctgtccttatatggccgaggtgctactatcaaaaccatgcaccccgagcccagcctaaaaccattttgagggttttgaatagaggggaggtgtgaatccaattccacaatgatccaacaattccatagtgtccaggtgatatgaatatcccaaagtctagagttgtaaaaccacctaatgttacctaattaagcggcgaagcatctacctaaaatcatactagtggtaccttgagtagagtgtccactagttggggttttgtttattctagggtaaacaaggaaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttaccttgctcgctttcccaaacgtcggcttcaacctccacgaagagcggatcttccgaagctgcagcgtctacacgaccaacggaaaagaaaaggcttttactctaataaactccatataaccagcaagaacaaagcacaaaaatgggttcttgacttcttaaggaaaaattagagacttgaacggtccaattccgagttcaaatggccaagttatggccttttgaagtttatatgctctttaaatgaatatttgcgaatttcttcatttaaaatttaatttaaaaagggtttattgcgtcagccgacgggaggggg

SEQ ID NO: 6956 - DNA, 4469 bp, Oryza sativa
agggtttttctttttataaaataattttaactttgttaatttcataataatttttatttgtgctctgaaaattccactaaatttaatttacgcattttaggcttttaggatatttacaaaaatcctctaagccttatttgacttttaactttgcacattttaattgttggaggctttcacccggattttaattattctaggcataatctagaggatgtattttagagtcattttgggacgtgacaattgatttcatatttctcttgtggagcctatccttcagctagccttgcaaagagaggggaacgatgaagaacattaatatcattgtgagatcatggcaaaccgaagaatgcatgcggaatccaaagatcttttgaagcaacaacttccaaaactatagttcgtttgcttaattttcctttatacatgcctttccatgctgaagggcaatttttccactcccaatgcatgcaatctatggatccaagcattccaggaaaacttctctgctctccaagtgcaagtaatctagaagtgtcagcactagttggataacgcaagtactcgtctccgaaaatctcaacaatagctctcacaaaccttttcagactctctatagtggtactatttgcaatttgcagatattcatcttgagtgtcggctacgactccattggttatcattctaagtgtagcggtaatcttttgcaatggtgatagacccaaagcactagcatcatttccttttttgggctaccacatcattaactatatgcgcaagaaaagaggcgactcattccaaacctacgcaacaaaatgtgaattaatataagtggagaacaaaacaatatcaccaaatatatgtaaattaattgcaagccttctccagaataagactaggtcatatgtaggatgctccaataagtagttgtggtgcaacctatcatggccggctcgacgattacgacgaataacttgacgatcaggaacaaaatcacctcgccatggagcattcgactgctcatattcatcttgcgcgactattgttgcagcaacgatgatttcatcactggatgaagatgattcatccaatagaacatgtctcaaaatgaagatcattgagtgatggaagaacaacgcacaataatgtggatggagcaaaaagatatgagtacctactttacattatgttcatgttatactgaatagacggctagcttatctgggaaaaactttggtgtgggtataatgtttgcttatgcaattactctatgtgtggagattatgggtaccccatacctacatggcatagttatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaagtttctatcttgtaaccctgccccccaacctatataaggagggcagggagcccctctaggggcatgatgagacaacctgatcgtcagatcaatacatactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtagggggtgcgtcgaattacctgtcgaaaagtgcgatggaatcaacttcagaagaaaccccgagatcaatctcatcaatttcgatggctcaaatcttcaatcgggtctaccgttgcaatttaatctctattagattaatttttaatcattgtttgatttcctgatattttgacgaatttcatatactggatgagatcgaaacacggccatcatcgtcgcctacttgggtgcccttgccgtgtccgagtgctcctctcttcctttccttgcagatggacgtgttgcaggagtggcacaggccgccaggattcgattcctgtttgcatgtatgatggttgatgggctccgccggctacctccgatgatggcatcatgccgaaagaacatcgagttagctgttagttgccggggcttatacatgttgcatggcacgtcgccggctatcactcatgatccagcctcactgctcgacttgagtttttcgtttcaatttgttatcaatatatattagattgatttctaatctcagattaatttcttactattttttgttgttgttcgcatataactacgcggcactattgaggcgattgatgctggtcatggactcgaggcgtctcagctttccggtcgatcggccgcgagtccactccgccggcttgtcctcgccaccgccattgctgattgcaacaacgacttcaccaccggcctgcctccgtcgccgccgactggtgttcccgtctgcatggctggcctattatgccgccgctgttgggcgtctacgacttcaccgccggcttgcctccgtcgccgctgagtggtgcctccgcctacacggctggcctattaagccgccgctgttgggcgtccacgacttcaccaccggcttgcatccgtcgccgccgagtggtgcctccgcctacacggctggcctattatgccgccgctgttgggcgtctacgacttcaccgccggtctgcctccgtcgccgccgattggtgcctccgcctacacggctggcctattatgccgccgctgttgggcgtctacgacttcaccgccggcctgcctccgtcgccgccgactggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgtcttcaccgccggctcaccttcgtcgccgtcgactggtgtttccgcttacacggctggcctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctgatccgtgaaactttgttccattaatgacgaactcatgtcactcatatgcatgtttgggaagtgcctaggccgactcccggtgcttgatggttatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccgaccggcttgccttcgccgccgccgactggtgtttccgcctgcacggctggcctttatgccgccgttgttgggcgtctacgtcttcaccgaccggcttgccttcgccgctgccgactggtgtttccgcctgcacggctggcctttatgccgccattgttgggcgtctacgtcttcaccgaccggcttgccttcgccgccgccgactggtgtttccgcctgcacggctggcctttatgccgccgttgttgggcgactacgtcttcaccgaccggcttgccttcgccgccgccgactggtgtttccgcctgcacggctggcctttatgccgccgttgttgggcgtctacgtcttcaccgaccggccgctagtccgccgacgactggtgcttacgcctgcacggctggcctattatgccggccgtgttgggcgtctacgtcttcaccgaccggcttgccttcgccgccgtcgactgggtgtttccgctgcacggctggcctttatgctgcccgttgtgggcgtctacgtcttcaccgaccggcttgccttcgtcgctgccgactggtgttttccgctgcacgg

SEQ ID NO: 6957 - DNA, 4282 bp, Oryza sativa
  unsure (1)..(4282): unsure at all n locations
ccgccgaatggtgtttccgcttgcacggctggcctttaatgccgccgttgttgggcgtatacgtcttcacagaccggccgcctcgtccgccgcagattggtgcttccgcctgcacggctggcctattatgccgccgttgttgggcgtctacgtcttcaccgaccggcttgcattcaccgccgccgactggtgtttccgcctgcacggctggcctttatgccgccgttgttgggcgtctacgtcttcaccgaccggcttgccttcgccgctgccgactggtgtttccgcctgcacggctggcctttatgccgcaattgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacgtctggcctattatgccgccgttgttgggcgtctacgtcgtcaccgaccggccacctcgaccgccgccgactggtgtttccgcctgcacggctggcctattattctgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgctgccgttgttgggcgtctacgtcttcaccgaccggcttgccttcgccgctgccgactggtgtttccgcctgcacggctggcctttatgccgcacttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacgtctggcctattatgccgccgttgttgggcgtctacgtcgtcaccgaccggccacctcgaccgccgccgactggtgtttccgcctgcacggctggcctattattctgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcatggctggcctttatgccgccgttgttgggcgtctacgtcttcaccgaccggccgcctcgaccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggcctattatgcagctgttgttgggcatctacatcttcatcgccggtcgtctcgtctgctgctgactagtgcccttacctctacgtctggtttatacagctaccactactgatggacatcatcatcttccgtcgccgactgattatgctgccgccgattggtgcttttatcttcacaactacgcgtcttcactaccggtttgcttctgttgccgccgacttgtgttcacttcattacggcaatacaactttgtcatcatggtggagcgacttcatctttattatcttcggcaccggcaaactctattgctgctacttcgcaagttttactacttcaccaaccacgacgtctttgtgaacctcgacatctcggcatgcaatgccatgatattttactacaacaagtgactctccaatattcaagatttctacttggacaccttcaacacatatcttcaatcaagcaatgactactcgacgacaagaagctataattctcgactctatgttcagttgtttctcaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgttaagcctcttcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttcttttgttgttgttgttgggcgcctacatcttcactgctagctgacctgactgttgccgactggtttctccgcctccatggttatgcaacttcattacctttgattggtgtcactgtttttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatatattttggagtatctcataagggataatcactcagatcagaagctattcatatgagctacacctggtctatatcacccggaagatttattactcgagagcatgttacatgcgtcatcctttaaagggtgtcgaaggcatattttttggtctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatataagtcaaggtgctgtttgggtttttaagcaattgattagatacaatatcattgcttttcgccacgtaagtgtgcatttttattgaccaatattatggcttaggctgattatatattgtggtcatttttcaggcggttggtaaatcctttatgagtttatttacttggattttataccacatatgccatatatttccgggtgtggtgaaaccatgtgtcttttagggacttaagcacatctgttaaagcagtgtgcgcatggcgtatgcccaatactttggaaatttctttattcacaatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6958 - DNA, 30561 bp, Oryza sativa
actttaacaagagtcgtgctatgcttattgagaggttcaagtctgttaactctgttgctttgacatctaatatatggtctggtaatgctaaggaggattatttaagtgttgttgctcattttgttaattctgattggcaattagagaaaaggattttgggtctggtgctgattgatgtgaagcacactgctgagaatatttctaaacgtgtgctttctgttgttgaagaatatggtttgactgataaggttttttctattactctagacaatgcctcttctaatactaaggcaatggattttctaaaacctaagttgtctgcttatgttggtgatttatatttgcatcagtgctgtgcatgtcatataatcaacttgattgttaagactggtctagaagttttcaaacacatgcttcaagattttagaacagccatctcatttgtgaatgcatctaatcagcacattgctttatacaaaaactggtgtattgctaagggtgttcgacctcgtaagtttggtttggacatggatgttagatggaatgcaacttatctaatgcttaagcatctcttcccacataaggagcttttttcattatttattgaaactcattatcctagggaaaatggtagactattgcttattgatttgcactagacaattgctgaaactgtgcttttattccttgaacaattttatgattcaactgttattttgtctggtgtttattatccaacatctccattaattatgcatcacattcttgagattgctggacatcttaacacttatgagaatgatattaactttagaaatgttgttgttcccatgaaaagtaagttcttggcatactggtctgagattccatttctgtattcatttgcttttatcttggatcctagggctaagatcagaggttttagcaatgttctataaaatatgtcacaaattttgacctctgattactctacttatttaactgaggttagggctgcattgtctgacatttttctaagtatgaaagtaagtttggtgctgtgagattgcaaagaacaaccccaggcagtactgctagtaagaaaaagacagcctggggaaagatttttggtgccagtgatgcacttggacatggtgctggtgccagtccagaacctggacttggtgctggtgccagtccaggttctggacttggtgctggtccattttccaggagaacttctgctactgctttgattcaagctgtttcttctaatgctaacttgaatgcctctgagttgtctgcctatcttgactgtgacattgtcaaccaattcgacgatgacttcaatatcctaaactggtggcatgagcacaaacacacatatcctattatgtccatattagctagagatgtcttgactgttcctgtttctactatatcgtcggagtctgcttttagcttaactggcaggatcatcgaggagcgacgacggcgtctaggtcctaacatggtgcaagctttggcattgatcaaggactaggtgcaggtagacaagaagttgcagcacactgctgagaatgtagagcttataaaatcatttgagaatttgtgtcttgatgatgtaaccagtggcagtgccactggaactggatgattgtattggacttggactttaatatgatagttagatgaaagctgtgggctgcactcttttttcctttctagggttttctgacgaggtgtgagtttttacctagaaaggtttttaatgaggcagccattgcactacacagctactattatttttgaaagtgtttgtgacttgatcacttgagtttgaactgtgatttgtgaactattagacttagtatttgaaagtgttttgtagatttgtgacttgagttgtgaattgtgagacttagtagttgagttagagaattgaattgtgatattgcacatactataacttgtgaattgtgatattgtaatctgagacttgtgatattgtgatatgttaacttgtgaattggatggttttgtgctgatttttgtgatggacattgcattttcgatatgtatgtgcaacactgaagtgaacaagtggcagttagtgtttggcgtgcctgggctagcccgggcacggtgggctcatcgtgccgtcgggccggcacggcccggcacgactgctgtcgggccatgcctgggcctaaggttcagcccgtgggcaggcacggcacggcacgaagtgctaggcgtgccgtgtcggcccgatgcgtgccgggccgtgcctgggcttgaggttcagcccgtgggcaggcatggcacggcacgaagtgccaggcgtgccgtgccggcccgatcgcctcgggccgtgcctaggccgggccaggccgggcgggccatatggccatctataactatagcaactaaattgccctgatatattaggcaattctcaatacaactcacctgctagtgtcacaattcaagaggtacttatgtcgcctattataaaatagagtacacatggcccatgctagaagttatttgtgtctagaccagtagaagtctacgttggctcggtccctaaatacatatacatcgcaaagtgattatttctttattgttaactttcaaaatcaacaatttgtttatgtagcattttaagtgccttgcaaatttcaacgggactgtaactagtaccacttccatacaaaaataagttcactttatatatgaacctggtataggctatatctatatttatgtacaaaattgaagttattgtagaacggggcagtaaatatttttgagctagggttcaactatctctctttgtttttagttaccatgtgtattacatctgaaaaaaaaaataaatactccctccatcactaaaaacaataaatttggacttagttgagttttttttttatggaacatataaagtacctggttatccccaaccgtacgaatgcaaatgtcccaagtaccaattaaaagtaggtaaaattaactccaaagaagtggccaagaactcaaaaaccccgcactcccctaattaagacacaaaatggggatatgagactttctaattaagcaacggacctaatgtagaaaaaggtactactcgaactagaagatgtaaattccttcctctaaaccgtacgtcatccatatatagtgggaattagaaacggagcgctagctgtacaagttttcacaatttgagccttttaaaaaactaattttacaaatgaaccgccgccaaaacttattttaaaaatgatcctttttttcagcgccaaatcatgtggtgttgaacttagacacctcagcgccacatcaactagcgctgaataccgtaccaccgcagatgggaggctaagtcagcgtgccaacgtacattcagcgccacacgatttagcgttgaacagaagggtcagttttgaaataagttttgacggcggtttatttgtaaaaatagttttgcaaagggttaaattgtcaaaatttgtgcgctagctgtgagttaactagccactctatatatttctgagggtgttttttttatacagctttaaaagttctgggtgaaaaataattgctttttgtagttagggagaaaattagtctttgagcaagttagacgtcaaaaatgtactttacccaattaatagcatcaccaacaacattggctaaatttcatctccaaaaatatgaatttgagaatcttaaatgaaatttgatgtgtaaaaatagttatcttctgttaaaaaaattgggtaaaattaacccctaaaaccaaaaggtgggccctatatgaaactaaccaaaaggtgggccctatatgaaactaacataatatcgtacagacgggcacctgttaatcagtactacagttgtacaaactacaacgtaaaatatgacaatgaaagtagatattgaattaaattattgtgatcctatgtatttttcttccaacacctaaattaattaaagtggactatcatcgaagggcaagcatgttgcccgtgtacgttcagattaacggaataagcaccactacgtactaaaacagattcttgcgtaggatcggagacgagagacgttgaaatgttgacatcctatcatgatgatcccccttaatagctcgggctggtggttgccacttgcctgcagccctgctgataaagtcaggatctatctgtaatctgacatccgctcacattaatcccgtgacagagatctgcagacgctcaacactcgcataaaagaaaggcaagaattttgccggcgacttgcattggtgtacgttgatcgagttagttagctgggctacactaattggaaatataattaagcacatgtgggtacactaaacatgcatgtatatcaatagatccatatcatatgtatatgatttatacatgtatacgacagcactgcatgtgaatagatcaacacgaaacatagtcgaaacgtactgatggtttagttctaaaggacgcacaacaccactgctacaaaatacttcatatcttataggaaattgctcgtaggtaaaaccgacacatataaactttttctacatccgtgtgatgaaaaaaatatagaactagcatttttaaacactatagatccacatccgtgatgaaaaaaatatagaactagcatctttaaacactatggatgccagttcttaaaaaaaaaagggcacttatacttataagtaccgacacatataatcctatgtatatattcttatataattcatctcctccactaaatataattaatgctattctctcttttttcattaagccacatcacctcaattatttttagtctttggatgataggtctatggttcaaattgtctcttttttcttctctcataacactatgcgatctcacttgtttttaggatcaaaattcataaatatcaatttattttagttttaataatcatattgcatcttatttgtatatattatgaaacttaattttccacggtaacgcggcggagtattcatctataccaaaccgagccgagccggtgaaccgagcgccatccttatctactcccatccagcgctcgcgtcctatccatttctctcgtctctctccctcgcgtctctatgcctcccctctctctcgcacatctctcgcctggcgctcgctctctccctcgcccggcgctcgctctctctcgtgtgtctctctgcctcccctctctcttgcagcggctgcccagcgaaggcggtggtggcggcggcggcagtgggctccctaacgccagatccagcgagaggggaggcagcgctctccccttcgccagatccggtgagaggggaggtggtgggtttcccacgtgtgttcctttagttctcttcacacgcattacttaggccatgcttctttcagcttaatattattgtaatctagattattgacccagattactataagttggattataataagctgacatagttgttagctgtttgtttatctggattattagctttttgttagttgttagccacccaataatttaaaaaagcacctttagagtggattactagattatagtaatctggcttatagattgtaataatttattataataagctatatgttcgttgcagcttactcataataatccagattataataatcataagctgaatcaaacaggaccttaattgattagaagagcattaattattttaaggtggtttcacatgcatgcatgtctcccgtgggctaaagacccacgtataatttcatcatatctagacatatgtactataagcattaatttatgtgtagattaatccggctaataaaaacacaaagcaaacaaaaagatacaacacattcatactaaagttacactgttctatattttgcaaacttaggccatatatatttgtgtgcaagttcaagtgattgacagataaaaaaaatagacgactaacaaatagcaaaactgtaatttattttaatatcatcaagacacatcagcaacaacttgtatatatggtcaattaatatgtaataatgtattagtacccggcgtacaagtatatagatacacttgcacatacatcggttggctatatatataaccgatgagtcgatataaaattataaattaactcggctagctagctagatagagctcacggccggtcactactcaccatcgagaggagagcaaaaataattgagtgatagctgttagctaagctacctagcatcatgcagggaggcgccaataataagggcttggtatgcttgatcgccgccgccgccgtggtgttggtattcgccggcagcagcggcattgcggcggcgcaggcggcccgggctgaagaaggggttctacaagaagagctgccccaaggcggaggagatcgcgcagcgggtggtgtggaaccgcgtcgccggcaacccggagctcgccgccaagttcctccgcatgttcttccacgactgcttcgtcagggtacgcacacaaattgaatatatccatatactggccaatcatatatatattcccctctgtagattataggtttgactgattaaagttaaactgcttcaaatttaattaattttgtagacatatatataggatgtgtttttcccctttttcccaactcacatctctcgttttccacgcgcacgcttttcaaactgttaaactgtatgtttttttttacaaaaaaaaatatatacaaaagttgtttaaaaaaatcatattaatctattttttaaaaaatagttaatacttaattaatcatgtaataatacgtgcttcgcttgggaggagaggttcccaaccccttctcccgaacacaaccatagtaatatttacaacaccaaattagtttcattaaatcgataattaaatatatttcttaatatatttgtctaaattagttttagatcgataattgaatatatttttatgatatatttgttttgtgttaaaaatgtttttatttttttttaaacttggccgaatttgaaagtcagaacaagttataatctgaagcagagagagtatatccaaacgatacaccatgcacaattgtattcttgatgtgtgcaaatggatatataatgtacatgaaggggtgtgacgcgtcggtgcttctggactcggctagcaacacggcggagaagaacgcggcgccgaacctgtcgctggcggggttcgaggtgatcgaggaggtgaaggcggcggtggagcgggagtgcgccggggtggtgtcgtgcgcggacatcgtggcgctggcggcgcgggactcggtgtcgtaccagtacaggaggagcctgtgggaggtggagaccgggaggcgtgacggcacggtctccagcgaccaggaggcgctcgccgacatcccggcgcccaccttcacctttcccattcttctcgccaacttcttcgccaagggcctcggtctccaggacctcgtcgtcctctcaggtacgtacacaatttcttgcattgcttgcatcgatcactgaagaagtatacgtacggagactaattattttcttagataatgggcagttcattaagactgtgttcggcagtgcaggatgggaacccattttttttacacgcaaaacggagtggtcttttaacatgattaattaagtattagctattttttttaaaaaaagatcaatttgattgcttaaagcaactttcgcaataaattttttttaaaaaaaacacactgtttagtagtttgaaaagtgtgcacgtgaaaaacgagagatttgggttgggaagatggggtgccgaactcagcctaagtacattcatgaaagcatccgttttctgaacaaaactgatgaactcgaccaaaacacaacgacgcacacggaagaagaataaaagaacagtaccggccggtactccccctattacatcttaacttgaacaaactcattagctaagtccaagatggttacgccatccaaaattagaccacaaagcacagggacaactaatcattggggttgatttcttgatttatcacttcagcagtatcaaaattgtttaactagctagggcctattttgtttatttgtatatgcctagtattagcctgtaatatgttttccaagttgtcctagtgacctagttcacgacatttctcaagaaaaattctactttgacatttcttaatgcaaaaagggaaataattttaccatctttgtaaaggtaaaaaagataacatattttcgaattgtaaaatttggtatctactaatatctcaaggtattaaagtttttagtttaaaatcttgatacatttagttactttctcaagtaaagtaaaatttgtaaaaagaaaaagaaaaccgtccatatgaaaggttgcatggatttgaattgaagcatgttgattaaagacaactgttcccgtagtgtgaaaacaaccgcttgattgcaatagcccagctgaaaatgacataattgtcggtgatggggcaaagaattaattaaacttcaccacaggccacatgcacgtccggttaatgcgcatgtgagccaaaacagtatacgaagatgcaaccaccagattggatagatttagcttcaattcggtaggtaaaaaaaaaacaatccttgggaaagtaatcccagtcaagatagcagctttaggaattaaaaaaattcaaatcaaacgtcggataaaaaaaattataccaaacatgaatgtttttttattcatattcaacattattaccacagtccatttttggattgttgtaagacggactactcaccgtactaaagtaggatggatgactgcagtacttaattagaatagacggtaccgcttagatagcagacaatcctcctaatagcatgcgacccatacttagagcgcgtgaaactcatcacatgttatcttgagcggtatgttactagaaagcgtcggtttctcatcagtgttactatcatacagctgttcaacttaaaagctactcgctctgtggttcgcatgggtcgtgccactatctattggacaagacccataaacataaatccttcgaatagaattacacaattttatacatattctctatgttaatataagtccttgtttttcgcaaagtaaatatttgaaaactaatcttaatgaaacaagtcaaatttaattttggaactgatggtacaagagcatgtaaggtggagcaacttagtacatgaatatgtaaaatgattcgttcgatctatatgaacttttttggatcgtgtggatcaagaccaaaacaacgtactatgactaattttgtttagttgaactctgatcgattaatataggcgggcacaccatcggaatcgggcactgcaaccttttcagctctaggctcttcaacttcaccggaaagaacaaccccagcgacgtcgacccgtccctcaacccatcctacgccagattcctccaggtaattaattaacctgttaattagtggagtaatggctaatctctgcagtaatttaatctcatcatgtcttgcaaaattcagaattaagatcagtagctgcaaaaaggaaaaaaaaaagcatagaaaaatatgtactacagcaattgtgtgtgtgtgtgtgcaagtgcaggggcagtgcaggcgtaaccagcaggacccaaacgacaactcgacggtggtgccgatggacccgggcagcagcgtgtcgttcgacagccactacttcgtgaacctcaaggcgcggcaggggatgttcacctccgacgccacgctgctcaccgacggccgcgccgccgcgctcgtcgacaagctgcgggaccccggcgtcttcctcgaccacttcaagaactccatcaagcgcatgggccagatcggcgtgctcaccggcgccgccggccagatcaggaagaggtgcaacgccgtcaactcctagctagccggccgctcgctagcttggcttattatcattctctaagctttttagctcttacgatgaaaacatgcgtcatatccgctgcgcgcacaaccattattagttgttgtatcctaattattgttatgcgtcgaatacagtaaaattaatgcccacgagttaagtacaagaaacataaaaagattacagatatatatattttattggtaaacagaagtactgccagtatatactggtagtacattgtaccgtaaaagttcaacccagccatcccttcaaatttcaaacctacacctctcactaatttcccctccctctagccgtcctacgccctccttgataatccctctcgagtccagacctctccctccacttaccctttcttcggccacccacagcctcaaccccacactagaacccttatcgatggggcttgttagcagttgtcgatagcgctcatacgggttttgatagggttgattagaatccgctcgattggaacggacgtttgcaaaaagcaatttcaaacaaatttcttcttgtacaacgaatgagataccgagatacttgctcccccatcatctagaagctagtattacgttacgaaaatgcttatcatcatacgtccgataaaggaggaaaaaatggacacctcaactcaatggagtagtagtatagcacaggtgcatgacaactgacaagtgcaagcagccaatggagcgtgcatgaaaatcacatcgattcaaaatttaaatgatctttctcttaaactatttatcagaattatgaactaattataccattggatttgttataattaactatttataacaagatctcacatgacaatattctgatgatttttatcacataatgttattataatgtttcaatatgtttttactcatatttcactaattcagatgtaatgttgcatgtggtctttttatatgctttatgctttagtaaatgtattttatgtttcaaaaaaagtacaacttgacgcttcaagagtgatataaaattttaacaaaataaaatatttgcaaatatgttgcaccatatatatttttatgtttccctaggtatgacctaatgttttatgtaatggtagttattgttgtagccagtaatttttatatagttattgttacacgtgatctatttatatgtttcagcaaataaaatttttatgtttcaaaaattgcaggttaacgtttcaagaatgatataaaatttaaacaaattaatatttacaaatatgttgcatcatttttttttagtttcagtagtttgggacataatatttcatgtgacggtgcttattgttgcatttagtaatttttataagttacatctctctgggttgagttatccgtacaagtgataaaacaatattatggtgcaacaaaaggttgatttttccaaaacacatataaaatgttgcatggcaatatttcgatatttcaataaatatttttctgacgtttcactagtttatttgtgaatgttgcacgtggtattattggatgtttcagtaagtattttctaatatttcactaattcatttataaatgttgcacgtgttgcttgggatgttgcagttaatattttctaatgtttcaataattataactcgttgtttcacatataatatacaaatgtttcaattagtataggtggaatctaaaccatactccctcaacaataggtggaatctaaaccatacccctcaaccataaaaccgggtaaaaacgactcatccaactatttaaaccagtgcaaaatgactccctaggtggttttgaaggtggttttcgctgacgtggtgcctacatagcacggttgacttggtcttaagctgacgtggtgcttacgtggcattacaatgaaaaaaatgtgagacccacatatcattcacataaaaatttattgtgggacccactgaccatgtgggacccatatatcctcctgtccctcctgccctcctttctccttccactccagtgttaatgaaaaacacgaggcctgggagatctgcttaactccagtgcaggtccaaaacacgctttcgggtatgctagcatgccagttgatttgatcctgcaatcaactagaaataaagacaaagaaaccgtggttaaatccataaacgatagccgatcgactaagtgccgatgacatatcgtttatctttgagccgatgtcatatatgcatcgatcggcagttataaatagataataaagaactaaatctactcgatcggctgtagacattaacaatatataatcgttatgtcgatatatacttaaatcaagtaattgggatagatcggtcgccatgccgagacagtataaatcacttagattgaaatatatactaacaacaagactatatatgttcatagcatacccgatcagatagatctagcctgtatggctaatactccgataccaccctatgttaagatattaaagcaagcagaatataccaaacaaaagcctaatatacttaaatgcaataagattttgacataaagggtagatttaacatgtcaataaagcatataaagcaaatatagttaaatcaggtaagatcggctgaaaccccgatactaccctaatcggcaaccaagaagcaggctagagattgagattctaatcatcactcataagatcaaactcaactgatgcagctataagtatgaaaagaaggacaatatctagataatcaagccattggaagtttcatagagtggtggatatcatatataatctaagccaacatcgatatttaacctaatcggctgccctctattgatagatgttagctgagtgtaggttagatagtgatattgccagagattatataagatatatgataactcgacgaattacataaacaagattagagtatcataaagatggaagcactaatcccaagaacgcaagccgtcataacaagttttacctcttgttgaagatcgaaatcgatgcagctcaacccgaaagcaagaactcgtcgaaataaaactaaagtaaaaaagggtggcgatgcgccgagattgtattgaacgtgtgtgttcctttgattacatagggctcggtgtctatttatacccgagaattatccaacatgtccatatcggacaagactcttatccttgacaaactctaagataccataagtctttgcggcagacttttgccaaacatatctctaaggaatttatataaaatatcctaactaatagatacagtcgccttctcaggactctatccatgcgtggcaatcatcttcaagcatatcaactcgacccgatgtcgtacaccaagtcgtattgtcggaattggctgtatcacctaacccagtctgactcggacttagccgatcccaatcgtagccgattcgaactccagccgattcttactctgtttccacgacgatcctcatctttgattctgcttcgatctaatcttcttccccgatactgatattaccaaatttggtcgttaacacatgccccccaagtccggaatatttggtaatgtttcagatttgccatatatcggctccgagcaagattcgcactctgccgttttctgaccgttattccagcgctttaaatactaaccgttgctcctgaaaaatcttcatcgccgaagacaactttgtcctttctctctccggcgatttctccgacgctcaaggcgatccccaagcgactccatctccggccagatctccgcccacggcaatgtcgtcctccgccagcccgtctaccgcgccgtcggccgaatacgctgaggtaagttttcatcggctagatcttctcctttcgcatcagattgatttcccctttcctcatcttgttttcttcttctctattcttgttcgcatctgtagcatctgtccaatctgtttgcgattccaagtctatcgcatgagggacattatttccttggttcgatccgcaatctagatcgcactgacttcatcattggcgaaaccaatagaatccccttcaaattagccaaccctaatctaggtcactgaaagaacaccttcaagtcttggccgtctctcgagaaaaccacccctgagaagagttggacctcatggtacaagcgtgtatcgaccagcaagcaaacacattgggatgaaattggaatcggccaagcacttgccctcaccatatcaaattcagccaaagatgaacccttaatggccatcgccacctacttctggtccaatactatcaacgcctttctgttcaaccaagggccgatgacaccaactctgatagatattactatgatcactggtctagatgtatcctcatctgctaatcccatgaacctgaacaccaagaaccaatacgatttcaggaccaaaagcataggtggttggtctggttatgtggcagcatatatgggccatagatttgttactcctcgagagcatgtggcatttttactcatgtggctagaaaagtttcttttctgtggatccagttgtggccctacaaccaactggcagtttgcagccaaagctcttgagtcaaaaagagaatttcctctaggcaaaatcctcctcggctacttatacaaaatgttgaacaatgcatcggccaaaatagccgtcggctcggtggttgaagcaggtggaccatggtggctactacaatcttggctcaacttaatggtcatgaaagttgtcaattggccatcagtgacagaagccgaattcccaaggctggagccgatcacagaagatgatggagaagaacgcacccatcgcagatgcatgttatatggagagtatgcatccacaccagccaatgctggagcaaaactatcggctgaactgctcaaggattggttctgcagcttttatgaggactcagcagaccttgagctcccgtcagactttagattttaagatatcaatcataaaagataccaaaagtctagggaagttttctcagttgcaatcagcccatgcatcctttctatcggcattcatcagggaagaaacattcaagtctcttatgaattctatcacccaatgagctcagccagacaacttggaatgggccaactcccaatcggcttatttttcgccgataagatccagtgccgaggggaaatttcatcaaccttgatgatggatcgactgctcaatctccaaggacctcctctgggcagcattgagaatatcgagctggcgggattcaagagcaaaaactttgacatatggtggggtgaatggaagctgcatctattccaccaaccggcctcgatgtacatgacagatctcttccctgatgttgtacctcaggtaaaccttgtcatcattaatctaaacaattgtcagctgattcataacttgactaatcttttgtttctgttttgcaaacaaccgaatcttcccctccacatgaaagcaacagtgacagagacattgaatatgccccaggtctgattcccaatggaggtgggccatctcctcctatcatcggctatcatgcccccaagacttcaactcttctccaaggcctaatcagagaaccagccgatgcaggcaagaagagaagaactaggtcatcggctgtggacacattggctccagccccaaagaagaaggccaaactcaagaagcctaaaccaaccgatgacctgcctgccctagatccatccattgaacaagctctgggtgaagaagaaatcggcgaggatgttgatcaagccacagataagtaagcgatactgaaagaaccccatcggcttcacctaagcaaactcctccaactccttctgccccattccatttttcaaaggtaagcagctttctttttgcaatcccttcacttatagtcgattactcacagattttatggttgcagaagaagaaaattgctataaagaagaagtcggcagcaccaattcccaaaccggctccaccaataagatattcttaattcttttaatagtcgatctcaaccgattttccgtaatacttatctttttgcagcctcctcctcctccttctcctgttcagcaaccatcaagtgatcaaactccatcggctgcaaggggtcatcatgttgaagaagaagtacaaccagctgctcttgccattccagtaagtcttgtttataaaactcttgaatcagccaaataactcatgttgagactcaattttttaaattccttcttgcaggccttagccgatctgttctctttcgatattaaagactatcttgatgaagaaacagaagaagacactactagcaagtctttagctcccttgtctgataatgtgaagaaaacccttgaagacatctctcttcggctagaggcatcatcattagacagcttggtggtaaactgtgggccaattaggactcggtcacacgaggttcaagctctaatcccaaatgagctagtcgatgtccttacaccagctgtctaccttgagcagcatcaattcaagctggagaaagccaaactaagattagccaaacgtcgggagcgcaaggacattgtcacaccctaaaaatcctaaatatgtaaattgttgtttaaatggaattattagaatttatttttttaaaagcctagaagggaagatctaattttaattaataaattccaatataaaatggggccagataaaatttcattaaatactttgcttaattctataattcctagatttttctgggatttatttgagctaaggaagtaattttaataaatgaaattgcatttcatggataatttaaattgaaaaaggtttttaaaaagtctcttttggctttgggccgaaagtcggcccaaaaacctctctctctctccctcggcccaagccggcccagtccgcagccgcagccgcccgcgcgcgcgctcgttgtcgctgacaggtgggtcccacctgtcagtcttcgtcttcctcgcgccgccgccgccgcccgaaccctagcgccgcgccgccgtcgtctccttccaaatccggccgctcctttccttctccggtgaaatcaaaagaggggaaatgtttcccgagatctcctctaccttttcccttttggaaacatcatctatttcggtttggaaatcggtggattcgagatcgaatcggattcctctctctctcccgaacccgaagtttccttcgcgtcgccggtcgccgtgggccttcgccgccgcctccttgcccctttaaaaggatccccaagcccgccgctacccgtcgccaccctcgccttcgtctctcgccgtcggaagagctctagcgccgtgtgacctagcgccgccgtcgttcgccggcgagcatgcgcgcccgagtcgcccgagccgccgccggtggtgacgtcatcgccgacgtcatcgtcgtcgtttctccgtgagccgccgtagacccgatcgatctcggccgtccgttttggatggatcaatctcggccgttcgttcccgtgaaccgccgccgtgcgcccggtccaccgcaaaccctagttgctgacgcagtaaaccccttttccttttcaaaaataactcattattgcgtcataattcaactaaaatccatataagtgttttaatccgatttaatctttaaaaattcataactaattcatcttagctcggatttagttggttcaagtctctaaatttttctaaaattgagatctacatgttaaaaatatccacatgtactgttcatgcttgtttatgtgctgtttttggtgtttttgctcttttctgtttagattccgacgtttccggagagtccgtttccggaggagaagaatttgaagagttccaaggccagcaaggcaagtcacacagatcccaaacaaccctttgagcatgttgatcccgtttaaagctattgtttctattcaactattgcatttattttcgaatgtcattgggtggaattaacctattgtttgttatagccctttttgttcttgattactttattccttgataccttgggttgttataacttgactagttgggcaatatatatattggttcaactagatgtgttagatataattgcttagccatgcttagaaatattagctcactaatgggatgaatcatatatactacattatttaatgatggcttaatgatagttcacgatggtcaatcgtgattggttaattaatcacttgccaactaaaacctgatgatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgtggggcaccagactgagaaatggcggagataagcccacgggggtcgctggggagtccatgccttgtttacaagggggtgattatgatctaggaatggtgcgctgcggtggattgtgttatgcaaggggtattgtcacagctcctttccgaggtaccgtggtggtattgaggcacatggtgacatgatgtggggttgtgtcttgtgggtacagtggtacacctcttatcagagtagaactattcgaatagccgtgcccgcggttatgggtgggtctaacaatgtctttcgtgattagtttcacacttctcaccataataaaagatgctataactggtaataatttgattagctcctggtttggagatagaattgtgcagccgggatggttgttcagaatggttgggcctatgcaacagggtatattgtatagcgttggattaatattgtttaattattacttaactgttttattaaattctgaaatgtttactaaatgctgtttatgcaaatgaaaccctattatgccatcctttgttatcctgtgcacttgcatatttgctgcgtgacttgctgagtatgtcatatactcaccttgcaatcattcatcagaggaagagttctacaatgatgctgatggtgtggaggattaggtgtagccctggtcaagctgcctgtggagtggagccgtctacgccgtttatctttttttttccgctgcttagatctttattgattgagaggaactatctacctctgtaatgacattttattcgcttattaattagagtaataatggtactctattatcaatttgttattgtgtgcctcggctgattcctggacgagggtttacacacatgtaagcgtttggaattttggatagaaattccgggcgtgacagacattgaagccacaatccaagccaatcggcagcttgtgcacgaagagaagtccaagcttgatctgctatccgagggcccgatcaaatccaacgttaatcggctcgaagctcgcaagattgagctcttggcccaacttcaagaatgcaatgccgaactggatctggaacacaaaaagctagccgatctcccgcgagtcgttgaagaacaaaaggcgaagctgaaatcggccatcaaaaatgtcgctgatatgaccaagtccttgaaaatcatccctggaaccgacgctcaagatgcccaagctattgaagaagtagaacaaattaggcaaagagctatatcggctatccagcaatatttgtctcggtgactttctgtgtaatagatcttataaatttttgtaatcggctaagatactctggtactttattgtcttgacaaacctttgtgccgattaatataacttctaaatttgctcaaaaattttcatttttcgtatatatgtgcccccctaattttacaacgtcaaaagcattgacaaaattataaaaacaactaaaggcgatataaccatatcggccatcggtacatcggcaaaccacaaccgattacaatatgaaaaacaactaagggcgatataacaatatcggccattgtacatcggcaaaccacaaccgatttacaatatgaaaaacaactaagggcgatataacaatatcagccatctcaaagcgatgtagacacatcggctgtcatgtatcggcaacatcagccgatcatgcattaacccaaacacttgggtaatatttcttcaaatacttgccatttagtgctcgtccataaacttctccatcgagtccatgcaacatgtaagctcccttagacacaactttgtggatttggaatggtccttcccaattcggcgaccacttgccgaatttgctatctcgagtcccaatcggcaaaatcacttccatacaagctcaccttcagaaaaagtcttgggtaccactttcttgttataatgtcaagcaactcgttccttatccttggtaacccttgcaagggctcttaatctagactgaaccaagtcttccctttcatcggccatgagattataatactcatcaactgttaaatcattttgcaattccgttctccttgagccgattctaacttcccatggtaaaacagcctcatgtccataaacaagcttataaggagggacttggatcgatccatgacaagccatccgataataccacaatgcttcggccaaccgagtatgccactgccgagggtaatcataaatctttctcttaatcaatttgatcaaactcttgttagatgcctcggcctacccattagcttgtgcataatatggtgaagaattcaacaatttgatacccatgctatcggcaaactgaacaaactcatcggacacgaaaattgaaccttgatcggtcgtaatggtttgaggaataccaaatcgatagattatatgctcttgaacaaactgtatagcatcccagaatcaactttctttaaaggaatcgcctcaacccacttggtaaaataattggttgccaccaatataaacttatgccctttactcgatggtggattaatcataccaatcatatcaattccccaacccctgaatggccatggcttaatgataggattaatagccgacgctggtgctctctagatcgccccaaatttctgacaatcttgacatcccttgtaatatttgaaacaatcctctaacattgtcggccaaaaataccctgcgcgtcgaagcaaccacttcatcttatgagccgactgatgagtgccacaaatcccttcattaacttcgccaattgcaaccttagcctgattggcgctcaaacacttaagcaacaccccataaatttttcaataatagagttcatcatccaataaagtatacttcaacaccttatatctcaatttccgagaggccgattgagatggattctgtaaatatcgatgtacatcatatctccaatcatcggctgttattgcagcaacttcaaccttaacatctttgatcatcggcttataccctgacgccccttgggctaaatcattagcttcaatattttgctctcgagatacatgcttcaaagtaaccagccgaaattccttcattagttcttggcacttctcattataaactatcaatgtatcattcttgcactcatattctcctgccaattgactgattactagcaaagaatccccccataatttcaatagcatcggcttcaacttccttgagtaactgcaaccctttaagaactgcctcatactcagcttgattgttggttgcataaggtttgatagtataggcaaactgaaaacttgccccccgaggggaaattataaccaagccgatgccacaaccatgagtgcatactgacctatcaaagaataaagtccatggcatgatctcaaccgagccgattgaatcatcacgatgttctacaataaaattggctatagcttgccctttgaccaccttcggttactcataccgaagatcaaactcagttaaggaaaatatccacttcccaacccttcctttcaaaattggagctgataacatgtatttaacgacatcggctttgcatataacagtgcattcgttggacaatagataatgccttaaccttgtacatgaaaaatacaggcacaagcacaacttctccacaggagaatatctagtctctgcatccaagagtcgatgactcaagtagaatacaacactttctttcccttcaagttcctgaatcaagactgaaccgattgacttctcaccggccaacagatataatctaaaaggtattcctttctgtggaggaatcaaaactggaggagagctaagatattccttaatactatccaaagccttctgttgctctacccccaagtaaactgttgatcggctttcaatcttaacaacggtgtaaaaggttctaaccttctagacaaattagaaataaaccttctaacaaaaattatcttgccgattatctcttgcaactctgtcttgttctctggaggatgaatcttcttgattgcattaacacttctatgagtaatctcaattctcctctcatgaacaagaaattccaaaaattggccagccaatacaccgaaagcacactttgttgggttcattttcaagccatatttcctggttctctcaaaaaccttcctcagatcggctatgtggtcctttatctctttagacttaacaaccacatcatcaatgtagacctcaaccaaccaaccgatcggatcatgatatatataattcatggctctttgatatgtagccccagcacttttcaagccaaaagtcattacaacctactcgaataagccgattgcaccaggacacctaaaagctgtcttatgaatatcttcttcggccataaagatctaattgtaccctgcattactatccataaaacttaaaatcttgtgtcctgaagcagcatcaactagctgattggccactggcattggatattcatcttttagggtagctttattcaagtttcggaaatcaatgcacaccctgaccttgccgttcttcttgataacagtaactatactagaaacccactcggcatatcggcaaggacgaataaaaccagcatcatataaacgtttaatctcagccttgacaggttcaagcatatcggctttgcatcttctcggaggttgttgatgcggtctaacccctggtttgataggtagccgatgttcaacaatcgatcggctgagtcctggcatctcataatactcccaagcaaagcaatctctgaattccttcaatagctctatcaacttggttctaaactccggagataaatttttactaataaatgtcggccttggtcgatcacccagacctatgtcaatttcttccaattcatcagccgacatgaaaccatatccttgcttgtcatcgagatcatctattgtatccttggtgtagacgtttgaaccctccacgacgccctcaaaataatagctttggttctccatcttcaattggccgtatatcagaatcggacacttttagaaaatctccatcccaaacttttccagataaacaatcaagaccatccatctcccaaagagctaaatcggcactggcaacattgactgacctgttggctggcacaatttcaatcttgtcgccttgccactgaatcaagcattaatgcatggttgagggaatacaacaattggcatgaatccaatcccttccaagcaacaagctatagaaacccttcccatcgatgacaaagaacgttgtaggtatagatttgctgccgacggtcagttccatattcaaaactcccttggtttctgatggattgccaccaaaatctttaagcaccatgtttgtcttgatgagaccttcaacatttctgctcaacttcttgaatgtagcgtaaggcatcaaattcactgcagccccaccatcgaccatcatcttggacaccggcttcccattgacatagccatttatatacaatggcttaagatgccgattctctatcccctctggcttctcgaagacttcttgttctggtgataaaatcaacttagccgattcctcttcaacttcatcgacatcggcttgcttgaccccaaactcagcaggcagcgtgaaaaccatattaaccgatgcagtcacaacactttttcctttggccaatctctttgcttcatcggctgcggcctcgtcggctacaggagcttgtttcttaacgcgccactcctgctttggcttcgttttctttagctgatgactgatttcctattagacctcctgaaaacgctcactgttcctcaatctttgaacccttctcttatgattctttgtaaatataccagaaggacatcattgagtcttcctgttttcattgtcctcctggttacaatcttggttcactggacccaatctttgatgaacgggaactctagtctgcattagccgattgcctctattatatgatcggcttgagctttctacaatattaccgcacctaggacagtcctcgatagatggcagcctcacatcctcattccagcaaaatctaaagaactcgcagccccaatgaggatcaaaaacgtcatcaccttcctcataatgcctctcctgctgtttgtcatacttcttctgatatttgttgataatttttgccgaattcacctgaaaacctcttgcacgtcctccatcagctgttcggccagctgtttgcaccatattaacaggaaaaggattgccatcaaccttcatcagcctcttggagtcttcaaattttattttgcctccctcaatagccgcttggatctgctgcctgaaaaccttgcaatcattggtagaatgagacccagaattatgccacttgcaataccttttcttgcccaattcttcagccgatggaatcgtatgaccagcaggaagttgaatctgcttctctcggagtagcaaatcaaagattttatcagccttggtaatatcaaagtcatacctctcctcctttccagaactctttacccattgacacggtataactttcttgcttctaacccattcggctgctgctattccggagtcatcatcatcatcatcatccgatccatacatgtaaggacagacatgattaacttttttaaagttcttccttgcttttgcaaacctctgttcatgcaaggtcaccttctgtgcaagatgtgacaagctatcaaagtcttgagatgagaacttctccctgattggagcaatcataccctgaaaagccaaatcggctaactgggcatcagttaaactcaagctatagcacttatttctcatctctctgaatctctaaatatattcatgcacaggctcatcatgtctctggttgatcactgttatatcggacagttttatctcatataccccactgtagaaatagctgtgaaaatgcttctccaaatcggcccaactgttaattgatccatatggcaaagaagaaaaccaagtgaaagccgatccagacaaagacaaccggaacaacctaacccttaaggcatccacagccgatgcttcaccacactgggccaaaaaccggataatgtgttcataatttgacgtactatcttgcccttagaattttgaaaagtctggaactttgaaccggttaggtagagggactccctcaaaccattcagggtaaggttgccggtacaaatttccagcgtctttcggcctgagcccaaactgctccttcatcacatccgcaatcatatcggcccatggtcgttgctgaggtgctccttgaggttgttgtggcatgagctcgaattgattgtactgaggaacaaattgaggttgagccgatcctccctgctgatattagacttgcggtgaaggaggttgatactgataattcaaattgccccctggtaatcttgaaaatttggttgaatattgcgcaccaaatgctcaggaacaacttgaggtaccaccgtttgattcggttgcacattatggaccaaatgctccggaacaacttgattcgcggcatgctgccttggctgattattaggtgttgcaaacccagccgatgcattcatcgaggcttgttgttgaatcagctgaataacttgttgccttaacagtgtttgctgaattggttgcaaaatctgccgcctaggtggcgtctgctgaattggctgcacaacctgttggattggtggcgtttcttgaatcggctgcacaatctgctgccttggtggtgtttgctgaatcggctgctactgggttgggtcaacagtaggttgaggaggtaagaacatagctacaacctgaccttgcgttagctgattcacattctgtccactatgctgcggttgctctctaaccaacaaccggggattcactaattgacccggcaccgatgatgctgcagcaggtgcaagagctgatactggtgccgtcggctgagccgatggtgcattgggaggaattggttgaacagctggctgattatcagtgactaatggccgataattcgggaacacccctcctggtagataaaccggtcctgtagcctgatattcagccattgaaccatcaacccttgtcttcaccatgtttgacaaagtgttgactaatattccagattgattgatcaaagcatggtgcacggcatagtcaacctgatcctggatgttgttaaactgtaactgtgccgcattgccgtcttgattaaggcctccaccttgaattccttgagagccaacaccctgaactccttgagagccatcaccttgatttccttgaaagccatctgcagcacctttatactcggttgagctgcatcatgtcacgtcccaaaacgaccctaaaatatatcctttaaattatgcctagaataattaaaatccgtgtgaaagcctccaacaattaaaatgtgcaaagtaaaagtcaaataaggcttagaggatttttttatatttcctaaaagcctaaaatgtgtaaataaattttagtggaattttcagagcacaaataataattattaaggaataaacaaagttgaaaaggttttataaaaagaaaaaccctaaaaaccatccttccctctcttgggccggcccggcccacttccctccccctctctcctcttcccccgcggcccactcggcccctccccgcgcccgcgccgttgacgggcgggcccgcccgccaccctcgctgacgggtggggcccacccgtcatgtccttcctcccaccgctcccgccgcctcgcccgcgcctagcgccgccgccgccgcgaatcccgccgcctcccgtcgtccccgcgtgaaatcaataggggggaattactccccgtgatcccctctccctttccccccatttttccctctctctctcgcattcaaacggccggatttgctcccgcaaatctcgccggcgccattgatggcggccggacctcccggccggtttccttccttccccggccaccctctcccccttccaaccctatttaaaccctccccgcgcctccctcgcccgtttccgccccttgccgcactgtctcctcgccagaatcgagctcgcgccgtcgccctctctctcctccgtcgccgacgaccttcggccggctctctccactcgccgggaccgtttcccgccgcggcgtcgcctcctccggcttcgccgcaccgtcgccgtccccgtccaccccctcatcgagctcgccgaccgccggagcgccaccgtccccgtcgaccggagccgcgccgccgccttcctccgctccggccgcctttttcgtcatcgccgtcgacctagggtgagtcgtggaccgccacctcgtttccccctttccctcccctctctcggccgccgctccgccgtgcctatggccgccgccggcgaccataggggcgcgggcgcgccgcctcccgccggctgcgccgacgtggccgccttcgggcacgccgagcggctgccgcgtggggcccagccgtcagccgcctgcgccctcgggtgcggctgacgcgtagggcccacggcgccggccggtgtgagcccgggtgcacccggtccaccgtggaccgtgaggctgccgcgtgggccccactcccgtggacccggtccgcgcgccctctcccctcggctgacgcaataaaccatttttaaattaaaatttaaatgaagaaattcgtaaatattcatttaaagagcatataaacttcaaatggccataacttggccattcgaactcggaattggaccgttcaagtctctaattttctcttaagaagtcaaaaacccatttttgtgctttgttcctgcttgttatatggagtttattagagtaaaagcctttttcctttccgttggtcgtgtagacgctgcagcttcggaagatccgctctacgtggaggttgaagccgacgtttgggaaagcgagcaaggtaagtcacatcattcttgaacatattgaatcccagtttataaaattattttgatttaaattattacattatcgctttatttaaattcccgcgttatcactgttttatttagccatgcctttttacctttgttatgaccttattattattgttattgttattattaccttgttcaccctagaataaacaaaaccccaactagtggatactgtattcatggtaccactagtatgaatttaggtagatgcttcgctgcttaattaggcaacattaggtggttttacaactctagactttaggaatattcttatcacctggacactatggaatggttggattattgtggaattggattcacacctctccctctattcaaaatcctcaaaatggttttagcctgggctcggggtgcatggttttgatagtagcacctcggccacataaggaccggtcttcgggcctctgttgcaaagcactaccgtacttccacatgtctagtgggtaaggcttagtttgtggctcagtctggttataaacaaaagtacacggatggagatggacgaagtcgagggtcgatggacatctctagggcaaatgaaggctacacgagctgcggcccggtagtcgagatgtcatggcacagggctggtgtcctgctgctaggggctcagtcctgcctacctgtcccggaggttccggccgtaggtggggttcggtcggtactcttgtctatggctaggatgggttggaaactatgtcacgtcttccgtccgtataccatggtggtatgtggcacgtggttacacgtgacgaagatgtgtcttgtgggtaaagatgtacacctctgatcagagtataacctattcgaatagccgcgccctcggttatgggcaagcctagcaatgtacccaagttagtgttttaattcttaaaacctgcttaacaactaaaatgtggaatggttggcctgggttggttgggacgagctgggacccagggtcgggttgccagttcagtctgaatcatcgtaggccttgggttaaggcaggttcgtatgggttcacggccttgattaataatattgcatagctctaggatcgtgtttacaaagtagctttgagcaactaagtgacttttaatgatgtttactgcaaaccctaaccccctatattatggctcccttgtactcccttgcatttattttgcacttatgggtgtgtcttgttgagtacgggggttgtactcagtcttgctcaatttttcccaaacccagaagatgagttcctggaagatgaaggctttggtgtctagctcgtgcctgccgtcaagcgcctgtggtcgtcgccctagtcttccgctgttttttgtttgtcttcttgtgtgctgggccttcgctacccatgtaataaattatctatttacgcttccgcttgttaaactctgaattgtatcaacttttggtgtaccttgcctcctgggacaaggaataatacacgcacgtaaggaacgcccgttgggttatttccggtcgtgacacatcatctgaagcttgtttcacttcttcatccttagaagaaccggtcctaggaacatcagcaattacctttactttgtacttctgaaccagtgttcccttgcgggactccgtgaatgagctcaagaactgattccgtgcttgctgcatcattgtatcaaggtctttttgctgctcaggtgtcaatttatccagagtgataggcacaatgttgtcttcatcaatctcagatagacccagcttcaggatcttttctttaacagagctaggaccagcctggacggcgatgctggcaatttctcggccatggggaaaactgctgttgtgattctgacttctgatgggtcccaccaggcgtgccaaaagcgtgttgatgaaaaacacgaggcctggaagatctgcttcacttcagtgcaggtccaaaacacgctttcgggtatgctagcgtgccagttgatttgatcctgcaatcaacaagaaataaagacaaagaaaccgtggttaaatccataaacgatagccgatcggctaagtgccgatgacatatcgtttatctttgagccgatgtcatatatgcatcgatcggcagttataaatagataataaagaactaaatctactcgatcggctgtagacattaacaatatataatcgttatgtcgatatatacttaaatcaagtaattgggatagatcggtcgccatgccgagacaggataaatcacttagattggaatatatactaacaacaagactatatttgttcatagcatacccgatcagatagatctagactgtatggcttatactccgat

SEQ ID NO: 6959 - DNA, 9296 bp, Oryza sativa
gccctctatgatagatgttagccgagtgtaggtagatagtgatattgccagagattatataagatatatgataactcgacgaattacataaacaagattagagtatcataaatatggaagcactaatcccgagaacgcaagccgtcataacaagttttacctcttgttgaagatcgaaaccgatgcagctcaacccgaatgcaagaactcgtcgaaataaaactaaagtaaaaaagggtggcgatgcgccgagattgtattgaacgtgtgtgttcctttgattacatagggctcggggtctatttatacccgagaattatccaacatgtccatatcggacatgactcttatccctaacaaactctaagatatcataagtctttacggcagacttttgcccaaacatatctctaaaaaatttacataaaatatcctaactaatagatacagtcgccttctcaggactctatccatgcgtggcaatcatcttgaaacatatcaactcgacctgatgtcgtacaccaagttgtattgtcggaatcggctgtatcacctaacctagtctgactcgaacttagccgatcccgatcgtagccgattcgaactccagtcgattcttactctgtttccgcgaccatactcatctcttattccgcttcgatctaatcttcttctccgatactgatattaccaaatttggtcgttaacatccagccaccccaccggatccaccaacgcgtcgagctcgttctgcacaaagatggtccccgaatactccttccacggccgcgccatgtacgtcttcgccttctccagatccgggtgcggcgccacaatgcggttgtgcagccccgtccctcccgcgacctgcgccgttaattatgatgttcacttggttccccatcggcttttgcagctggatcaagcagttctggagcaccacctgcatgcatttcatttgcttttctcaatatttgcttattcttcttcgtcgtggtggtggtgttaattgttggatcaaaagaaagagaagaagaagagtttaattatatacttgcctgcgagttgcagtatatgaagtcgatggtgccagacacggagcagtcgcgttagaactgccgctgcgcatgcgggtagagcgtgtcctggtacgtcttcaccttgtccgtgaacttctccaggtccgggtgcagcaccaccatcacgtttggctcgaattcctccggctcggcctcaggccgcggcgcctccagcagcggctgcttcccgccctccgacatccacgtcggcatgccgtcctcggcgagcagccactgcccgatgctgaggctgccgagcgtcgatgagaactggtcgaccacggcgacgatgtcctccatgagctcctgcgagctgttgagcgcgttgggcatcttggcagcggcatcggtggtggtgttgaggaagtcgtcgaggcaggtgccctggtaggtgagtgcggcgctgagccacgtgcggaggtcgtcgacggccttgttgaaattggtcatatcgaagccaccgagcttgtcgaaggacgtgttgaggtcgtctatggcgtacccgagcagctccttgcaattctgcagcgctcccactattaaaaccgctggtgcccttcccggctcctactctacctcgccgtcgtcgccgccgccctctctactgctgctagaaggggaaaggggaggaagaggaagaggaagaggaaggagaaggcaaggagagggagagagaagagggaggaggaagaagaaaaggggagagaggatgacatgtgggcccacatgtcagtgggtcccacaatattttttttacatatgggtccctcttttttttttttaatgccacataagcgacacatcaatgtcaagtgagacgaagactaggtcaactatgccacataggcgccacgtcagcgaaaataaccttcaaaaccagctagggagtcattttgcactggttttagtagttgggggagtcgttttatccggttttgtgattaagggatatgatttagactcaatctatagttgaggaagtcgaattatactttttcctccccactggcccacatcattttagcccagatacaagctagggttgggcctcccagcgaaggccataagatgctgagtaatccagcaacaccaccacacaattaccgtattccttggattataacttcataagcaaactaaagttttgcatggcgattattaaaaaaaaaagctttgcatgacgagaaaggtacacatggcactttcacatattaacaggattttaccctagccatgcaatattatcaatgttgtccctcttccaaactcagcgtgaatgcgtgatgcaaccttccaactgcaagaaattctctgaaagagtcagcttcagtaagtgaaggagacacagcttcagcatcatataaaaaacgatgttgcgcttgtgtaaagttaagcgcctatgaattgatcaagacttttttacacaccagagacaaccataagttacacatgatatatggcagtaaatttaaagggaccaggtgctttgcttccagagatcaacattatgcctaactggctaaatgattcgatcagcagctggtagacttcaggcaccagccaatgactcgatcagcagttggtagccttcaggcaccacgctctggttctttacgcaagcggtgagggcaggaacatctgcttttatgtctaggaaagcagcaaccaggaggagaaggtggaagtccgagatccgcttaacaaatggtagatgcttagcacgatccaggtggctcttgagcgcgctcattgctacagggtttccacggttctcgataggaaagccggttgaaagtggaccctacatacacaaaataaatataggatgttaactgatatatctttatggatagaaggtatatgcatataatcgactaaaatggtataagagcaaatgacacaagctcagttggtggggggtgtgggtatctcttctctattgattcgattccaagctcctctgcatctttcatttttagttttaaaaaacaaaaattaaatgatagcagagtgttgaatcattgccctgttccctgggtggaattatgcaagacatgcgagatgtacagcccttttagaaaacaaatcatttgcttttcttggagagacaatgttaaaaagaagagtcaccatcattttgaaacctcaactatcctgaaatcaggtgtatttcgaaacaaaaggatggtggccatgtttatagtctaaatagaaaaggttcttgattaaacaaattgacaacccacaatgtaatcaccaaagcagtaaatgaagagattgtgcatatgaagattgatctacgccccagaacacaaatctaccagaagtaaaatgcaacgctaccacattcacagttatctgattacgctagtttctattatggacatcaaaagatggaaaaatagtagatttctagctgatcccttccactctaatcactggcccagtacatcatgatgaacaaatataggtggcttgtttaggaaaaatacagatgcagcactgtaatttaacttccataatcaagtgcatgcgaaattgcccaactaattaatgatgaaacacaacagtttcactgaagtatgtagccaggtgcatattggcttgatgcatggactgtacagtccaaattaaacgtattttcgtttgtcagcaaacaagacagaagcttacccccaattttaagtgtttaaagtttaatgtatatgatcatcaaatgcctgatgataagtaaaggtaagttaatatagatgatcttacatgaagctcaagttattccaatagtctaattataaatttctgtaagtgaatacagaagatagattcggatacaggttgtattgtgacattcagtttgccacgttttctttccacatagggaatcaaatactggatataaaggtaatgaattattagaactttttaaagataaaaggtaaatgttcagatggagattcttatattcttttcaaagtagatccatggaatatctgagaaaaagaactgttagtgtattctaggtcagaatatcaggttcccctttattctcaggtaagcttcagacttgttctacacacaactatctgtgtcagtgctaaagcagtacatgccgcatcttgttctatacaaaaagatcagaatagttatctttgatgcactctagcaccatccaaggcctcagaacactgccatagaattcttccctagaagcacaccaatataaaagaaaccttctattcttaggacctataatttttaaaaaaagaaaaaaaaaacttttcacacctagcacatcagatgcatgacatacatgacatcaccctggcctattccatatacacaagaaatggtttacactaaatatactagaagggcacatacacttggtacctcactaactctctctctttttttttggccaggcgaacaatggtatgccggccaaattttattaagaacaaaagagaaaccagtacaaggaaagcaacaataggatcattgaaggcacccaagcttgaatgcttagaatgcttaaaattagcaacaggacccccaagcctaaacatgaactagaacagctagaacaaaagcaaaaggaagaaacaaagttaggcagggcctcagcaaccctgttgttgtttccttgtactattatgccttctattcttaactaaaaagaggctgcatcatataagaactaaaaatcacccattgattctgctcttgaaataaattaaatggaatcacatcaaattcatgatatcagttgcatagatatcaagaatcgtcattcacagattcattctcatctagatcagctctatgaactaggatgcatcactgaaataagatgctcttttctagagtaaatttcacaaacactatagatattttggcatatctatcaaaaaaccacagatctcattgctaagtttgcaacagctacaacattttggcaacacttcctgacaaacacaaggctttgtcctgttccatgccaaataacaaaaatgtgtgctgcatgtcatagaacagggcctttgtgtgtctgcaagtggtttgaacaagtagttaaaaacttgtagttctatggaacataagagtaactatatctttacgttcttgaaacagttacttaaatcagtaggtcttcaataaatgtgccaaaatgcctgaatttttctacacatactccttttcttatatagtggttaattacttctcaaaagtggatctattattactagaattatgaatatttgtggatggctgtttactaacagtctaacactgaacagaactcatatatcatgcccttacacccagagattcagtttttcaagacagtgcaggaggccctctacgaagtttgaatcaaaaaattaacagaaacataatgactttgcagaaaataaatatgtcatgaattaattgcttgcatgcaaataggcactctactatttagtggataacacaaaggctctaattcttctcttgtattgggaaatttttatttctaattcatgcggcatatctaccttgttcgctgaccattatgttgtttcattgtcagttttacatcaaattactaaaacgagcacccactcagatcacctgatgattcaaggtttcaaacatgctgctacccagtcaagtgttaatattgctatgttgtaggaagcaaacttatttagtaaactgtaagttcattatactatgcaacagagtaggaaagaataagaatacctgatgatcagagatcttgacaggcaccaggaagaagtcattgtccacctccatagtatcctttcccccagccaccacctctttccgcatcttggacaggcggggatcgtctttgtccccaatctccgtctccagcacaccatccttgaacagcttcacacaaatctcactcatctggaacgcctcgaagtgcacatcaccggagccatcatcccccacctcgagcttgactatggcggtgacccactccgggatcccgccctccgcctgcagctcggtggcctgaagcacctcgcggttggacatggtgtactcgccagtgtcgctggtcttcctcccgactgcctgcgtgaacaccaggccgacgcggcgcatcccgaggccgtgggcgatggcgtcgacgcgggcctcctcctgcgcgtcccgcatgagctggacaacgtcctcggtgccgacctgcggcggctcgtagatgaaatcgacgaagacctccttggtgtcggcgtcgacgcggccgtagaggaagccggcgcgcttggtagcgaaggcgagcgactcggcgacgtggagctggaaggcgttggcggagtcgcggtcgaaggaggcggcggcgcagagcggggcctcctggcgggtgacgcggatctggcgcgcgatgaggtcgtccatggtcatcttcttgccgaaggagccggcggcggagagggctttggggggaggcggctgggaggagcgggcgtcgggcgggtaggagaggtagacgaaggagccattggagaggcggagggaggagagcggggcggccgggtcggcgagcagggcggcggaggcggaggaggggaggaggagcgccgggtcgagggagaggcgctggagcgggacggggacggtgacgcgcgccgcgatgagacgctgcaggtcgccgacggtggcggcggccgggtccggcacggtgatgcggtccgtgccgtcgcggctgcggatgcggaggatcatcgcggcttgggttgggttggggatctcggtacttggcttgcgcggtggggtttttggttgcggatttatagagcgggggaaggcgagttgggggagatggagtgcgactcgactgcggaatctgtgcgggaggaggaaacgggacggcggcggagaggagaggagaggagaggggaggcgacgagagatggattctcgaagggttggaggctttggggcggtggttgcgtcttcgttggctacggtagtttgggtacacctggcccggtgcggcggaaagacgagctggtttctattctctggttttgctctgtaaaaattggattctatcctatgaccatctgtgattctaatggtgtttgaactttatttataaagataaagataaggattaagtgtctcacgtaagacgaggtggtaataacatgtgattaattaagttttaattattataaacttaaaaaatggactaatctgatattttagaacaactttcatatagaaagttttcacacgaaacatatcgtttagcagtttgaaaaacgtgccatgataattttattgtttgagctgctactccatcaatccttttcaaagtatgagagattttggttggacttctatgaagattcataatactataatgtatcatgtcgaatcaaaatatcttatatcttaagatgaaatgagtaatacttctacttagatatgtcctttattgctaaagagagtaaaaattgagctatccgaatgctatcgacctaactataacctacagaaaactttgaaaaaaaataataataatttagaattagcaatgacataaatataggcatgcatatgctggcctgctagattccaaccgaccgccaaaaggtgattaggtgagtatggaatttcacctccatccatgcatatcctctttgtatgctcttccgaccgagcacaaggccgttgacaccttattgacacacatgaacaatacttttccattattctttccttcttttcttttcaatttagtaacaagcattcacttgtgatctcactggacatgtatgctatgggctaacacaaacatggagaattttctagcatagagaaataaaagaagcattaaaatattaagcattaaacggtttaaaagctaatatctgaaaacaaactacaatgaaaaactaaaattaactctaaatttattaattttcaaaatgagtaaagtgcacggtcagtctctaaacttgttcatacgtgttatacagattccgaaattctcaaaatgtattttgttctcaaacttgttaaggtatgtcattctagtccaaattacaataactcttcggatcctatgttgcacacaaatgttagatttattttctttatattttgtactccctttttcttctcttcttccttcatgttcgtgtgaaaaaaaaaagacaaaataagataaggacaacacagaggggaaggaaaaaaagaaaaattgggactggaatatcagtgtggcatatcgctttagtgactatgtggcatgccatgtaggatactcgaagggtcatggcaatttaagactgaaatgactcactttaataagtttggagacccaaaaatgcattttgagagttagagaacccagatgacacaactgaacaagtttaagaaccaacaataaacttcactcttttttttagaacacgcttcacttttccaaaaattatttatttttagcactcgcgtttatgagctaacaataagttcattcgagcttttaaatagttagcaggtttaaatgatgctttatatatatttcatataatgatactacctcaaaataatctactattcatattttttattctcaccctttctcccttcatctattttacttacagtaatatatttttaacgcatctatgattgtatcatatcttatgtcaaaattttagcattaatattcgtccttaatttataagtaacgctccgaggacttctaccacttgcttgtagagtcagccttttcctccatcaccttcatcatcctcgctaacggtgagaccacaaggaaaaagggacatgtttcttgttcgtttgtaagtaagtttggagagagttctatcatatgtttatggtcttttaggatgtttatgaagttaggcttgtttagagcctcttaatggctactccttttcatgaggtctcttatgaagcctcatttttcactaggctctttttaggatgtttattgacttatttgttgagattattggtgacgaagtcagtagccattttaggtcatggcgccgaattattcaatatcatcagtttgttgttatgtctatgaataaagtcttgctgatatttggcaatatgatcatgcatatattagagtagtcaacgtgatgtgctcgtctatctgcaattcttacgatgttataatatatagagtatctttgatcttacgatgttagaatt

SEQ ID NO: 6960 - DNA, 1334 bp, Oryza sativa
  unsure (1)..(1334): unsure at all n locations
gggccccacacggcacccgcggggcgcgccggaagccggccacgccggcacagccaccgggagtcggcgcgcccgcgtccctatggtcgccggcggcggccataggtacggcggagcggcggccgagataggggagggaaggggcaaacgaatcggcggtccacggctcaccccgggtcgacggcgacgacgggaccggcgaccggagcgtagaaaggcggcggcgcggctcgggtgaacggggtcgacggtgctccggcggtcggcgtgcgaaacggaggggtggacgaggtcgccggggatgcggtgaagccgaaggtggcgacgccgaagcgggagaaggtccgggtcgacgacggcggcagaccggagctcggctgtgacggcggagagagagaccgacggcgcgagctcgattccggcggagatagagagagcgccgagtggcgaaaacggtggaggaaggcacggggagtgtttatatagggttgggagtgagcgaggccggccggatgagggggaaacgggcgcggaagatccggccgccattgatgcgccggcgaggtttagggggaaagattccgaacgaatccgagggagagagggagggaaaaatgggggggaaagagggagggaatcacggggaatatttcccccctcttgattgcacgcggggcggacgggagcggcggtatttgcgccggcggcggcgctagggcacggacgagccggcgggaacggcgggaggaaggggatgacgggtgggccccacccgtcagcgtgggaggcgggcgggcccgcccgtcagcggcacgcgcgcggggaggaggccgaatgggccgcggggagaggagagggagggggagggagctgggccggaccggcccaagagggagagggggagggaaagggaacttttttagggtttttctttttataaaacctttttaactttgtttatttcttcttaattattatttgtgctctgaaaattcaagtaaaatttgagggctccttttagacgaaggagaatttaacaaaaattctccgggccacattcgaatttttctggtacgtattttagtgtttgccaatttctttttgaattttaatttaattctattattccttttagggaatgatttttatttcgggatgaatttatcaggacgtgacatgactccgccgatctttagccccggttcataccaccacccgggactaaagtcccacccctatatatatatgtcttcttcctcctccagcccgagnnnnnnnnnnnnnnnnnnnnnnnnnnnnnnnnnnnnnnnnnnnnnnnnnnnnnnnnnnnnnnn

SEQ ID NO: 6961 - DNA, 698 bp, Oryza sativa
catcgtcagcttagggttataacatgactagagattggactagggattgcttagccatgcttagttcaactagtgcacaatggggaaaatcttattaatgtttagactgttggttctaatggtattgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtaagcaacggcttggcttgtaacgtagctttcctctagccgacgcatccaggcaagggtgggcgtgatggagtttggatgggacctgcgacggcctatgcggcttgcggattcacctaggcacgagaggggactgcccgctgccttgcgaggagtgggggtgaaacctgaggtgtggtgtgcttggttagagggggttatgcgaagggtcttgtcacggcctctttccggtatgttgtggtggcatgtcagcgcacggaaacgtgtcgaggggctgtgtcttgtggatacagttgtacacctctgatcagagtaaaactattccaatagccgtgcccgcgggtatggtcggtcaaccagattcaccgtgattagtctcaccctagtgtaatattttgaatctggatagttaggtggatg

SEQ ID NO: 6962 - DNA, 691 bp, Oryza sativa
ctgcaaattacaagtacaaggaaaattactttttctcatctggagttgacaaaaatttaaataaatgtaattcagtgctggagaaaaaaaaaatcatatgatcatctaaacagatgcagaaaaagcatttgacacaagtcaacattcttataaaaactttcaacaaattaggtatagcaggaatacttctcaatataataaaggttatatatgacaagaccacagcttacatcatacccaatgatgaaaagctgaaggctctttcctctaagaccagaaacaagacagggatgctcactctcaccactgctattcatcttagtgctggaggtcccagccggagcaattagacaagaaaaagaaaatgcattcaaattggaaaggaagttatgaaactgtctctgttttcacatgacatatatcttatatacagaaaattctaaagactctaaaaagactgttaaaactaacaaatgaattccgtaaagttgcaggatacaaaatcaacatgcaaaaatcagttgtttttctacacactaacaaggaactatccaaaaaagaaatttagaaaaccatactatttacaatagcatcaaaaataataaaatacttcggaatagatttaacaaaagaagtgaaacatttgtacactgagaactgtgtaagtcattgatgaaaggaattaaaacac

SEQ ID NO: 6963 - DNA, 622 bp, Oryza sativa
ttcctaacatgttcttctgggatcccaagccattcagtattgctgcacaagtcacttggcatcaaaaacttctcaaagaggtactccatctccaagacctccttgtcaaccgactcttcggctccaacgatggcagctgacagtggcagagaggctgccatggaggacctgctaaacttctttgtggctttgtgacacgggatgaagggggaggattagtgcgaatttgatgtccatggtgttgtgatatataggagagttggacgaacgcgttcccactaggagctatagtagaaacaaagtacaacctggcattttgctggatttatttccacttatcaaaatatatttatttcgtgcttattttggtggtactagtattgacaacctgttttagattgttatctgtaaagtctattggtggatacagggaaatcgcgtaactttgacagcactactatgggaaaatgtaatgctatacaactgtatataatgtgacgtgaacaaattaatttatgaaacaaaacaaatatggggaagcccagtgatagaaatatagagaggccacaaggccatgtgagtcaagccaatcaagccaaacaactcacaagaacttgagtta

SEQ ID NO: 6964 - DNA, 535 bp, Oryza sativa
ctagtaaaaaaaccggaccggcccagcggttgaatcgtaaaaccagaaccatgcctctcaccggttcggtttagtagaacggacggctcatgcatttgacccggtaagaaccgagtgaaccggatggtttttagtgaaaaccggcgaaccgggctaataagaaccggcggttcattgtaagttgggctaacgcttgggctagccttgtaaggcccatcatcctacaccacgggccatttatattttatgcaaaatataagagaaagcatgtgtgggaagtgatttgaacccgtgacttgcggattgagacattgggcctgttcactttgatgccattttcaaccttaccaaattttggtaaagttgcaaaaaaagtggctacgggcctgttcactttgatgccatttttaaccttaccaaatttttggtgaagttatcaaaaaagtggctacatttagtttgctgccaaattttggtaactatataagaaattctgccaaaattttggcaagttgtcaaaattttggtaactatg

SEQ ID NO: 6965 - DNA, 516 bp, Oryza sativa
taattgctgccatctagagttactgtgataataattcaagaattaacattgtgccattgaaatcactagtatgtttaacatgaaggagtagcataattttgtgcttcttttcttttcatttcatgtttcctttttgctagaagcaaattgacatccattaaaaacagaggatctggactagcaatgacagtagggcttgctcatcacagttaaaactggaaatggaacataattgaagtggccagtgccataaatcgatctttctgtaatccctccttattacatgaaaatggagaaagttttggatggatgaatacaaatccaatccaaaccataccaaaaaaaaaaacaacaactaattactttctttctttttgacaccaatagacagagaatgcaacaacacaaaagctactatacaccatgaattctcgctgtactggtgttctcacatacacatgcgcgtagaattcaacacaaaattaaaccaattcaacacgagatcgacgagcacca

SEQ ID NO: 6966 - DNA, 704 bp, Oryza sativa
aaataatatatttgatctcataatttattaaataacaacaaaaatcatatattactaagctcgttggaagctcgagctcggctcgacaaagctcacgagcttagagagaggctcgggctcggctcgtcaggagctcgagctgagctcgaatcgagcctaggacgagccgagctcgagcagctcgcgagccttgagctttttttgacagccctaatgtgaatatcagcagcgagcgagctagaagtctagaactgtacattaacgcatatagtttttcatttgctgtcccctttggagagattgaataatgtttaaaacttgctacgacgattaattagccagatatttttcaagtgacttaattacctatgatttttcttacattttagtccttttaaaaaatattttctaaatagatccctaaaaatgtactccaaatatacgctcttcttggcaccacttaccctggctctgaggtccagcatgtcggcacgaatgacgctggtgatgagatgttgaacctcggcacaaataaccttggcgtcgagaaaatgatccaatttcaaaataagtctttttttagaaatctatttataaaataaatttttaaaaagagctaaaatgtagaaactataacttagggcctgtttgttacagctccaactcctaaatttaactccaggagttgggtctggaatagagtt

SEQ ID NO: 6967 - DNA, 17581 bp, Oryza sativa
ctcattttgactaaataacatgttataaaaataataagggatagagaaataccatacactaaatgtcatatatgattattattgaaaaaatttatttggtaaacaatgcaatatacatattatacatattgtctaccaacataatcttctctcgctgtagtaagcattcatttggtcaagattaggtataccctctacccttcgatgtacgttatatactgatactgtcgacgtttgatgtcgcgattctggtatttgcatagtatggggatcgttggtaccaggatatatgcgagattgaggtaaaagagacatagacgaggatttttatacaggttcgggctcctgaattgtcaggtaataaccctacatcctgttggccgaagccgttattgctcttattcaccataatcacaccagtacaatatttggggtagcctatctaagtgttgtcgacatggcggtctgaaggtctgactcgtagtcgacaacagggtagccttcctcctcgaatccgcattcggcgagatcagagacagcgctatatctctcctgacggtatccgtaggcactgtaggggactagccatacctatctctgaactcgatatccggtgtcttgtcttggcgtatgttggcttgtatgttgtggcttctgttgttccgtgtcccctctcttcctagggggccttgtatttatacccataggtgtccccttgtccaagtagaactagggaaaccaatatggatacaatccgagtagtccttgtcgtttccatgtagaactctggttgtcttcccttatccggaactctatccatatctgagtcagtttccatataagacatggtatgtggtgggtcctgccgagatttagtcaactactattaggtatgtggtatccataaccctgacagatacggtatacccgcacgtatacgggtagtttccttatacattaaggacatctaacccgtgatagaaacataatctatggacggaaagagttctactcggataatactgggtctttaccatatcgtgaggggtccaatatctccgagtcctacttggagatcaactgacccacgatatataagggaccccctaggcaggacctaaggcatcgaatattactgccaacacatccccacagcctacaaagccgaagcctacaggagccaagtcgccgggagatctagtcgggccaactcaactgcggtctcgtcggtatcaccgagttctgttattccctttgtaatctgtggattccatcatataatcccataccaactggattagggctattacctactaaggggcctaaaccagtataatccttgtcttttgtttgcctgatgtcgtactacgtagatcctcgtaccaacggaccccaataccctctatatctggtctacgggtatcccccatcgacagtgccgcgccagataggagaacttggtgctcaaggttctactactatgacttcaagcctcctcgacggtaacatcaaccccagcatcaaccaaggagcttcaacttcaacgatgctggtgtggactcaagtcggcgaaatcgtcttcccggtctacaccacgatgccgatctcgactggcctagcaattaccgggagcgagaacggcgtggttacgaccctggtcgactctatgtcgaaagatcctcccgcagaagcggagaacggaacatcgataacatctgagcctgagaaggatcctagtgcggtcaaatcttgtccttccgacaaaaagcacgagccgacaaggacaacttccgaggacgacacagaagctgagaagataacccgacaagccaagatctattgtatgatcggcaatgatctgtacaaaaaggcgccaaacggagtacttctcaaatgcatctcgtccaatgacggcaaacatctcctcctgaacatacacgaagagatctgtgggtcacacgccggcggatggacgctggtaggaaaagcttttcgacaagggtttttctggccgacaacactcaaagatgcctgcgatatggtgcagcggtgtgaagcctatcaatttcacagcaaacacacaaaattccagcgcaagcgctccagactatccctctcacttggccgttctcgtgctgagggctcgatatactcggaccattcccacgaggacagggtggctacaagttcctattcgtggcgatcgacaagttcactaagtggattgaagcgacgcccacaggggaaattaaggccgacaatgccatcaagtttatcaaagggatgttctgcagatatagattgcctcacctcatcataacaaacaacagctcccagttcatcagtgccgaattccaggattactgcattggattgggagtcaagatttgctttgcctcggtttctcaccctcagagcaatggataggtcgaaagggcaaacggaagagtactacacaggatcaagacccgtgtctacgacagactcatgtcacacgacaagaagtgggtcgaagaactcccctctgttctatgggccgtgcgtaccacaccgacaacatccaataaggagacacccttcttcctcgtgtatggcttagaggccatgctccccacggagctacaacatcagagcacacgagtacataagtactccgacgaggaacaggagcagcgaagcgacgatgtgaatctactcgaggaacatcgagaaagagttgccgttagagcagccagctaccatcaggcccttcgccgataccacgagaagcacatcagagcacgcacactttcgatctgcgattacgtcctccgacgggttcaaagtcaagtagggcgcaacaagctctcacccaagtgggaaggaccatacacaatcacgcaagtcttgcagccaggtgcattcaagattgcagacggcgatggtcgcgagttagtaaattcctggaacattgatcaattacgtaaattttatttacaaatcaatagtctcaaaatttgtaagtcatattacgatttcaataaagttgatttcaggttaagaatattgtcagagtgttccttcccgacgatcccttaccacgacgacacctagagttgaaacctatcctcatgtccctttacgccgtcctggcaaggcctctgaggaacctaagggaacttcagctagggacgcccagagcggataaggccttgtcggatcatgtagagacaaacgaccatgtatgacctggtcatgtaagagttctcgccatgcgtattaaccaagccgtgtaatcggaaattgagttttccaacttcacggctgggggctagggtcagtgcttttttcaaccaaggcaggtcaagggtctaaaagccttgtcctccgagaacgattctccgacaaggctaggggctagggagagtgtatagctcaagtgactgatcgaaatcacaaagtgagaaaacactcatacacaacatgcccagagtaagaaaacttagatagattccttttctattttacaagtatttcttacaagtcataaatacttcaaagtatattacatgcttccttgagatatttttctacataatacaaaaactaccagacggccaacgccaatccatggagcggatctccgcaggaccgtcgatctccgcaggtgtcctccgagaacgcgagaacccttcgcgaaggaactcgagatgcagctgcgaacgatgatctcggatgcaggctagcacatgtcctctggcatagcggctcgctcgacgacactcctgcttcagggcatcgtcgatgcgctggccaatcccttcgagctgtgcgcaagcctcattcaaccacgagatataaccagccgccgactcctcgggatcttcgcggggaactcagagctccatgcaaaccctcgccatcgacgtgcaacagctcctgaggtacgagttgaaccacacctcgtgacccccggagagcttccatggcctggtccttcttcacctgcaccatgatttttttgagttccaccacctcgagtttcgtcttccaatatcggattcgacgagctcggtcagccaacatgttcttgaaatctgcccgacacggaaaagactaagtcaagctattcttctcttccgagaacacagctaattaagtcaatccgaacacaaggagtgaaggagagcaagatacaaacctagcaacgtcatcgccatgtttgcctccgcggacgggccctgactaatttcctcccacagcacgaacggctcgagtgtgagcgccggaacgatcaccggcatatcgggctgcccgtgctgctggacatcctcgacatcaatatatctacaacgacaacaaagtactcagaatcacatgctaaggaaacaagggagacagtgttgacggtcgttatcaaacagtttcgaccgtcaatattatcaaaataggagagaactagtgatgcttgcaatgcatatgtttgttagaataataatattccactagtattaggtatactaacctttttgtagagaatgacactaaagtggaggagaatcgacatcaacatagacgataaatcaatcggacgatgtcgagaaccagacttatgtatgaatgggccaagaactcagaattgacacgatgaattgggccaaaattcacaagtctacaaagtgaagcaatagaggaagtcgccaaccgaagatgggctggtttgggccagcccatggttcagccaaaccagggggttcggtgtcacgtcctgataaattcatcccgaaataaaaattattttctaaaaggaataatagaattaattaaaattcgaaaagaatttggcaaacactaaaatacgtacaagaaaaattcaaatgtggcccggagaatttttgttaaattctccttggtctaaaaagagccctcaaattttagtggaattttcagagcaccaaatataattattaagaaataaacaaagtttaaatgattttataaaaagaaaagccctaaaaaagttccctttccctccccctctccctcttgggccggtccggcccagctccctccctctccctctcctctccccgcggcccattcggcctcctctccgcgcgcgcgccgctgacgggcgggcccgcccgccaccctcgctgacgggtggggcccacctgtcatccctgtcctcccgccgctcccgccgcctcgtccgcgccctagcgccgccgccgccgccgaatccgccgcatcccgtcgtccccgcgtgcaatcaataggggggaattattccccgtgatttcctctctctttccccccattttttccctccctctctccctcggattcgtttggaaacctctcccctaacctcgccggcgccatcaatggcggccggatcttccgcgcccgtttccccctcatccggccgccctctctcactcccaaccctatataaaccctccccgtgcctccctccaccgtttccgccactcgccgctctctatccccgccggagtcgagctcgcgccgtcgccctctctctccgtcgtcgccgccgagctccggtccgccgccgttgtcgtcccagaccacctctcccctcggcgccgcctccttcggcttcgccgcatccccggcgacctcgtccacccctccgtttcgctcgccgaccgccggagcaccgtcgaccccgtccacccgagccgcgccgccgccttcctccgctccggtcgccgtttccgtcgtcgccgtcgacccggggtgagccgtggaccgccgcttcgtttcccccttccctcccctctctcggccgccgctccgccgtacctatggccgccgccggcgaccatagggacgcgggcgcgccgcctcccgtcggctgtgccggcgtggccgccttcgggcgcgccgtgcggctgccgcgtggggcccggctgtcagccgctcgcgccctcgggtgcggctgacgcgtgggacccacggcgccggccggtgtgagcccgggtgcgcccggtccaccgtggaccgtggggctgccgcgtgggccccacccccgtggacccggtccgcgcgctcctcccctcggctgacgcaataaatccattttaaattaaaatttaaatgaacaaattcgcaaatattcatttaaagagcatataaacttcaaatggccataacttggccatttgaactcggaattggaccgttcaagtctctaatttttccctaagaagtcaagaacccatttttgtgctttgttcctgcttgttatatggagtttattagagtaaaagccttttcttttccgttggtcgtgtagacgctgcagcttcggaggatccgctcttcgtggaagttgaagccggcgtttgggaaagcgagcaaggcaagtcacatcatccttgaacatattgaatcccagtttataaaattatgttgctttaaattattgcattatcactttatttaaattcccgcgttatcactgttttatctagccatgcctatctacctttgttatgaccttattattattgttattgttattattaccttgttcaccctagattaaacaaaaccccaactagtggacactctactcatagtaccactagtataattttaggtagatgcttcgctgattaattaggtaacattaggcggttttacaactctagactttgggatattcatatcacctggacactttggaattgttggtttattgtggaattggattcacaccgccccctctattcaaaatccccaaaatggttttaggctgagctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtgggattgggtcggtactcttgtctatggctaggatgggttgggaactatgtcacgtcttccgtccgtataccgtggtggtatgtggcacgtggttacacatgaggaagatgtgtcttgtgggtaaagatgtacacctctgatcagagtataatctattcgaatagccgcgccctcggttatgggcaagccaagcaatgtacccaagttagtgttttaattcttaaaatttgctcaacaactaaaatgtggaatggttggcctgggttggcttgggacgagctgggatccagggtcgggttgccagttcggtctgaatcatcgtaggccttgggttaaggcaggttcgtgcgggttcacgaccttgattaataatactgtgtagctctaggatcgtctttttaaaatggctttgggcaactaagtgacttttaaatgctgttttctgcaaaacttaacccctatatcattaccccttgtacccccttgcattaatcgtgcatccgccggtgtggcttgctgagtactgtggttgtactcattcttgctctatctttctccccccttcagtaagagaagctttggagaagatgtcttaggtggagtcttggcttacaccccagttgagcgcctgtgaagatggagccgtaggcccgctagtccgctgctgtttattttttattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacattcggccaaacccccatctccaccgttgaggccacagtttggcatggatgtccaagattgcaccccaatgacgtttggagggtacttcggacaatccccctttcacaactgtcataaccacctctatataaaggcttcactctcttcacttcaacacacaccttaagcaatggctctagtagcttttctcttctcttttgtaagatttgtacttttattagaatactcttctatatacatttatggtattaaaatactctccgagtatataagtacctactttacattatgttcttgttatactgaatatacggctagcttatctgggagatgctttggtacgggtacagtgtttgcttatgcaattactctatgtcatgacgatgatattatagtagtatctggtagtttagacgtggtgtctagattacgggatatcattatttggggttatatattgcggatgagaggtgggccgctgatggtgacagctcagtacaggtattcctccgcgcctatatataatcctaagttaatttcctggggagggtattcctctgtatttagccctagttgtatggtcatgacgggctgtcgtaaggaactcggcagtcaggggtggcttcttaaagtaccaggagagcatcggatagagggtattagctagtatatcagttaactagaatgtatgtatactatgtatattagaagtataggagtagatttcctttctcttttctttccacacagcttagatgatatattatgagaatgagtagttaatgcttgtgtgtcactctacccttggattatcttaacccctatttagaatatgattatcacaagtaatatataaattattagttgagttctctctacatgatcttcccacgggataaaataaatacgatacccttggaatactctagagtgaaatgctacaatggtatatccgtgcgcttgcggatgaactctgtaaccataatataccagaagtatttctacgccattgctgggaattatatttctagtaatgtcgttaagaaataccatcagacagttgttcagataagaatagttcggatccatagacaagttttacagcatgaaggttaaggggtacaagggaaaacaaatgtcctactcttcaaaaagggggaggacggactcccccaagtcaccgacttcttccatcgtatccttgcgtgcgtcatcagcggcccccagatccaaagccttcttaaggtccagatcgggatatgccagcctcatgcacgcaaggacatggcacgccccggtgtagatgccgttggacgtctcctccccgatcctagccgcgtgcttggatgtgatctcctccatcgccgtagccagctccacaagcgatgacgtcagcgagaactcatcgggatgcgccgggatggtagtcgtgacactacactccccggcgagttggtgcaggctggtgaatgacgttcgcagcgaaccgcagatgtcgatcatgtggccctcgagctcggacatccggtgctcgagtccgcgccgctgcatctcgttgccggccactagctccctcatctttaggaggtcctcgtgggcctccggccaggtcgctcgctagctagtcggcacgttggtttgccgatgacgccgccgccctggcctcctcgatctcgtgacctacgccgcgagcaccggcctagaggatgcgctccatctccgcttggagctcctcccaggtgagggcatcggtggacgggcctcgggtaggcatgaggctgacagcagggccactccgtgccgcctcctggtccttagtagcgaggtcgccgcaggggacacgctgaaagcggcatcagtcccaccttgtgccgtctttgcccgcgccgccctgtgaagatttttctcttccccatgaggcgaggtgatcggatttttgaagatgacaagacctcaaaaatgtttacttacttctcaccgatcgtcaccaacctttgccttcgctaaggtggaggagacgcgtccgagtcctgagtaagatgaaatggtatgagatcaagttgttccgactacgtgttagggaaccacaaagaagcttaccgtagagtttttcgctttccgacgggtccctcgtacggaggagaatttccttcccctctttgggacgttgctaccactcgtggtggcagcaacagcgtcagaggcctccttggcgatgctctccttcaacgacgctgccgcctggtggtccatgagtggcccgattacgtccgtcagagggagagcctgcacaacgtgaagtcacgacacgatctcgaggagaaagatgtaaaggaatcatcgagtacactgacattgatcgcagcggcgcgttcggccgttcccttctcgcaaagggggatcgagatctcgcccgtcgctgagggggcgctgatgatcacctgactgacgcggcgccccccggtgtcactgtctagacctgtgaatcgaaaacgagaactcgataagttaggagaaacagatggactcggaacaagattagaaatgcgagcaaaaatacaccgaggagagatccgggtcgtgtcctctggcccagagtaatcaaaggccggatgggcacgggcctgcagcggttgaatccgcctacctacgaagtcggcagcgacttcgtaccccgacaacccccaatttcggagatcatcgatgatctcgataaaagattggagggagggagtcagggcgggtttggcggtccactcagggattttgtttggttgttctttagggacaacaaggacgggatccgagttttctatctgaagatagaaccatctcgcccgccacttgctgtgagaagaggggcattggaaggggatgtaacgcgacttcagccgatcccgaagttggaatgcaacgcatccagataccctgttgggttccatccatcgcagctcatagtaaaagcggaatagatcaaggaagggctctaccccaatgtaggcctcgcaaagatgagaaaagatgctaaggaatgcgatggagttggggttcaagtgaagcaaagaaaggccatagaaattcaagacaagaagaagaaattgagaaggcggaggaagaaaaccgcaagaaatgtaatcttcaacgacaaccatgcggcctaagatgggtttaggttatataccacctgcctccctttgcatggtcccgcgacaagggagggcaccgtcgtcttgcagcttcctcaaggacgcggtggttgaggtagacttctcaagatccatcgccgtcggaggatcgccggagaacaagagggaagaagcaagctagggttttctttgcggagagcggagaagacgaagggcgctagaaggcaggagagttttctggcaaatggacttcaaatggactcccaaaatccctttaaataagcgcactaccgacgacgcgtattccaaggaaaggagagagattgctgccggaaaattctgggtccgttgcgcgcggtagttttcagacttcaatttaaattcactcatgaccgttgaacttcatgcggtttttgtcgatagctctttgtctctatggtttttgcactgagatcgactagatgagaacgacaattccgacatcagaagtcgcgatcaatgacatgagttcatttaagcagaagtcaggggctactgtcagggttacggataaggtataccatctacccttggatgtacgttgtatactgatacggtatacccgcgcgtgtacggatagtttccgtatacataaaggaaatctaacccgtgatagaaatagaatctatggacggaaagagttctactcggacaatactgggtctttactatatcgtgaggggtccgatatctccgagtcctacttggagatcaactgacccgcggtatataagggaccccctaggcaggacctaaggcatcgaatattactgccaacacatccccacagcctacggagctggagcctacaggagccaagtcgccaggccgggagatctagtcgtgccaactcgactgcgttctcgtcggtatcaccgagttctgttattccctttgtaatctgtggtttccatcatataatcccataccaactggattagggctattacctgctaagggacctgaaccagtataatccttatcttttgtttgcttgatgtcgtactacatagatcctcgtaccaacggatcccaatactctctatatccggtctatgggtatcccccgtcgacacttctaagctttattcctaactttcagtcatatcagataatatcttgagatatgactggtttttctccaactattttttatgattgcccaaaaatattaatgagcactccttttcctgtatttctcattttctttcttctcttaatgattgagaatattttctaccttccatgtcctttctttctttctttttttagccatattttattgcaagctactaatatgagagacattttaaggacatgatggaatatttatttggtggatggaaatgttgctcacacctagggtagaggtaaaacaaccatgataggtggaaggcatattttgttaatctccagtatatggtgggtgcacgtaagtgggtatcttggtcaagacagcataaaaagaagcaacatatgattatagggttattcaattaagatcatcatattattgaggaacttataaattttattcttttttaaaaaaacatatgctccggaattccagtatcacttagagaaagaccatagcaactctatttcacaaattcatatccaacaacaatctagatttagatcatgctttatgcaatccacaagtttcaaattcaaggcaaagattttttttgccaacaaactcaaaaactatagtgaaggttaggcagtaaagcactagatagaaataagaatagagcatctattcatcatttcaactgggaaaaattaaaacattcattgatgatggcagcagtgcacgttgccaagaaaccgttgctactgccaagtgattcaaggggcagtggctttggaggaggttactgcaaccagcagcgtgcagagactgcgactggttttcagttttaggattcctctgaaccagtagcagctgctgaacaatcatctgcagatgcagtagtaggtgtctagatcagtttaccgatcgatctgaagagaggtgaattaattacaacgaatgaaactacagattcagagaggaagatgagggaggaagatactgattgttccatttggatttattttgaggagttgcattgcagatagacaaacagaattcttgatgtaaccggtgcaaggaaagattcagatttcttcctatgtcattaatttataagtttttttgttttgattttcatgtacaagaatgtaaattatagtaaatggtaacatcgtgcaagctagtactcaagcatatttatatgataactaggaaggtggcccgcgcgcatgtacggacacttatattattgaaatgtaagattattgtttgttaaaaaattttgtcccatagattaagggtaaactaaagttcagataatgttattttataataatttaaggtttctatttttcttaaggtatcttaaaaaaccattcataaacttttgagtagaagatggattaagtaattacgacttttgaatcatgtttttttctcaagtaaataagaaattattgctagttaattatcatacagtccaactatatatataccatgtagtatggtcacaaatgaaaaatgcgagagcaatatactcaaatttcttgtgattaaatcatctcatgaagacgtatgatatagtaagaaaagaagggaagcgtatgcatgcaaaaaaagaagaaagagatcaaaataaaaaaagggaggggaagcttacataccgacatatgtaggtgcatacctatgccgcgggaggagaggtgggacctcgtagtatttagtttgttctgagatcaatttaatctaacggtttataatattagacttaccgttttaagtgaaaatcaagaaatagatactttgcttttttcttaaaatttctaatacttgctctaatttattatagaactatgtgacaccttgagagcattttaaggaattttaaaggacttaacacatgtaattagaatattgaccgcgtaatatatatgagaatatggtaatatttgttcctgcttcgtccttgtttatatacatgtagagagaaattaattatgtggctggcaagccactagatatctaattaatagcaattaattttgacacctatttacaattgttcatagtagctcttacatatacatcttacgattttgattatttgttgatcaccatgactcgcatgaaaaaaatatgtgtactacatcttacggtttaggatatgaaattgatgaattatctgatttatgtgatagctatttgagggtataaacgaatgatttgacttctaagaagttaaaacattgtttaaaaaagacaccatttagaaacttggaaagcgtacaaacgtaagtccaaaatatggaattggaaaaaaaagagggccttaaactactttataacacccttgtcttagtaagagttctattgacatttataatataatgatttgtttcacatgtacgaacaactagtacaaaatccaaatatgacataacacaatacattataattattatgtaatcaactcttagtccaaaatattcttttttttgccaacagggccaaaatgttatatagtttgtatgcatggttcatagttgagacaacaatacttttgaacatcccaaaagaaaactcaaaaaaaattagaacctttttagaaattgccacattttcatatggaaataatcgcttggaaaacagttttcacgaagcttttgtaaagctttcataataatttccttttcaagcaaaactttaggcaatagttccagaagtttagctttgaaaaccttttgaaaagatgattttgaagtcatgcactcaaaatttggttttgcatgattttgcaataaattatttggaaccaaaattcacagatgtttttcaagaaaattttcttttgcaactaattttgaccattcctataattttaatataatttcaaagcggttttgggagacaatttttcaattacattgtttgaaacaaacacttcctttcttttttggagcaattttctttataaaactatatttcagaatgcaaaagttaatttgttttgcaatattttctatagacaattcacaaaacaaagttttcgggggaattatgccatatgagttggacttgtccttggaattttaaagcaaccggaaggtgaaattcatatttattttatccttcatccctaaattcttgtccacattgtagtttacaacgttccttttagtaaaatttcctgatctgcataccatcttatgtttctcctgatccataagcttcaaatctttgtatgtttatggaaataactagcaatcttgcatggctttcttatagatacgcagtccgtttctcttccttttattgttctccacgatattcccatgccaaggtagtacatttgttgtcagtggtcactaacggcttattcgagacttcacttctactgcacgagggtgtaaccaaaggaaactagtactaacaatgataagttgtcatgatcgataagttagtttctgctcttttctttttcttcacattattttcatataatatgatgcaatcgtctactttcgaggatgaggtttcggcaacaatcaataatattcctatagcgtcttaattgctttcggttcttattctataattttgaaatgtagatgagaatatagaaccaatattttttaatcacaaatcgagtagtaagattgccttttcaaaggaagggttgagatgtaaggtatcaaaataatttttcttttcggtgcatcggaatcagacattttccaagaaaggtaagatgacgtcaaaaattgtttgaatgttttcacagatctttttttagcatttaaaaatagctttgaaaaatatagagtccttaaactaacgaccattctatctaggttctcgaactacagtcgatatgctctgataccagctctgtcgacccccgattttggaactcggaaatcttctgtgtttatcagtaccaatccctggatcagtagttggtacacacatacatagccaaatcacaacatatcacgaatgaattcaggctaagagagttaaatgcttacattagggccaggcaggccaacaactaacagagaacaacagcggaagacaaaataatacaagggcccggttgacatgccacaagcagtcgactgggaacgagacctagaatggaaccacactccgatcatcttgttaggtacgcaagcatactaacaagggcttctcttcaacactctgctaaaagatatatagagcaacaatgagtacaaaagtactcagcaagccaccacacaaaatgcagtaatgtacaggataatacaaggagtggctatggttactttgcgtaaagctgagttttcaaatatcatttcacaaacctaagacctagcataaactgttcaagttttagttccattgttcattaaacagcgacggttctgtccaccatccattgtgttcccaaggatagcttcccgccactggtcgtcatggttttctggggtctaccccttctcgcctctcgagaagttgttccaccagtacaaaatcatcatgcaacatcccacccaaccagtttaagaatttagagtctagccaagtgtaatacatgtcccggtgctcaatatccgcgagcacggctattcgaatagatttggtttactcacattgcagtggatgtacactttacccgtactccgcgacttgcccaacacatgagcctacgtcccaacgaatgagacttgccacagcaaagcctttcgataacctcacattggtagtacccgctccatgaacttgcatcctcctgtactctaggcgtcataagtttctagcagtgagaggagttctggcgctcccgggaagggaagactcacacatgcattaagttttagttaagttaagtttacacatggcagtcctaccgatggcgacaccactgtaagcactcgcccctcgcggtcccaccaatggctgccccaccgtaggccctgcctcacacacatcaagaataaccactatgcagggatactgccttcgctcggctatgtactccgctaggtctatacccatacgagaaatacggttgtacgagagtcgtttcatgcttaacttcatggctcggtccttaactgaacagggatggtactagccttttccggactccacccaagtaccccagccgccccagtcgaaaacagtgtttaattttatttctcctttcacagttcgtgtcatccttgtcatggcaatgtggcgctcatgtctccacatgccgcatctcaactaccttccctaaggtagttgcccaagcatatagcacttgataaatatgagaatgcatgattctaattagcatgactaagcatttgttcaatattgactaagtacacacgatagcagggtttacaatggtcatacagataatcaatatcaaggcatg

SEQ ID NO: 6968 - DNA, 3299 bp, Oryza sativa
ggacattcatattcatatatatagcatgcaattttatttaaatcaacataattttcgcaataggttcaacatgctcaaagattagtgatgacttgcctgctcaggatagttcttattcttggtataatcttgatcaaccttcacctcctggaagctgcatacgttgcctcaccactaatcgatacacaatttctataatatgcgagaaaaccaatattcaagcaacaatcaaatatgcacaaacaaaatataattgttcggaatatacctagggctattcatatcactcgtgcttgctaatggattgtaaggtgctacgaagtccaaactatggctgctcacatacagaactcaatactcaggactatggaattatctatgaactattgctatgtggagttcatggctaaactagctttgattgtaatttaaatggtgacaccctacaggagatttaccaaggctcagtggataatttaatcataacaagagttctaacaggatggattatctaagcatggctctacaaatattactgtattagggttccaacgaattacatgctatgtaggttagattagtgtggtccataatattatagttaaagtttatctcaatgcataattttaccataaataatcctaagtcacggtcaaactataattgtgtgtgaggtcaagatttataattagtgttttatctactatacacgcttatcatagactcctcagtttaatatatgaaaaaggtaggttattgttcttgtgtatgatttaaatggactgtacagtagttgtgagtgcaataacatactagtattagatcatttactaagcatgagctatttactgtaagctatacagtatatgtgatgcaggtggatttggcgagttggtactgtttatcaacttaagattaccaacttaaaagatactattccaaagaacatgacattaagtaattaatttcgtataggtgatttaatcacactagctctgttattatttctcataaacaagttaaagattcatctatgagtattaatattttagttacaaaatatgaagctaaactttatgtaactaatttttaagtcatgaatttaattatatggccatcgaatattaaataagcactagtattttcctatacatccattcatttgagacattacttatacttagtttatgtggttgctacagtgacaaaacatgttaaatatatttatttgacatctactctactgtacaatatcaattttatttattagcacatttttaagttgaccataatctaatcatttgatattaatatattttattaaatagtgagttatataccattggaaagcttatgaatttagatgaatttaggttcaagtttcactcgaatcggagctaaaatgaataatttatactaatttaaagattcaaatttgagttaatccgagaaattgtaaaaatgcactgttcataaatgatttatttttaatcggaaacattatccaaaacccaccgtggttgacatgtgggaccggccctggttgacttatggtcaaacctgcttgtttaattaccattgggtcccgcctgtcataggaacaaaatatataattgtgttttcttagattttaactatagggaccccacctgccattgagtgggataatcaccgttagggataggattactgtgcgctaatcacatgtgggtcccacacggtttctctctctcctcatcttcttcttcctctcgcccgttaccgagcgaggcagaggcgcggctcggcgcagccggcgttgccggcccgagccgggacggcggcgggcggctcggcgacggccagggtgaggcgcggaggagctccggtgatctcccgccgatggcagccggcgcgcgaggagacgggggcgcgcggcgccatcaggcgacgccatgcccgagctcggctacaaggggcttcggtgctagggacatccttcggccgaattgaagggtgcgggagcatctacgaggtatggggattcgatttcacgaactatatggagaggggagctcccgggatagcctacccacggagagctcgccggcgatgaaacggcggctggggcggcacggccatgggcgctaatcgtcgattttgaagccggcgctagcaattagatgtatggaggacgctacgggcgcgagggtgtaccgcgagatggcgagatggcgaaacgcagcgaagtggagctcgacgcggtgcaggacaggggcaaacggcagcgacgtaaggtgctcgacggcgtttcttgatgtccagcggctaccccgcttcccccatggcgacgcggcaagcacggttctttcctccacttcctctaaccttctgctccggccggggagcctcacaatggtgatctctagcggtggtgagagggtgatcgcaaggtgttcgatgaaatgcatacgagaagaaggctgagagggatggggattttgttgagggcttcgcttaggatgcaagcaaactatggggataagatcaccagcacatgcctaggcgagctagagtactaatggtgatcggataagagcaatgaggtggatgacgcggctgagattcatctccttctccattaaggttctgtggcttaatcatcacacctataacctatagactgcaggtctgggcgctagctggaggagagggctccgttttatccattgggcgtggatgggggcgatgggacgcgcgtgtctgggtgatgaaggcaggcgtggcgacggcgacgcgcgcacatgggcgatggtgcagctccgtgttttctggagagaatctaggagagcggttagaggtgcggcttggcgtggtgcgggccctggcacgacgcggcacggaagggatgacgcgggcgcgggcgtgggtccggcgcgatgcgacgcacggcgcgatacaacgcgatacggttgcggagcggcaagtgcggtgcggctagggttggggtcggacgcagctgaggggaaggaggcgcggttgcggtgcggcacgggcgtgactggcgcggccagaagcgatgtggtgcacgcagtagacgggatcgaacggttggcggacattgaatagtggcggctgagaaaagagagaaaaggaagaaaaagggaaaggaaggaaagggaggggctaatctgcaaaagtgaatgggattgaatttgaattgaaatgtaatcaatatattttggttttgagaattcaaatgtttgatttgaatatttatttggttatttattagttcccaaatgaatttgctttccatt

SEQ ID NO: 6969 - DNA, 1668 bp, Oryza sativa
caacactaatataagagtcaagtatttcctattgtgatcagcaaaagcaaaaatcctaatctgatgatttttaatgaattcatataacataggcatgttcaactagaaattagaacgattaatactagtactatcttaaggttggtaattatttataaaagtaacacaacaagaagtgtgccagtaagtgccgaacatgcaagagtattatggatttcattaacaaaaaatatgaacctaacacatgtaagggaatatatcaaacaaaagcagaaataaaatgaagagacaactgaaacagaggaaacagatttatgcagaagatatttagatataaactgcaaaaaaaaagaacaggaaatgaagggcataaaaatgaaagcttcaatttatataaaattgaagatgctgacagaaaaaagtttactcaactccaaaaactagaacaaaatatgaagtccaacgattttctgatttattctttacagtgtacaatgtaccaattttttgtcctgttttattttcatgttctgttcccttctcatatttttgttaccatctgctacatggcttgtgatgctgggatatttaaccaattaacccaaacgaatcaagaaaaccagtagagatttggaaaactcatcgaactatgtaagaagaaaaataaaagccaataaggaaaactgagaaacaaatcttggtgggtggtaaaatttactgaaccacatatatagctcgacaaccaaattaattagcatcagatattgagtggaacagaagtaaaccactacggaattctgatgaacatccaagaaacaggaaatcctcccaatttgaccaccaacaaccaaacctcaactcctcaactacctgtctacctcaggaacagtgttaactattattgaccaaagtaagtaaaataaatgcaaatctttcctgatcaattcttgaccagaacacatgtacaatcgacaaaatgatgcagaatttgcgaacaaatcaactacaaaaaagaaatcaccattcatcctcattctcaaattgcaatttcatgatttggagaagcagagcagtatgagagaggttaattacctcgagcacggcaatggcgcgggcgacgccggcgcgggagaggcgcctcatcgcggcggcctcgtcggcgtcctccagcatcatctccaccgcctccctgatcgcctcaccttcacctttccttccaccggcacctctcctccgccgcctccaagaatctcccgaccaccctgcactcccttcgcaccctctacaccttcgacacctacaggatcacgcccttggacaccagcctgatccgcagcgcctccaccgacggaggcggaggtcgtggacgcggcatcagaggcagaggcggcggctggcactcggagacggacgacagacgcgcggaggaacacgccgacgccgacgcggcggcgccggcatacgcagtcgcgtcgtcgacaggggagacgcgggcgggcgagcgcatgcggcgtgacagcggcggcgccgcggtggcggcgtgcttgcttcgccgacggcgatgaagaggacgagcaggcagcgtcgtaccagcagctctgcagtggacggcggagaacgggtcgagggccaaagagcagcaccagggctggcgcggcgctgggccct

SEQ ID NO: 6970 - DNA, 9599 bp, Oryza sativa
agacgcggccgggcgagcgcatgcggcgtgacaccggcggccccgtggtgtcggcgtgcttgcttcgccgccggtgatgaggaggaggagcagccgtcgtcgtcccggcggggctgcggtggacggcggagagcgggtcgagggcgaaggagcagcaccagggctggcgcggcggggggccctgagggtggcggcgtcggctacggcggtggcggtgcgccgccgccgtcgccaccggcgacgagccgggcgtcggcatttgcgagttggcgtgtgggaggagagtgcgaaagggagggagggaagggaatgaagaacatgtgtcatgtagttgttgtttgcatgggtggtttgtgtggggatttttttttttggttatgtagcaccgccaaatgcacacatgtttctgtactccagagttatggattttgaattgtgttaagagggtttttttcatacagaagggtattttttaaccaatcctcaacatccaacaaaatatatgccacctttttcaattagatctttagcctaccaatagggaccttagccatcacataccccgaattgaatttcattcctatgaagatttgaagttaagccctcggggtgcttctaaccattaggctacatgccatttcgcaattgtgttcatagttaggaatcattttcttttgttttaacctatgtaggtgcaattaagctacgtgaagtgtcaaaatatgtgttaaaaaggatagctactccatctatcgcaaaataagtttatttttcatttatcctacacgtatcaatatagaaaataaaaagccaagaaaaccctcactttatcaaatcccacaaaaaatattcttctctttatatactctcaattcatttatcctctattttaaaaaactttgatacaataattacttaaaaataaatttattttagggcaaatgggaggggctaaaaataaacttattctaggacagaggaagtagctcagttttcccatcaggttgtaaatatttgatgccgaggataaaatttagtcaaactttgaccattgattttatgtaatgataagtttgtaaaatctgataaatctgtgatagtatgacaatgggcctgttcactttgttgcaaaaaaaaccttaccaaattttggcattgccaaaattttagcagctatgccaaaattttggtaacttgctaaaattttggcaggatttcttatatagttactaaaatttggcagcaaactaaatgtagccactttttttttgtaactttaccaaaatttggtaaggttgaaaatgacaccaaagtgaacaggcccaatatttttcaagacatatatgcaaaccattctctctttttttatataaaaaatatgaaaatggataagttattgattattaaagttgcaaattttgaccaaatctcattctaaatgacaagtatttatgcgttgtttgtacttgttgatctcgaacaaagtaactttcttatgtgtaacagtgtaagttagttaaattaattaggcaaatttatatgctgttaatgtctgtcttccttgttagatggatactatcaagtgttgtatatgaagtgatatttttaaggattggcatagttaccatcaaagtaagtgaatatactaattaagtcttaagagtacaagatctatgttgactgaatctcatgttttgtacattctccatcggtaaattctaagaagaggtataccatgatgtaaatatgacattattttagtagataattgccatgaaaaattctcaattactcatctaaaaagtgccctttttaaaaagctaacttggatgcataagtttcattttcagtggcatatgcttcaagatatatatatatacacacacacatagccctttcatttttgcctatactgtcactcttaaggccggcttaattagcaacctagatatcaccggatatagtacagtccgctgtaaattgcctatcacataactagtagtagtattgtcattaatcaattttaactctagatatgacccaagaggcatagataaatgcatcatgtgcccaccattttattatagcatcttttatgaaaaccaatattttgatgtaaccaactcaaatgcttgttctataagaatatcaatagtgcaacttctctaaacaaggatcaacagtgcaacatattgcatgtgattgttgtatggtctacatgcacatggatatacaactatatctctactattataaaaattaaagatatttttaccggtattttagtatgtcatccgtgtttgagtcggtttttaagttcatttgcttttggaattatagatttgtatttgagtagactttttaagtccgtttgctttcgaaaacataggagtcgtataagaaatcttaaaaaaaactcgcatgctaatcctacttgtagctcatgatcttgtaaaaacaatatccaagcaaattcctacaatgaatttcactttagctaaactgtataacaataataacattaagatagccttcaccaatttcaacacatgtgtattttttttctagtatactgcaaaatatgaatgaaacaaagataagatacggatagcggaccttacgagaaattcaaacgaattttaggctaagttcgtttgctggagttggaaactatctctcatgcacgcaaaatagagcgacccgttagcctatgaattattaagtattagttattttttaaaaaaatagattaatatgattttttaaaaaaaacaatttttctatagaatttttttaaaagaacaatatttagtaatttaaaaagtgtgcgcgcgaagttggtaaccttaagcaacgaactcagctttagtgaaatggcaataacctagttgttgtagtgacctgagtagcactctaaggtcttaagttcaaatctaatttcagattgggttatttgagagctaagttccttgtttaataggctaagttcctaatataaaatggctgcatatatccggttggatgtaaaggccgggtaaaaaaaacccttctctaaacaaaattagaactcatataatgatgatacacaaatactaaccaatagtggagaagatggtgggggtgagcagagcaaatttgtgttgggtggcaccctacgctaataaataaagctacaggaaaagcgggaagcaaaggatgccgttgcagcttttgggggcaacggcataatttcctctcctctcgtctctccatccatacttttccttcgttttaagcggcaaaagctcttcctttcttgcctactaatccatctgctaattggacctccttcactctaatcatatgcctcgtcaatgcacttacgctggtatcacggaagttcatcctaattaaactccataccactaaaatataaaaatagatcaactatatagtgtgttaaagattgccgccgccgtctttactactcaactatccaataaaaataaccttaatttctttgagaacatttagtaatgaaagaaaacaaataaagtaactttcgctaataagaaagtagtattgtcaatgtcaggtgaaaaaatgtaagattattgagatacaacacctcggtttgtagaaataagagggtaaaaaacattaagataaactttaacagctagaaattaagggctttttttgcatagatagatatttacgtgtttttttttgcggggagatatttacgtgttatagctgcatgttgttgtccagagttcaattgatttcttcatgtgaaagttagttacctcacatgacatctaaaactagtaacctaggtgattaactaaacatatccatcttaaacaaacagggctaaaataccacaagtgccaagccttgatgcaatccaaagctccagtcaataggaccccgtgacacatagccaccgcaatcgccggcgagtagtggccttatccggcgtggttaatactataattatcaccaaaatttggttaataattaccacctaaactaatcacacatgatgatgattattaatcagctagtagtagtaatatagtactagtagctagctaaccatcacatcataatcatgctgctcccctatgctttttgtgtaccaaacgtttcattccaaaataataatgacacgcgcatgcatgcaatgcaatactccagctaataacccaacctccatcctctgatttggttaacaaacccttgtggccatcaggggtaatgaggattaattaagcctaatcacacgttcagccgaccaaacagtggttagccaacctgcaattaagcatttttaatttggttggtcatgggggaactgttgttaattatggaggattaattagagggagagagattggctggctagctggttttggcagtggcaatcactctgatgtttgttgtgtgaccaactcttgctgctttgtttagtattatccagtagataggttattcctaatgactcaaagtggatgtatgtaatactaggtataatcttatcttttggttgttgagaacattaattatatatttttgatggtatgtggagagggtgagtgattgaatgaagcacactgctccactagtactgaccatgttattactatacacgatgcagttcaactacgaagctcttttggtacgaagaaattttaaagaaattccaacagaattaaaagtttactaggttgtttgttttatcacctataggggggttaaaaaatggcggtggaaatttctgacagtaccaagaccgttttcgtaaaactaaaagtgacgccgtttttccgattctagctatatataaaatttaattaattaattaattccatcagcattgtattgaagttgtcactaaattgttaagagtaaatttgacagaactaaagatttcaggtaatatatcataaaactacatgtttaaggctaattatcacaaaactatagattttgggtttaaatccttagcactaatattatgtttgaattataaacatccaaattttgtgattaaattgatactaaacttgttgttttttttggtaactttgttattaaatctgtagttttatgatactccaccttaaatctgtagtccggaatgaatttcatgttaaacctataattttgtgatacatgcatcatcttaaatatatagttttttgataatttaatcaaagtatctatagttttgtgaaatttaatcaaatagttaatttggccaatatgaaatttttttgaccgtaccaaaaccattcctctagctagaaatgataacgttttgaacgttttcatccttagttcacctatgtatattgctctttcatgtgtaatactgaaatgcataattttttcaaattactacatgagattaaaaaaaagaaagaaaattcagaccaaacaaacctaatttgttccaaggacctagtttctgcaaggaccaaacaataattcatggttaattagatctgcaaagttagaacagagatccgtaaaaggtcgacacgaactgtatgtattaattgtattgcatatgtaactatgcatacttgtagtggctcccctattgttaatattgctacaagcctaaaacacctcaaaattaaactctctttcattggcaatgtctagctgcatcaagaaacgacactgtttgagtattaagagttaggtggatttcgggtgatatatagtaaaccttgtggtcgaaggagctagctgttcttggcctggacgatattaaaagcttggaattccaaacagtgatgtatagatgcatcttgttgtcaataaaagcaggtgagagatgagatccccttgtccataacgaagcttttactggaaaaacattccactttcggaaattctctagtgtgtaatccgcttcccttttctggttcccgccttccttgctgtagtcgcgtcttatccttggccttgtaatgctgtaagcgtggcagcgaaggcgtattagcagaagcacgtgttattattccaaggaccagcagcaatcgaccagagtaaacgtaaaggcatccacggtttagtgaaaaagtagtccataagcaatacaatattccattcagccacatagcaacattgtggaactagtcatagcaaagaaataacaaaagttacccataaacatatgaactgtccatagagaattaaatatgttacttgtctctacttcctctctcctcctaatactatttgctatctatatacattgtggatgtttacaatagttaaaactcatatacgtgggtcccatctatatggactacttttgttatatacattgttgtttccctaagaatcaaacaagcattaggttattattcttgagatgacaccaagagagatactactacaagttagtgcacctaaaacgagaaagccactagcgcatgattaattaagttttaattattacaaactcaacaaatagatatatttgatattttaaagtaacttttatatagaaaattttcgcacgaaacataccgtttagtactagtttgaaagcatactaatggaaatcgagataaaatctaaatcttatgcagaaaagaagagggatggacctgtatgataatttggtcaataatccatctcaaatggggcggcctatatgaactggttttctggccgaatacgcttttgatgcaatctggtagagaactcttgattgatcaattccattatgaggaaaaaaaaagagcagctttgatttgactaaattccggtaataactcactctatgctccattcaaaactggaaccagggcggccacaagaggaatgaataccttctccattgcatgctgacaaatgacagtgcatgtttgctttttaaatttttttgcaggaactgacgaactgtgaaacactggagatcttcagggcaaaaggaaaagtctattctcagttgcccagcatatccatgccaaagaggcaaagaacacaccattctggcgcacgcaaatttgtttcaacactcgttgcactgtacatattacattctaaagtgatgaggtatatattgtcgacgtttgatgtctcgactacggtatttggatagtatggggatcgctggtgttaggatatacgtgagactgaggtaaaagagatggagacagggatttttatacaggttcgggcccctgagttgtcaggtaataaccctacatcctgttggccgaagccggtattgctcttattcaccataatcacaccagtactatatgtgggtagcctatctaactgttgtcgacatgtcggtctaaaggtctgactcgtagtcgacaacagggtagtcttcctcctcgaatccgtgcccggcgagatcagagatagtgctttcgtatctcctgacggtatccggagacaccgtaggggaatagccatgcctatccctgaagtcgatatccggtggcgtgttggcattatgtaggcttgtatgttgtggcttctggtgggtgtgtgttgattgtcatgggtgtcttccatcctccttctcctcctagggggtcttgtatttatacccataagtgtccccttgtccaagtagaactagggaaaccaatatggatacaatccgagtagacctggtcgtttccatgtagaactctggctgtctttccttatccggaactccctccatatccgaagtcagtttccgtatgagacatggtatgtggtgggtcctgccgagatgtagtcaactatcattaggtatgtggtatccataaccctgacatatatataatggataaaagtgaatttatgacaagtactcctatttgataaggatgaatgatgaatcgaaagaggtaaacacgttcaaatgttgatttaaaaagtttctaaaagtaacctttttttttttacaaaaatcgtgacgtttagaaattaaggaagcagcccacaataatccgtcatcggttaggtcaaaagaacgaccccttaattaaaagaactaaagaagagagtgatatgaatttcagaatttgatgcactgatgcttgtaagttgcaactgtagtgatgaccaccttgtacttacgtgggctactgcagatttgtgggccttctaatgggctttagtttgggctgcagacaaattaatgaactttctgccctttgtgaattgatgcaagtcgtgatcctttcagtttaaagtatttttatagaattattatatagcaattaaaaccttaagatttttttctactaaaaatgtccgtgcgttacaatgggcgaagacaaaaatccaatgataatatatgctttcttcctttccctgtataactatgtcgcgatgacaataagtgttaattcgcttatacgagagcctacgctctatttcacggtatcaacatagggtgtgtttgagggccaggataggagattgagaagattggaaagatatgcaaaacgaggtaagccattagcgcatgattgattgagtataaactattataaacttcaaaaatggattaatatgattttttaaaacaactttcctatagaaaaattttacaaaaaatacaccgttgagtagtttgggaagcgtgcgtgtgaaaaacgatgtactttctaactcaatgtatctggaacgaacgcagccatagtcttcatgacctaattttgttagagcgagagataagggaaagatgctacatttctagtataataactcgattatgcacataataaacaacgcattaatccttctgttattttctcgtgttacatacatcaattagtcgcatgccgttaaaacataacactattcaaatcatgttcaccttttggatcctctccggacaaaggtcacacagagaactttttcttataaatactgatcagaaaaaaaaaaacaataaccggtggcggtgacctttagttctcgaactaatgtttgaattaaaaagcaaatgtagcaatgatactgctagttttaattactatgaaatattttttacactctcctatgtcggtgattacatgcaacgaattttgccatgaaaaaataatattttttatagacccacaaacagataataaaaataaaaaaaatacaaccaactgtagaaacatttctttgaacctagaaacgataagaacttagttttgttttaatatggtttcagtccttttgcctatcataggattattcatttcgtattttttacggagacattttttgttgcaaatatggcaagttctccccgatatatctctataagtgaaaggttaatcttgaaaagccacctcattaatccacgtaggaaagaaaacatgggccatccgatgaagataaaaaagaaagagagtgcacgatctgatcggtaaaaaaaaaaaggttccggagaactcacgtccgccatctctggacgagatgagatgagtgagatataattttttctaattttttggttttttaaaattcttttatggtttactgtagtatgaaaagaaggggggagaggagggaggagtgtatgcagtagtataaagaagggggcagacgggtgatcgctgagcggacgggggagcgatcacccgtcc

SEQ ID NO: 6971 - DNA, 18530 bp, Oryza sativa
  unsure (1)..(18530): unsure at all n locations
cccaaatctactttacaatcttatcaaaccacgactttaggccgttccgtgatatacaaggaaacgtaatacccaagtcatgatctgttacatattccatatatataagttatcccctataactagtcggataaccatgccgtgtgggtatggggtacccataatctccacagtagcccctgagaccttcacagtcgaaaagataatcttctctcgaaccagattactccaaagccgagtacttcaatcatctttgacatggtctcccgagtacttttaccaaatctgaagactgtggagggctgaaaaataaagtcaggtgcatcgactagatgcacctaataggtgtagccctcgactatgcagttaagtgaacaaaccaagcatatagtcaataaataaataatccaaccaaccgagtggcttcgataattatagttaaccaagcgacttgatattaatatgtagcatatgcggtgtaaatccctgaataacatgatccgagtgatataccgactgctttgtaaaatatgatgagtgtaacctaaagttggctacatcattgaaaattcacatagcaaaacagctataaaaaagcttgtatgttgtgaataaagaaattttcaaagtattgggcgtacgccatgcgcacactgttttaacagatgtgcttaagtctctaaaagacacatggtttcgccgcacccggaaatatacggcatatgtggtgtaaaatccgagtaaataaactcataaaagatttaccaaccgcctgaaaaatgaccaagatatataatcagcctaagccataatattggtcaataaaaatgcacacttacgtggcaaaaagcaacgatattgtacccaatcaattgcttaaaaacccaaacaacaccttgacttatataaaaaagtcagcagggcagctatataaagctttattgtttgacacattttaagatgcattgtaccaactcctaaaaagttgagtaactgtggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaatagatcttccgggtgatatagaccaagtgtagctcatatgaatagcttctgatctgagtgattatcccttatgggatactccaaaatagatataaaaattgaatcccgactggcgccagtattcggttgataacccttacggggaataataaatagtccagtctttgagcatagaaaatagacccatgatcatgaattcatgttgcatgtatccggaacaagtccaaattgaaggtatgatacttgtgtttgaactagtaagcccctgagcatatagctcgtccttctgtcgtagtcacaattgtccattgatggtagctgacgcagttagcatagagacaagacaaccgatatagagataatattgcccaccagaggtggcaaaaatattggtggtagtgaagatagtgataccaatcaaaagtgatgaaattgcacagccgtggaggcgaagaaaccagtcggcaacagtcaggtcagccagcaatgaatatgaaggcgcccagcgataaagttgtctagccatggcagcgaaataatcagtcggtgacagacgagacagctggtgaagaagatgaaaacaagccaatgatgaagacgtagacgcgaatcaacgacgatggcgaaatcctccaatcatgaaaatgcaggaaatagtcgacgacgacaaacgcaactgtcatgatgaagatgacgatgtcggtgattcagtcaatagcggtgtagcagccgatgataatgacaaagacgctcatcaacgtttgcgtagtaggtcaaccgtgaaggtgaaataataagtcggcgaagacatagtcatccattagcaacagcggagatgtcagggccgatgaaacagaggtgctggtgatgatgtcagtgacaataatccatcaaattaatattatagctgttgtagatgcttcacttggaggagagttgatgctgttgtccaactcgtccaaaccgaaatatttgaagttgttgaagtagaatgtctgcttcgaagcaaagatgaagataatgactcctggagttgactcattagttgattaattggtttcttcagcttgacataaaatttgtcaaattttgagccttgtatttgtgtagcccccgactctttgattagttgggaaacaactaaacatagagtcaagaactgtagtttcttgtcgttgaatagtcattgcttgattgaagatatgtgttgaagatgtccaagtagaaatcctgaatattggagagccacttgttgtagtaaaataacacggcatcgcatgccgagatgtcgaggttcacaaagacgtcgtggttggtgaagtagcagcaatagagtttgccggtgccgaagataataaagatgaagtcgctctaccatgatgataaagttgcatcgctgtgatgaagtgaaacgagtcggcggcaacagaagcaaactggtagtgaagacgcgcagttgtgaagatgaaagcaccggtcggcggcggcataaccagtcggcgacggaagacgatgatgtccatcagtagtgatagcggtataaaccagacgtagaggcgagggcgctagtcaacagcagacgagatgaccggcggtgaagaagataaggccaatcaacactggcagaatcatgcagccatggaagtgaagaaaccagtcggcagcagacgtaggcaactggtgttgacgatgctgatgcctattagcggtgacggcgatgtagccagccgtgaagaagatagcatcagttggcgtcataacaggccagccgtgcaggcggtgacaccagacggcggcggatgaggcggccggtcggtgaagcggccggtcggtgaagacgtagacgcccaacaacggtggcataataggccagccatgcaggcggaaacaccagtcggcagcggacgaggcggccggtcggtgaagacgtagacgcccaacaacagcggcataataggccagccgtgcaggcggaaacaccagtcggcggcggacgaggcggccggtcggcgaagacgtagacgcccaacaacggcggcgtaataggccagccgtgcaggcggtgacaccagtcggcggcggatgaggcggctggtcggtgaagacgtagacgcccaacaatagcggcataataggccagccgtgcaggcggaaacaccagtcggcggcggaggaggcggccggtcggcgaagacgtagacgcccaacaacggcggcataatagggcagccgtgcaggcggtgacaccagtcggcggcggacaaggcggccggtcggtgaagacatagacgcccaacaacggcggcataataggccagccgtgcaagcggaaacaccagtcggcggcggacgaggtggccggtcggtgaagacgtagacgcccaacaacggtggcataataggccagccgtgcaggcggagacactagtcggcggcggtgaaggcaagccggttggtgaagacgtagacgcccaacaatagccgcataataggccggcagtgcaggcggagacaccagtcggcggcgacgaaggcaagccggtcggtgaagacgtagaggcccaacaacggtggtgtgaccaaccaaccgtataggcgaagacaccagtcgacggtggacgaagcggccggtcggtaaagacgtagacgcccaacaacggtggtgtgaccaatcaaccgtataggcgaagactccagtcggcggtgacgacggcgagccggtggtgatgttctgactgatccattcctggagcgtaagagataagcttaaagccatgaatcccttttatgcatatttggatttggatcctgcagaacaaacatataggatgagtagtatctgatgtaaatataatactcgagaaaaatgcaagtattttaaaatatttataaatatgtatttctcctcttgtcaattttgatttccccgagcagatgactccttacgtttaaacactctgcccgactagtcatagtccccaagcatcgggagtcggcctaggcacttcccaaacatgcatatgagtgacatgagttcgtcattaatagaacaaagtttcacggatcagaatttactactcgtgtacttttgcaattattaagagcagaaaataaatttatctcatctctatgcttttgatttattccgaataatacttagcaccttgcgttactcagtccatccaacgagcccccgggtgctaggaatcggcccaaaggcaaactatccattggcaaaccaaacggaaagcataggaagatagaactccataactcgataggtacttttgtactcagattatgtcgcaagcaatcaagataaatattatgaaaaatatgatataacatctgtagcccccgactcgctactcaatagagaaccaattgatgtagtgaggcagaggaaaataccatataaagaaaaaaacaatgatgacttagctttgtaatattccccttggtgatggcagaggtgaccaatgtgggaacaaagtcatcaatcaataacaatgaagacaccagtcggcggcgacgaaggcagtcaatggtgaaagcgaagatgcccaccaacggcggcataataggccagccgtctaggcggagacatcagtcggcggcggcgaaggcaagccggtcggtgaagacgtgaacacccatgaacggcggcataataggccagctgtgcaggcgacaataccagttggcggctgcggaggcaggccggcggtagacgcccaccaacagcggcataataggccagccgtgtacgcggagacaccagtcggcggcggcgaaggcaagccggtcggtgaagacgtgaatgcccatgaacgacggcataataggccagccgtgcaggcgaaaacaccagtcggcagctgcggaggcaggccggcggcgaagtcgtaggcgtccaacagcggcggcataatgggctagccgtgcaggcggagacaccagtcagcggcagacgaggcggccggcggtgaagtcgttgttgttatcagcaatggcggtggcgaagacaagccgacagagtggactcgcggccgatcgaccggaaagctgagacgcctcgagtccatgaccagcatcaatcgcctcaatagtgccgcgtaattatatgcgaacaacaatacaaaaatagcaagagattaatctgagattaaaaatcaatatgataaataatgataaaactaggcgtccggcgctagacgagtagttagcatgagtagatataaaaaattgctcaatggaaaatatcacataaagaggaaaaataaaggcacttagcttttttctcagtgtcctccgtatatatgtgttaatgggtggacaggagatcatatcggcagcttgtgacagacatgcaatacatgcatgagtgctgcacttccctgcgcgaaaattgctcctattggttggctcagattccacgtcgactccaatttagattagtaattgaatatcaccaggagatttaacatcatctaaaaaaacgctggcggttgagagttgatccgttgcttggtgatcctggtagattgatatcgccgaacagattaaaccagatgatggactcggcatgtcaaacgatcaagttgacgactgacgtcccgtcggaatttccggcggcggcgatgcaagccaaactccagaagagaagaaccggtccgaagatgaaggtggtgctgacggcagccataggagattgaatctaaaacttgccgtggtagattgttgtaatccctcgattgagtttcccctgactgatttggatcaagtcagagaagaggagcttgaagaagtggtcgacggaaaggaagtgaaaactcccgaagcaaaaacgaagtcggcgactcatgaagttgattccatcgcgctcgttgataggaaactcgacgcaacccctacttggcgcgccaactgtcgaaacatgaattcggcaataataaaagggggtagcgcacgaaacctaaaagtggatggatgcggagacaaggatttagacaggttcaggccctctcaatgagaggtaataccctactcctatttggggatttgaatccgccgggtgtagtattgatctgacgatcaggttgtgtcatgccccctagagggcctcctgcccaccttatataggagggggggcaggattacaagatagaatccttatccaatacggtatcggtttcctaaatctactttacaatcttatcaaaccaggactttaggccgttccgtgatatacaaggaaacgtaatacccaagtcatgatctgttacatattccatatatataagttatcccctataactagtcggataaccatgccgtgtgggtatggggtacccataatctccacaatggccatcaccaaacacaatgacaactatagtccaatacagcattcacaatgagatcgatttgattatgttgttagtttggtcagatgggcaaagcagagcaacagatggcttcatctctgcttcagcttttcctaaaactaacgtactgtagggccatcggtcactcacaactaacaacatgcacaattaacaatactgtgaacgcttcgctggctcgtacaccaatcattgcaaaataatcgtggagttcaaccctataaaaagttttcatacgtgctcagttggatcataggaatatctatcaaaaatcctttggattggtccgaaacataggatttgataggaactctaatatatgttaacttttggaaaaaaaatatttgtgtctatctattttttttgttcttgtgtttttcctgtgctctatccaaacagctattcttgtgttttttcagtccataagatttgagatgttagagcactttaattctatttcctccgtttcacaatgtaagactttctaacaatacccacatttatatagatattaatgaatccagacacatttatatgtgtctggattcattaacatctatataaatgtggataatgctagaaagtcttacattgtgaaacggagatagtatatctttttcctacattttaagaaccatgcattccaaagtagcccataattcacaacaccattggcatgcagtcactattacacaaatcccaataagtgccggttgggaatcggcaataggtggtttcccagccggtaccattttatcggcatctatgctctagggaataggtgatggtttcagaaccaacacctgtagagattataggtgccagttcttaacccacaactagtacctatagcattcaataaaataataaaaaaaaacagctgatggagcatatccaccgaccgccacctcgcccacaccggccttctctaccactgcctccatcaccggatctggaggagaagaggggagggtggacggagaggagggagggccatcgggaaagagaggggccggcgagcctcctccaccgctacagccggctctagaggaaaaggaggaagcgtatccagaggaggagaggaagggaggatgccggtggagaggtgtatgtgagagagagacgaggccgggtgtgggccaggggataagggtggggattggggccggcactcgcttgtttcggcttggctcgggtaacggttttttaaaaaccaacacctttagtttattataggtagtatcagtttttatctagaactaacacctataatataaatataggtcatttcttaaatgaaactcacaccggcatcagtttttaacttttttttctatacttttctttatagagatgagaaacggtaataggtgtcgatttcaaataaaccaacaactatggagtggtaccttttatggtagtgcgtcgaactgagggaactggccgaaactggttagctagagctagctcccaaatactaagttccaatcatagagagcaattccaatcatatagttagttatatgccacctgtgcaattaattaattaatcatggagcccgtggatcgacgacgacgtaacggccggagatggggcagcagaggtagttaaagctacggcgaccgccactgtcgcgctttcgtatatggcgtccacatgattaattaacctgttaattctgcggccagtttttaatatattgcgcttatggggtgcctaactttttcccacacacgcatgattagttcttcttagacaaatcatttagggcgacaattgtagtctttcttagcggatatatagtatgtaaaattaatgatatggaacagagagagggagtaaagaaaaacatggattatagaagggagcgaagaaaaacatgatttgtcaagtatcggcttaaaatcgacttttagcatttattaaataaaatattgttgtttgtgaatgaaaaaagaaaaggaagatacaaaacatttattttggtgcgttagagaccttgttgttttaactattataaggttactgtaaggtactctctctatcccataatataaggcgtgatcaaattaagttggcacgtagtagcaaatctaggatgaaagtagagatggtgctaatgcacatgactaaaaatataacttggtactataaattatatttcctgaaaaatatgaacttaaaaatccatgtttcattttggaaaaacatatatgtccagttcaattagaccctccaatgtgccctaacagatgcaaagcaagagctcctggtagatggcgttctcactggtttggtaattgaattgggcttggcatagcatttagcaattaataaacattggatgacaaatggagcactaatcacaccgtagagctataggcaagttttcttcttctctagtcgctgcaggccccaatatatatactttgattgttccagtgtcttctactagctttgagcttattggaagaacacttggggctgaaagctgaagctgcggcacctcaacaagccccaacagtgaattcgtccagttggcacagtctacacaactaatctttatattctaatttctcatatattataagctttattacaacaaaattaaaaattagaaccatatgaaagtaaatttaaatgtcaatccaatgatataatttttaacaaataaatcttatttcatattttactaacgctttgtttagttcgtgtgccaaaatttttttaagtatacgaacacacatttgaagaataaagcgtagactaataacaaaacaaattacagattcagcctgtaaactgcgagacgaatctattaagtctaattaatccgtcattagaaaatgtttacggtagtaccacattgtcagatcattgcgtaattaggctcaaaagattcgtctcgtgatttacatgcaaactgtacaattggtttgttttcgtccacatttaatgctccatgcatgtgaccaaatatttgatgtgacggaaaagttgaaagtttaaagaaaaaagtttgaatctaaacacggcctaagtgttggtcaaatgttttgaatgttgaatcttaaaatgcgtgcatgctttatattataggatggaaggagtaggatagtttcagcnacgtgattattattaagcccgtgtcaatttatccttataatcttaagattgtggaataaaaaggtcagaatcccctacatttatgaatataaagagtagtttataactagatcgctaattaactagttcaatagtctatcnnaatgagnagggaagagtaaagatccgnatgtagtagatcttcatcattttcncaagttcgtgtgcttcattgtccatcttcgaaactagggagctgttcagattaaagttaaaataaaccttatcaattttttgcattatcaaaattttagcaggatttattatgtatttattaaattttagtaagaaactaaatgaatgcacatatttagtaactctattaaaaaataatatggtttaaatgacatcaatctgaataataattaaccgccaatatatagcaaaatatccctgcaaacattctaactgtttggatatatatagtatatatgtagtatggatacatagagtataatatttctcttttttaataaatagcgttattgacttttgtacatatggttaaccatttttcttattctaaaattttatacaaatgtactataagatataaatcatatttaaaatactttaagtgataaaacaacatacaataaaataagttgtgattacgtaaaccttttaataagatgaatgattaaaacagaggtagtattatacagttttattcggtaagaggagacgaaattttagggtccgttcactttgttgctaaaaaaactttaccaaattttggtaatgctaaaattttggcatagttaccaaaatttgttgctaaaattttggcaggattttctatatagttaccaaaatttgatagcaaactaaatatagccaccttttgataactttaccaaaatttggtaagattgaaaatagcatcaaaatgaacaggcccttggacattatcacagcagtgttatgagtcgtgtttgtgctggtctgctgcagacggcgcacggtttgattattaattggtggtcggcgtcgtacgtggatggcctcacgtccacaagttagctagctagcctagccatgcttctcctttgattatgtgcggcatattcaggacagtttaaaggtcggtgggcacatattcagcctcctttaaattgcaccacgattgaaaagttaaggactagaagaacacatatgaccttaatagaaatatatctatataaaacaaatgattaaaaaatataaaaatgattgtttaaatatagaccacggaaaaaagttagaaaccagggtcagaaagactccagaaaatttttaaagaagctgaagctcttgctaatttttctgcaaaagtttcatactatcattcattccattgaataaaataataatatttaatcctttgttttcaaaggtctttgtaggaatttaggaatttgtgtaagatcgaactatatttttcctataaattagaagggttctcagcggtatagtgaaatacgctacaacaccgaatttgctatatcaagttgacagaaatttagatacaaccatattgctctaaaggcaagctcaatgtatacggtgaagtgtgatattagaagtgtgcccataaatagttactattgttagagcaattctcataacatacaatgttatggttaagatctaactataagatgtggccccactaagatggaaaaacttgcttcaactctagttcatgagatgaatgagagaggaaacaaatattttcttttcgtttgtacgtagtagaccttaagcataagcaccctagttaaagtatttctcataatatatatggctcactttataaatatattgtcttaaggttaactttttgatacattaatttttgtttgccttgagattcgtgcattaacagaaacaactccatctagctgcagtgaatttcaacgaactacacgagtccccataaattccattagcaaattaactcttctttgagcgatgagttaattttgtagagctccttaaaactcattatattcacattatagagagttaaggacctataaaatctccgatacatcacttgaaacaacagtcataagaaacaaaaccttttggtgtggttaattagtactccctccgtttcacaatataagtcattctaacattttccacattcatattgatgtcagtttcacaatgtaagtcattttaacatttcccacattcatattgatgtcaatgaatctagatatctaacttacattgtgaaacggtggaagtagacagtatcagtttttaacaaatcaaacgggccagacaagtgagatgtacttgcgctagatctgagcaagttgatcacaaaaatgaacagctaaaattacatgcagttcttaccttattggtggagcttcacataaagaagtacgtagtactagtatgtggtggcaactgtcgtgagccaccggtggaagaaggaagagaaggaccattctcagtgcaaagctcctcatttgagtggtctcaaatgccacataggctgaaaccataccatcaaaattttttcactcccacaatgcaaattgcttcaagagataccttaaatatgcatgttagtttctagtatgttgaatttcagtcgtgatatgttatcaatatacatccaagtctaacttttacactaaacatcctcagatccgctaagtaaaataaatctctccaaaattccttcaatcctcactccccctcccctcatcggactccgatcgaaccgagttggctgctggcgagcactatggatggcgccatgtccaactccgagaccgataaggtctgatcttcatgtggcgacataagaaaggataagacataatctattataacgaatttaagaaagtgttatttagatttattgaattcttcttgggtcgttagtattttttttttggaactgagtatggctcggctcggctcgtggaagctcgtgaaatgccaggctcggcttggctcggctcggttctccaaccgagctgtacattaggctcggctcggctcgtggtctggctcgtgagctttgcaatagcagcagttgtattgccagtagcagttgtgttgctttgcaatgacttggttattcagataataactctcaagtccctacaaagataattaggtatattgtatgcagccaacatataacaaattgatgggcttttttggttttcggccagaagtctttctattcaaaccgagcctactaagctcgtgagctgctcgcgagctggctcgggctcggctcggttcacaaacgagctaaaacccaggctcgggctcggctcgttcaggattcgagccgagccgagccaggcgagcccgagccgagcttgagccgagttcacgagctcgagctatttgtccagccctagtatcatacatacagatactggtagagtagtattcaatcatagagcggcccgacctgacctctgacgaccagtttgggtccctgctgggagggagggttgagctaggttagacagcagagcgatatcgacgacgacgacagagaattccgagaaagaaggaagatcctggtcactgtcgggcgatcgcgcgacgatcccaggctgcgcggacgtggcgcccgggaacagcctccctccccccctcgtacgtggacgccctcccctccacaactccaacgacggccaccacaacccatactccagcaggtgacaccacccggccgccccttgcacatgcccaatactactagctagctcgtgcatgcatgcaattgcaagagatcgatctcacacttctcaaatttcttttgacgatattgctcacagcaggtacgttacgtgcacacaaggaccagcacacaaaatcgatttttgctgcaccaccaccatgtgcacgtttgtttaacgcacgcagttatatataattaattaatctgatggccggcacgtaaccaggcaacacgtacatacgtagtactccctctgtattttaatgtatgacgccgttgacttttcgactaacgtttgaccattcgttttattcaaaatttttgtgcaaatatgaaaatatttatgccatgcttaaagaacatttgatgacgaatcaagtctactactacttaaaaagtaaaacctgcttccgtcgtccgttgagaaaaaaagagcgacaaaaaaaaacttcactcggaaaaaaaaaggtccgactcatccagtggtaaaaaaaagtgagaggaaaaacaaaaaaaaagaaaaaaaaaacttcgatcgcgaaaaaaaaaggcgtcaaaaagtccgactccccggtggagaaaaaatgccgagaaaaaacaaaaaaaaaagcaaaaaacttctaccgtattttaaaaaaatatatatataaattaaagatgtttttgcatccgtgtatgggtcggtttttaaatccgttcgcttttggaaatacaagtccgtatttgagtcatttttttaagttcgttcacttttaaaaatacagaaggaatcgtataagaaatctctttaaaaaactcgcatgctaatttcagacgatcggactcctacttatatctcatgattttctaaccaaatatatatccaagtgaatttaacgcagtgaatttcatcttaactaaaccatatctataactaatataaatatttggatttttccggttgtcacaagtcggacgaagggcgccttcgtccctcgcggtgcgccttcgcccgcagcccccgaatcccaatccctctcagaatcggatacaagggaaacaattctcaaaatcagcacaaccaaatgcggggattttttgtccgccccccaagaaaagtcccagtcgaaattcatcaagaacacgcatgaaacattccatcaataacacacataacaaaactttcaaccaagaacatatgaatctccaccgacaccattcacagagagagagagaaagagacgacgccgccacctctcccgcccccgtcggaccgcagccgcctccatgccgccggatctggcggaggcgaggtccggcccgccgcccctcccacccccgccgggctgcagccgcctccacaccgccggatctggcggaggcaaggcccgaccggcgttccatgacgtccgccaccaccaccaccgccgcacctccccaccatgcacagagagagagagagaaagaaacgacgccgccgcctctcctgccttcgccggaccacagccgcttccatgccgccagatctggcggaggcgaggtccggcccgccgcccctcccacccccgccgggccgcagccgcctccacgccgccgttgttcggggagagggcgccgccccgtcggttgtgggggagggcgccgccgccgccactcgcgggaagaggggcgccgtcgccgccgctcgggggcgcggaggggagggcggcgatgtgagatgggagggagggaaatgggctagggttttggcggctaaggagagggaggggttttgtttccccgatatcgacgctcggccgtccgatcaaaaccctaaagatcggacgatcggtgtcgtccaggctaaaatcagcccaagagggatcgagagtgaggccatttttccggcccaagcccaggttgtggcctggggaggggagtgcacttgcgcgtgcacaaaaggccgtggaccgaccggcaagggccggaaataagtctattttaggtccctcgggccgaaaaaaatagaataagttcatttttagtgcttattttttcagaagcattacaattataagttattgaatgtgtttatttcaaagcaaacctaaaaggaagtattttctttctttttccaagtaaataattgttaaatgacgtttgtattaataaaattaacaattaagctctgaaaaattcaaatataatttcaaagagcgtaactaatcatggagaatttaaaaaaaaattaaatttaaccatgtcattttatttctcacacttgctttacttgtaaatttatttaattatacacatacctacttaaaaataccaaatatttcagcgaatttgtattttaattaattgcatatttttctaatctgtacgcttcacattgtaacacacaggcacttttgctagaccaaacaacacttttggtcaatatacacactccgtaatcacccggtacaacgcacgggcacttttgctagtcataataaaataaatgataattacataaatttttttttaaataaaacgaatagtcaaatgttggacaaaaagtcaacggcgtcatacatcaaaatgtggaggtagaatgtatacactctctacgtacacgaaacttccaacacgtagtcgccttaactctagttaccctccatccgtacgcaatatccgaagggacgtgatgcaccggcgcgcccggcccggccgccggcgtaacagacttccgacccgagaccgacacgatcgatccaccgaccaacgtggcgacccctcattggtagccacgcccacgacccgcaactatagtacgtacaacctctctacacggcacgtcgacgtgtcgtgtcgcgggccgacccgcaccgcaggggaggggccgccccgcccgactcgatcgatcggtccgtcggggatcccgtcccgcgcctgcatcgccacgtggcatcccgccgccacgggctgctcgccacgtgtgaaccggccccgagcccgtcgcagcgcgacgcgtgtactctgctcctccccacccaccgtgagagctagtgctcgggtataaatagcccaactcgtggatgtcacctctcctcctctcatcgcctcgctcgtctcgtttcgttttttcccaagtacaaaagcagcgcgcgcgcgcggaggcgtacctatatacgtatttgcctcgagcatctacgcgcgtatatacggtggaatatacgcgactcgacagaaggggatacgtatacatatacgacgtcgtctatggcgccggagatggtagcggatgagaaggcgaaggtggaagcgacggggaggatggcgtcgatagagatggagcccaagactctcaccctcgaccagctcaagttcgcaagggtatgtatatatatacatgtatatatacgacgtatatctaccgctagctacatgataccattggatttcgaatgttcttctctctctctttcttttccttttcttttcttttcattccgaattcacacaccgagcgcgcctcatcccataacctggccggcccttgcaatttcaaagcgaatttgcacttccgatcgatgaattaggccttacaaacaccgaattgataaatcatcccttaattaatttgcactgttggagtaacacaattttgctccgcttggaccttcaccaaacttcagattaattcgttgcacacagggtttttgtttttcaatctttcatgtttgtttcatgcatataggagtataacagatacattagccatttaatttcaaacttaccttctgagaagcatatagacatatatatatatatatatacttcgtcaaatgtgaagtgcaacaaaataaattaatttgagatactacacatccatcatttatttgcactattgattggttacgaagaaagcaactaaatcatttttgacacgaatcaatagtgtcaaaaccagctatatattcagagtatatattaagataaattcgttacacttgtggctaaatatcgttggtgggtctctcaccgtcaccggcactgttcctgaacctgttcaattaggccacgcctactaacctgtacttccacttatctactcttttctgttgtggccggtgatgaccttccaaactcaaattaattaaccttaatttctaccgtccacaaaatgcatgcatatataccctggaatcgactaacaccttttttaaaaaatatagctatatatatatatatatatatatatatatatatatatatatatatatatatatcatgcattatttttttaaaaaaagttctggttataaataaactactacttttgcacacaacaattatcggtacatggcattattcaatattcatgtgcatatactcggttatatttagctggagtacgtgctaatgttacatgacgtcgacacggtgcacgcaaggaaaaaaaaagggagggggcaatggcagcggtggtaataatgaggcaacaacgtagccgcttacgtaacggtgcagcgacgccactgttgtgctgtcccatgatgtaacgcgggtcaccgtcacgcaacggaatacactgaagacgtgtactgcctcatgttacccgtctcgcacaacggatgttgtgatagcgacctgcatcttaagccatcttaattacacacttggtagtaatctttcatcttatacagtatattttataaaaaaaataaaaaaaaatcagtcagtgtataagaaatatttatattgtatcatctaataataataaaaatattattcatacaaaacttttaaataaaataaagagtcaaatgttatataaaaaactaaaaattggagtctttcgtgagacgaagggagcatgttcttctacgactatagctagacagctagtagcacctccttgcgtacgtgtacattgcatgtatatgtcaatatgtgtacgtgtacgccaacatatatacatacatctcagtatttattatcccttcccacgtatgtttacctggcttgtacggagcacgtacaacatcagcatgcttacatcacatattcaatttatgtaaagagtagttttgttataccagtaattcataaggg

SEQ ID NO: 6972 - DNA, 11349 bp, Oryza sativa
gggtccaaggactacgttaacccaaataattaatttggaggacttgtttggacgttttgaaacctcaaggactaaactaagcccgaagcgaaacttcagggaccatattagctattctcccattcattaactagtgtagtatagtaaaatactatttcctccgtttcacaatgtaagtcattctagtatttctcatatttatattaatgttaataaatttagatagatatatatatgtttagattcattaacatcaatatgaatatgagaaatgctagaataacttacattgtgaaacggagaggatattaatcctcaattatattcagaaaattaattaatcagaattttttacaggaggcggcgctgtacgtgctgagcacgaagccggcggaggaggccatccggatcttcaccgagggcctcaagccggtgcacctcgccgccggctgcggcggcggcggcaggaagagctccacgatggcggcggactcgtcgtcggacgacgacctcgacatcggatgcttccacgatgactacgccggcaagtcgtactgccgccaccatggcggcggccgtcgccgccgtcgccgttcatcttcggccgtcgagaaagacgtcgccacggcgcccttctagttctagctgcttctagaagaaccctttttaccttttttttttttttttttgctttgtttgataagctggccttgtatgtgtttttataccgaacgggccggccggttttgtgttgagctaaaagcggcaaattttggcgtgtagtagtttgaaggccatagagaggcctcggctagaagaagaggcgtgacggtagtgaactgtcgttgcatgtaaatatcagtagctagctagcacgtacgtattgcactgtacattatgaacgcaaagtttttgtttcctttttgctttccctttcgagagaaagatgaatgtttacaattacacatttacgaaagttgactagatattttccaaggaagtgaagtgacgactactgtactgtgaattattccatctctccttttgtctccttccatgacgagtccagtagtagaatgctggtctgacaaccaactgatagttgaatttgagtgtcaagttgtcacaagaacacgaacaatctcgcaagtgtgcgcacggaatgagaaagcctactaatctaactcgggccttaggtttagcatgaaggctctctttcctgtctgtagctttgatagaccgtttccacaaatctaggtaacggcccaatcgaggtctatttcattttgaataagttcacattcggtccacctttactgtctccaagtttgaaataagtctgtaaccaaaatgatataactaagtccctcaatttacaaaaccgagtcatctgagaatatcctagacagtattaaacctgattttagctgttgtggcaagcttagtcatcgtgacactactgggaaagggacattagctagaaactgaaaaaacttcttttagcctacataaattagaattttgaacgggtgtatgtttcattgatataaattagaattttcatattctattcatacttctatggtcttaatgttatgtgagtggtccggagtatgattgggctagaccaagaacggataatacccaacaggcactgttcattgtcttccttagctcaaggcgaaacaaagaggagggaagatgggcgccggtgctccggcgaccaaatgacggtgaggaatgtagtaggacatgtcccacgatatgactcatccatagatgctgaaggttggcaatgaagaaaaccagaacaagagggacactgggggcaacgaggtggtcccgatagagagagaaatgacaaagacaagctctagtagtgacacgaccggatgagtgcatcaaaacatgttcccggacgagaggattatgttttccttgtacacacggggaaacctgactaatactatttattgtcttccctagttaacataagaaatagaagaggaaggaagatgggtgacggtgctccagtaaccaaacggtagtgagtaaggtagccggacatgtcccacaatgtgactcatccatagatggtagcagttggcaatgaagaaaaccagaacaatgggaacgcagcaagcaacaacatagtcccaatagagagaaatggcaatggtgagctcctgtggtgaacacgacagagtgagtaagtcaaaacgtgttcccgaacgaggaggttatgtttttcttgaatgcgcaagagggagggaacacatgggagagaaggggcgccagtgagatgagatgccaagggagagggggagcgtgtgcagcgagggagagatggaggggggtgctaggagggaaggacggaggtgggagaggaggggcgccagggaaaagaggggctgcgggggagggggagagataggggcgccgagaaggagggagggaggcagaagcggaggctcgggagggacactactacagacttcttatctgtaacggcctttcctatgccaggggcttgcagaccgtcacaacattgtcatctctaacgggtcaaaataaatactgacaaagatatactcgtacaaacattatccatatgcatgtatttcgagctcaccgatgacacctataggtgacgggcttatgtttaggcccgacaaagattatctttgtaatctttgtcacccccctatattgcgctcatcatcgatgacaaccatctgtgacaggctcaatattaggtccgattgagataactaaaagcccatcaccggtgtccgttcgttgggcgttactgatatctattgcacactataaatactccagccgtctaaggaatggttatctcactgttcactattttggtgggaggtgttggaggtgaatttttgtctttttttcaaagaaaacagaaaattcaaaaaagtaatcaaaaaatagtaaacaattcccataaatttagtaatacttatcttacaaaaattattatctaatacttattcacttttgcaacaatggatcgaagttggatgtatggaactgtgcgacgacatagcaaagagtatagaagtggcatttcaaattttataaatgccgcagaggaggacatgaaaagaagaaactgcgattacacgtgttgtccatgtacatattgtagaaatgagattatgcttgatagtggattcgacgtacacactcatctgatacgtcgatgattcatggatgactacacatgttgggtgaagaatggatcggagagcaagaatcagtcgatgatgttgcagctgcagacagaagtggtgcacaaaattagaagatgaagatgagcatgacatgtttgtaccttctccattgggtggtgaaatggttggtgcggatcacgatttgcagtaagacatgttgcgttatgttgaggactgtcacaccctgattttcgtttcaggatttataaattatttaataaattattatcggaatttatattaaatgttcattaatttacaagtgaagttaaatgtgggaaataaaatttcctaaatataaagcatggatggatttaattattattaaattccccatggttaattatactctctggaatattctcggatttttcggagctcaattcctaatttttaatcatacaaagagcatttcagtaattacccacatattaaattaatcattaaatggtctaattataattttgttaagtactttgagtgtccaagtattttcaagatttttcttggaattatttgagcataggaagtatttttaacaattcaaagatcatttcattgattaatttaattggaaaagtaattaaagttcaccttttccttttcgggccgaattaggaaaagtcctctcactctcggcccagtctcctctcagcctgcagccctttttctctctttcccgaagtctgctttgtgtccctcctttaatcagtccttggaagtagaagcccagccgaaagtctagtttgcctccctggcactgttcatcttcaagcttggacagagccgagccgcccgtgctgtgccctgtgcagccaccgcttcctccgttaaattcgccacatccggagctccgtttgcaaaattagttgaggggaaatattcctcttatcctcctctatcctctcccccaagaatcggagcaaaccgttgagtatcttatccgaatcgagctcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccgccccgccgtcgtcgccggccgagctccatccgcgtcgtgccgccgcctccgtcgtcgccgccggtcgccgtcaccgccgtaaggtgcgcgggagggtggagaagcccggtcgcctgacccccaaagccgctgatcaccggagccccgtcgccgccgtcgaccgaagccgcgccgccgctagacctcgtcgccggccgtcgtcgttcgtcgtttggttcgagggtgagtaccgttgggttcgtctcgtcgtcctctacgtgtacatgtcctccaaagtcacagccgaccatccaatctccggcgaggtcgccatcttggtccggccattgatgaggtcatcatgacgtcatcatcgtttttctttttcctgtttttctaatagattaaatcttcggaattcataattaaatcatcgtaactcggttttgagtggttcaagttgctaaattcatctaaaatcatgatctacatgttggtttactttttatgtattgtttatttggtttttattagtctttttcttcgttttgcgtgttagcttgtcgttttcgtcgttgcgaaggttcgtgagtgcgtcgggagtgttcagaagattaattgaagaccgattattgcaaggcaagtcacacagatcccaaacaaccctttgagcatgttgaacctgtttaaagctattgatttatttcaacttatgcattgttttcgaatgtcattgggtggtgagcctttcccatttaattatggccgaagatgactttattttcctatgggttataatttgactagcatggaccttatatattggattggttcagctagatgttatttatagttgcttagccgtgcttagaaacattagcacactattgggataacttatgacttactattatttaatgatggcttaataatagttcacgatggtcaatcgtgattggttaattaattactcgccaactaaaacttgataatggtgggttgtgagcacatggttttgagagtcgtgctcatgacaattaaggaccggttcgcgagctactgttgtgaaacatttatcgtgccaaccacaagccagcatgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgctaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgagttgagcaatgtttttcgtgattagtctcacacctctcacaatatttatagatggtatacctggtaataatttgcttagctcctggtttggagattagatctgtacagccgggtatggttgttcaggatggttgggcctgtgcagcatgggtgtgctgttcagtgttgattaaaatttctgattaattactccactgttttacttctcttaaatctttgctaaatgctgcttttgcaaatgagcctatattatgccatcctttggtatccttgtgcacttgcatacttgctgtgttgtgcacttgcatacttgctgtgtggcttgctgagtatgtcatatgctcaccttgcaataatcattaaacctcagttgaagataaaggatccagaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctggacgaggattttatgcacaaataagttcggaaattactagtgaattttcgggcgtgacaaggacctagcttacaatgagagagattctataaagttcaccaggttggtcagtgactcggagacacctctatacaccggatgaaagtccaaacacaccaaattgtcagctaccgtggatctactgaaactgaaaataagtagtggatggacatacaagagtttcacagattttttaagaatattgaaagccatgcttcctaaggagaacacattgtccgagacgacatatgaagcacaacaggttttatgtcagctggggttagaggtctgtagaatccacacttgtccaaacgatagcataatgtaccacaagcaataggcggacttagatgcttgtcttgtccgcaaggtttcaggacacaagcaaattgtcagttttttctttaacaggaggcggcgctgtacttgctgagcacgaagctgacgaaggaggcctttcttcacagagggcctcaagccggtgcacctcgccgccggcacggcagcgtcaggaagagcttcacggtggctgcggactcgtcaacaacgacgatctcgacatcggctgcttcgacgatgactccggcaaggctggcctactgccgccaccatggcggcggccgtcgctgccatccactactagaaaaagcatttttcccgacgcgggggtctttttttcgcaggcggacatgatccttgaagccaaatgaccgtctataaaaatataaatcggggtgaagttcattgtattttcacaggcggaccacttaagcgacgcctgcggtgctttgatccgcgtgcaaaaattagagatttttagtgttgtttgggtacaggcggaagattttgccgcctgtgaaaatgtgttttgaccgcctgcgaaatccttctctctagtagcggttgccgttcatcttcggccgtcgagaaagacgtcgccacggcgcccttctagctgcttctagctagctaggagctagaacatcttttagcttttccttttctctttttagctttcgttttttttttgtttgataagctgttcttgtatgtttttataccgaactgagcggcaaattttggttgtagtagatgcaaggcctttagagaggccgcggctagaagagacgtgacggtcgaggagtgtacatgtgctaaattagggctgtcaacgagccgagctcgtctgcctagactcgagctcgagccgagcttgagccgagcctataaaatgttcaagctttctgataggctcggctcgagctcgactgccgagcttgatttttaagtaaaacaacatatatttgaaatataatctttaaaaatatataattaatttttagttcatcatattaatataagaggaaaaaaggaataaaataaatatatgatgccaatataagccatataaataatatatttgatctcataatttattaaataacaacaaaaatcatatattactaagctcgttggaagctcgagctcggctcgacaaagctcacgagcttagagagaggctcgggctcggctcgtcaggagctcgagctgagctcgaatcgagcctaggacgagccgagctcgagcagctcgcgagccttgagctttttttgacagccctaatgtgaatatcagcagcgagcgagctagaagtctagaactgtacattaacgcatatagtttttcatttgctgtcccctttggagagattgaataatgtttaaaacttgctacgacgattaattagccagatatttttcaagtgacttaattacctatgatttttcttacattttagtccttttaaaaaatattttctaaatagatccctaaaaatgtactccaaatatacgctcttcttggcaccacttaccctggctctgaggtccagcatgtcggcacgaatgacgctggtgatgagatgttgaacctcggcacaaataaccttggcgtcgagaaaatgatccaatttcaaaataagtctttttttagaaatctatttataaaataaatttttaaaaagagctaaaatgtagaaactataacttaaggcctggttgttacagctccaacttctaaatttaactccaggagtgggtttgaataaagtggtgaactgcttacccaggctccacactctagtcattttgtgagacagctccaccatctccactcccagttttggtggagctgaaactgtttggctgagctcaagctccaggaggggtggagctagagctgaagctgtgccaaacaggcccttggttgcccgtctgaatgattccattcctctcctctaccctccttcaggagtcgtgtacaagtgttgtacccgcgcttgaccgtgttatcaaaagaacaagataatcaattggtcaaattgaagtggaaaaattatacttcgactcccttaactatggtccatgtatgattcataacatttaaccacaaaaccggtatatcgactcttccactattaaaaccgatgcaaactatatccctgggtggttttgcaaacggttttggctgatgtagcgtctacatggtggtattgactcggtcttctttccacgtatcattgatgtgtcgcttatgtgacattttaaaggtaaaaagacaaaaaaaaaggggaccgacatatcatccacacgtaaaataaaagtgggacccacgtgtcatcctcttcctcctttatccttcctctcccctcctccctctcctttttcccccttcctcttcctcttttttcggcctcctcgttccccgtgctcttctttctcggcccaagcgcgtcgccgcccacctgctgcgccgcacctcttcctgcctgaccaccaagctccggagctgcacgcctcatcgtttaatcgcgctgccgccgaaaaccacttcggtcccgacgccgccgcgcagggggttcgacttcctgctgtcatcgtctccgagaccctgccggtgaggtctgccgctgcccttgagaccacgggcctccagccgacatccaagggagcttcttcctcgatgcaggagccgaccgccccagccgccggtgtctgccgcctcctcctgaagccaacgccgccgagcttctcactcgccaccgcctcagccatcaccatggccgttgaggtcaacaccaccggcgtcatctctctctctctcttgtcctcaagccgtcgtggggcaacttcgccgtgcgcaaacagttcggcaccgacgacgtgggaccgacatcggagcgccatcccgacactgaacgcagcgacgagcactgccaagacgcaagaggaggatggaggaagaggaagaagaaggggccgtggaagaggaaggagagagaagaggggagaggaaggaggaggaagaagggaatgaggaagaggatgacatgtggggtccactattttttctgtgtgaatgacatgtcggtcccacgtatttttggattttgttttcactctaaaatgccacataagcgacacattgatgacacgtgggacaaagactggatcaacattgccacgtaggcgccacggcaaccaaaaccgcttccaaaaccactcaaggatatattttgtaccggttttgatagttggaggagtcaatatacccggttttgtggttggaggttatgaatcatactcgggctatagttgagggagtcgaagtatactttttcgaattgaagttctctgttctcacacaggacacgaacaagctggcgaaacagagccacctaaatcgatggcccagcaaaacgagcccaccaatccaacatggacaacaatatttcagtagaataagttcacagtagaataagttcactttttgaccctcaaaagttatagaaatctaatctgtgaccctaaacaacaaaaccggatatcttgacccccaaactcttaaaaccggtccaatttaactccctcggcggtttcggagggcggtttcgctaacgtggcgtctacatggcgatattgaccgagtcattgttccacgtagcgttgacgtggcacttacgtggcagtagaattaaaaaatataagtgggacccattagtcattcacacaaaaagaaatgtgggcccagtcctccttccttcttcctcctccctctctcccttctctctctttctctccccttcttccccttcggccggcgggcgggagggcagcgagagcaagcggcggcgggcggcgaggccggagctgcggcggcaggcgaggtcaggcggtggttggccatctccggcgccgtcaacagcggcgaaggcgaggcgaggcgacgcggatcgaacaccagcgcagctccagcgctttcttcttcctccggcacgcccagcgctacttcggttcgtacgacggcgccgaggagcacaagctcaatagcacctcctcgtcaacctcaacaactttgagtacctcgacctccccaacgcgatcctccaacacaactggtacgagccggacaagctggatctcaagaaagtcgccatcgtcaccgccacactctcgcggccgccaactgaacgaggatgcgtcgtcgccggcatcatcgaacctttcctctccgcccaccgagtcgcattctggcgcatgggggatcaggtgatctcgccacaaccggcgtggccgtggctgctggaagaagtggaggacatcctgcactacaccttcaaccgcaacggactagagtatgaagctttccttgtcctcaccacggaggaagacgtccgtgtgtgcgacccactaacatgcgggtgtcgcggcggcgggcggcggaggcacgggtgtggcgcggcggcctgcgagtggcgtggcggagacgcgggagtggcggcggcgcccgggctaagctccaccgccgcgaagacgaaggagaccacaccacctcccgatgacatgaaatcggtggcggcggccgcacggactcccgacaccaaaatactaggggggtagcacgcgtacccgtgccgtg

SEQ ID NO: 6973 - DNA, 16909 bp, Oryza sativa
cacacctccaccgctcgccgatgtctccaccgctcgccgctgcgggagagagagagggaccggcgaggaaggagaaggaactagagggaggggagagagaagggatacgtgggtcccacaatttctcttctgtgtccatgataaataggtcccacacatactttttaattctaaataccacctaaacgccacgtcaacaccacgtgtagaggagacccggtcaataccgccacgtagacgccacgtcagcaaaaccgccttttaaaaccgccaagggagtcaaattgcaccggttttaagagtttaggggtcaagatatccggttttgtggtttagggtcacggattatattttgatcacttttgagggtcacaaagtgaacttattcctatttcagtgatcttccctggctgtagcttcgatggacttgtactgcactggctgtgttcgattgttgggttgggaaccatccctctgcatgaaaaacggagcggtccattagcgcgtgattaattaagtattagctaattatttttttaaaaatgaattaatttgatttttaagtaacttttgtatagaaatattttgcaaaaaatgcatcgtttagcagtttgaaaagtgtgcgtgcggcaaacgaggaagaggaggttgggaacctgatgtcaagaattcagacctactccctccgtcaaaaaaaaaaacaaacatagaactagtattaggatgtatcacatctagcacttgattggtttttttatggaactaaaaaaactttaatctagaatgaaatgtgactccttctagtacaatgaatctggacaaatagctgtctacggagtagatgctatcttgctgagttgttagctccgctgtctctttttgtgcctggaggtttcagtttagaagttggcccaatctggagtctttttgtgctttcgtgtaagctagcaaattaacccagcgtttctgtgttttttttttctttttggctgtttttacatgttattggctttattaacaaactgggtcgatcagtggatcaatctctgattaaataaaaaagtgcagatgtgctgcgagagttcttttttaatattctttttcaaccaattgacttgttccatgagcagcagccagtgcacagctaatacaaataatggttgcagttttcaatctaggcctgaaggtgccagggtgtgcaatgcataatgcagtctgaaacttcgtatagtatcttcatgctcgtttgtgctatgcaagattcaaaacagactttttttaaaaaaaaatgaggcatatgattttcaattactagaaaaagatgagaagacagtcgttaaatgttcacttgatgctaaaacattaaatgttcagaccacaaacaatcgaagctaagtactcgcacaagcacgggcacatccacgatacaaggaccaaggaagtagctctacaaactgacattaaaaaaaaaaaacagctctaagtagtagtattacaaaactgacataaagtgttacataaccattcaaacaggcacaatactacaacaacgattacaacaaattactagctgtgcagcgtgagcgcgatccacgatggtggtctatggtttctcacaatgtaagatctgttcctcctcacacagctgactaccatccagaatactagaccactagttgttgggacgatgtaacctactacttcagtatttacaatgtttagaaatacacgtacagcccaccaacaccgtggtaatacgcagatgtgatgtgattggtgtcctaaaccaaagaagagaataaaaaatggtacagtctagttatttgagtcgaacaacatgtcctggaaggtaaggctgctaaggcaacttaacatactcgatcaagagtgcaatgctgagcacaatattacaagagaatatcttgcttgtctggcaatcgagaaaagaaattccaaatgttcgatggtgtattcttcttctgaaagcaccaagctttatatagatgaagtgttactgctatgtattatatgagagtaccttgcttgtctggcaatcgacgaaagaaattctcaacgatcgatggtgtattattcttcttccgaaaccttgggtgcctcattatgtaaaatcctgcgattcccacaagaaccttctttggtacaaaatacacaacaatcgataccatgacaatgatgaactgaaagattgcagttgctctaggatccctccaacataacaatgattggatcctctccccctgagttgctacatcacccacaactgtttgaaccctgccggcaacgctcctcagtctatcgtacctcattcttaccaggtcaatactacaacttgattcgacactatcaaactcctcatcaatctcatctggatgtacactgcctaaacaagatactttatgatcaaaaaaaggaggcttccttggtctgaaccggtaattccacaaagctactaagacaaaataaatgatcaccatcgagagtactagcttatggaagcacagagccaggacaaagatgacacaagaaatcaaggcaacggcaggattcttccatgaggtcacgctctgaaacaaatgaatgaatggggaagcaacctgcatgagtcgaaaaaagttcactttgcttttcctcatactccagcagctggtgcctccggtggcgttgcacatgtatgcaacaatctcactccttaggggcggctccacccggctgaatcgaagggccatcacctcagctacctctgaacgaaacttatcttcttccattactgtcagggggtgttcatagtgcatcttgggcagagtggaccgtgcgtacatgcctaataggctgataaaagattctgatgacaacttcacagctatctgcagctcaccggctttcttgaacccacggcgattcagaatgataagagggtaggagtgtgcatatactcgatcagtctcaaggcaagataaatgaatctgtaccttgccaatctctcgatgggctttacgcgtgtgtgggaaatggtcaaaaacacccgcagtcagtacggtcgcaatgtcatagacgctccacgtatgctgttcattgaatacatgttcagggccatcgaggattgtgcgggtccgtacccacttatcaccatactttgcaacacaatacggattcactgttgatttgcccattctaagtgggaggccggtagcgcgcaatatcccaagatgaaccctaccaactgggggtctccagagtttcctgtcagcgggtctagtgtcatccatatagcctttagaatcatgcacgatacgatatctaccatccagcatgttctttaggcaaattcgcatgcggctactgttgtcattgccatcatccacagaactgtcgaactgtggcttatcagggtttttaagatcaaaccacttgctgggcatgacatcaaagtggtcgtgttcatcgcctccttttactatagaagacaatggtacagtctgttggccgatgacaacctcatctttaccgggatttgcaacaatcacatgtagctcaaggtcatcctcaaagaatggctctgcagcaacaaataaaaggtcctctttccattcatagctaccactggttgtcctttgctttccaacttccaagtgccctagtcctctgaacctgtttccctaaccttgccctgcaaaacacccctgtgtctgtgcctgtgttgcagccggccatgtcctcctgttcatcgtctcctactgtaacaccctggacctcaactactgtgacccgcaagcaccataggtttgggttctcatacactttgggtatataccctgataaacctacatgacgatatgcttcatcagcctgtgaccctatccaaatcgcgagcagcaagctggcctgtgctaattttgtcccgtcctggtcgaggagtgggtaccatgttggttccagtgggacatcatccagagacctttttggaatgttcttgagatccaagtgtagcttccctacaaagtcatctctgaccagatccttatcgttgactacgatatccacagtggggctgggaatcttgtcatgctggaaggagaaagcaaaagtctcgttccactctgggttcttgttcctcttaaagcatctggtgacacccctgttgtaagcaccaaatttgacctcgacatagggatcaaggctgccattggcatccatgtccggcagcttgcgagcctttattacacgcacaaagagaagctgcattcgctcaaacaacctgccaggctcgaaatttgggttgatctccatcagatcaaaaccggcagtctccaggacaaccggatcatcatgttgatctttgccataaccataatttgtttgaaacaagtagttgtaaatgccatttaacccattgccctcagtttgatgagtatgacgatcctcagtttcaagcagaatcctatcaacagcatcagtaaggaacaacttaagtagcacttttgcattgacgccctctgtattatccaatgtatattgcatcggatctacgttagctgaatggcggtgaaaatatttttcaggtagcaagaccttgccaagcaatgacttggagttgctcatctgatcgaagcagtagacagcagcttcaagaatgaggttaccagaaggatcctctcgctgtctcatatcaaaagagaacctctcattccatacagcaacattttccttgatggtcgtactcttactttgactgttgaaatgaagctccacggaatagttggtctgggaggtattgctgcttgagggtatatcagcgcttataacctccacaaccagataggtagtcgccatagaccctgtagtgtgtcgacacaatcagcctgcatacgtgagaacatttacaaattctttcttgcaatcatttatgaaaccagctcaaatgagttactgtttgcattaattgcaaaagatagcagcatatacaataatcatctagtaagaattatctggatcaagagcaagttaaaccatctcgcttgatattgtagtagtattgaatttttggggacatctatttcaatgacaaactattcgtattagatcaacactcgagaactcatcgcgtttcaatctttttcctaggagtgaaaaaaaattcttgtttttacgagtagggatcacttagtatttgtaaaaaaaaaaaacaacaacaaatccccaggtccgagataccggaagttcagaaaaacttgaccgaagtttcaaattccaatatgaatctgaccaaaactatgttgaaaaaacagtagagttgagtaaagaacccgttccaccagtttggtttggcccgtcgcttcggccgcccttcttccatccccgctgtagtccgtcgagccagggcggtcttgccggcgggcggcggcggcggtgcccgactaaggcaccgagcaaccggcgctacgccagatcttgggctgatccgtcgagttcctggcctcatgcgagtgaagccgcctttgggcgcagattcacagcaccgaggtaccggagctccctgatttgccgccatacagcgccgaccggagccgactcgcgcactccgatgagaggtttttgttaaggggaatggtcaatcagagaacgctgtgttttcaattgattttgtgttggtcgaggggagatcagcaatcgactctggcctaggagttctatcgccatggacgacgagaaaaagaggttcgtgccttttccttttcttttcttttctttttttcaagaaccaatgtgatggctccgcagagattgcgcacttagcaatattatattttttcttctcgtactagaaaaaaaaaatgtccgcattgcaatggaagccaatttaatttgtagatatgcgtaggtgaataaataattataatccaccgcttcgtttattatgtgcttattcgaattacagactttttgtgtgcaaatattttatatacatgttcttagcgactcaaaagcaaatgttgtaaaataaagtacaataaaaaaaaccaaaatgtcaaattcaagttataattttaaatttgcttatagcaataagcctaagccaagcaatgagacattcaaacacgagctcgatttatcgtttagctttatctcaagtcgggcaggaattgaaaacggacaaaatcaacaacttcgattatcctttattttggttggcatgctctttttgaaagtaaaaaatgattcttatgaattattgtaatgatatccctagtagtgcgtatgtgttgacgggtggtaccgtgactacggtattttacatggtatggggatcgttggtactagggtatatgcaagattgaggtaaaaaagatagagacaaggatttttatataggttcgggcaccttatctgacgggtaatagccttacttctgttgggcgaagccggtgttgctcttattcatcataatcacatcagtacaatatttggaataacctatcgagctgtcatcgacttggcggcatagataatcaactcgtagacgacggtagggtagtcttcctcctcgaatataaactcgtcgagatcagagatgacactagatcccttccttgtcacctagaagggaacaacgttgatattctatacaatccaactgtcggggttaatctcatctctgagtcatttgcattcgcttacctgggcgataaagctataactccaacaaacaaattcttcaagcactcgaatgaaaatatcattgaaggatttgggattgtgcaagacgtacctctctgctttgaagacagggaggcagtcttggattttcatgtttttgaaatcaaagattttgacatcctaatcggacttccaattgagcagcttctcataaatacgccccgattggacagcctcaagataactttttgagggaacgaattctcagtttcattcttgcgggcaatgttcaccttgaccgactctctcccatagaatgagtatgcggaggaggttacggcagttccccctaacaagtctcccaagacccttctggaaaatgaagtcctcgacttcatcaaagaggaagcggagctcggtgcgactctcgaactcccaatcatggaactgccacctcgaactccgcttgagcttaaacctctacctgaaggcctacactatgctttcttgcacaatgacaaagaagcccatgtcatcataagtgacaagctttatgaagatgagactcaacgtcttctttctgtgttagagaagcattgcgctgttcttggctattccctccaggatctcagagggattaaccccatactttgcactcatcgtatccctattgagcacgagagtactccctccagggaacctcaacgacggcttaataatgtgttgagagaagttgtaaagaaagatgtcctaaaactcctgcatgccgggattatttattctgttccatacagtgagtgggttagcccagtccaagttatgccgaaaaagagaggactgacggacgttgctaatgctcaaaatgaacttatcccgcaacgaaccgtaaccggatggaggatgtgcatagactacaggaagcttcacaaggcaacaaaaaaggatcattttcccctaccctccattgacgaaatgttggaacggctggcaaatcgttcctttttctgtttccttgttgggtattccgggtgtcatcaaattcccattcacccggaggaccaaatgtaacaccctgaaaattcgaccaacaaaatcaaaactctaagaatacggattttcaaaatctttttaaataaattgcatcatgccgattttattcgcatatttcattggattttgatttcggagttcgttgatcgcgaataaagaataattaattaggaataaaacctaaaattaaactggcaaaataaataattaaaatataatttaaaataaagattaggtgaggttggtaataaataaaaatattatcgcgaccatattagtatcaattaaatttaagtgcgatggaataagaattaactttaattaaattcaagtaaattatataaaaataaaatatgggtaatgttaatctagggcgaatcttttggttagagcaacacaaatattgagtaaacttgatttgtgcaaaagttagaatttatagggcgagatttaaatagaaaatagattaaattagggttaataaggatctagcactattcattgcctacaaggtgcttgatgtggtcctagcctagctagcctcaagccccgcgccgccgacgccgtgtcgtcgccgtcaccgcacgctgtcccattgatggctgccatcgcgcgccgtcgccatcgccgttgccgcgccgcgcgccatcccgttgcgccgtcgcgtcgccatgccgccgtcccgtcgcctcacgccgcgcgctcgccgcctcgcgccccgcgccgttgccgcgccgcgtcgccgtcgcgtcgcctgtcgccgtacgccgagccccgcgccgcgccgcccacccgtcgcgtcaccgctaccgcctgccgcgccgcgcgcccatcgccgtagccgcctcgagccccacgcgccgcgccgtcgcgtcgccattagggccggccacctctcctcgcgccctataaatcccctccccggtcaccatttcaccccacaccaccccacctcctcttcctccattttcccctctttcctctccaccgcgccgccgccttcatgccgccgcgccgccaccctcggtgctgccgcgccgcgccgagtgccgcgccgtgcgtcgcctgccttgcgccgccgtcgctaccgccgccgtcggtaagccgccgcccctccccttgttcggtcgccgccgccgccccgggtaggcagtgagccgagagagagagaggaagggagaagccgggagggagagaaaaagaaagaaagaagagagatgaaaagaaagaaagaaaagaaaaaaaagaatagaaaagaagaaaagtaaaaataaatagaaaattagggagagattaaggaggtttagaaaattaaaataattggggttagttgtaggtttcttttagttgtagaattgcaaaattttatataattatagaatattttggtaatctctataagtaatcaattcgcggtagaaatttagatttatttaagagctaaataattatgttgaattcttaggaatgtacttctaaatcacaaaaagacttaggatgaatgaacttaaaattggaatgaagtggttttgcaaactttgtagtcgatatagaaagatcgattcgcattcgacttttatttgagtttatttggatttcatttgaattctaattgagttcaaataaattcttcgcacgtacttttagaccctgagggagttgcggatccgagcgaggatcaagacccgcagaactacgagcaaggcaagtcatcactattctttgaacatgttgatcccaattgcgaaattattttgtttacaaataaaattgcatgcaatgatgaacatcctacttgtgattatgccatgccttgattattgtttaccccttatgccttcgtaaccatgtttacgtatgagtccctagttaattatgacaactgcttagaaatgctattctagaatcatgcatactcatatttatcaaatgctatatgcttgggcaattacctttgggaaggtaattgagatgcggcatgtggagacatgagcgccacattaccatgatgttgatgatatgatttgtgaaaggagaaataaaattaaacaactgttttcgactggggcggacggaggatttgggtggtgtccggaaaaggctagtgccgtccccggtcaattaaggaccaagccatgaagttaagcatgaaacgacccccgtacaaccgcacttcttgtatgggtatagacctagcggagtagatagctgagcggaggcagtatccatgcatagtggtttcttgatgtatgaggcaggggctctacggtggggcagccattggtaggaccgcgaggcgggtgtctacagtggtgtcgccatcggtaggactgccatgtgaaaatctaaacataattatatcttaatgcatgtgtgagtcttcccttcccgggtgcgccagaactcctctcactgctagaaaccgtgtatgcctagagtgcatgaggatgtatggttcatggagcgggtactgccaatgcgaggtctcatgtgttggggcgaagctcatgtgttgggcagtcgcggagtgcgggtaaagtgtacatccactgcagtgtgagtaaaccaaatctattcgaatagccgtgctcgcggttattgagcaccgggacgtgtattacacttggctagactctaaattcttaacttgtgtgggatgggttattgcatgatgattttatgctgttgcagccacttcctgagaggcgggaaggtggacgtcctcagaaaaccatgacgactcagtggcgggaagctatccttgggatcacaatggatggtggacagaaccgtcgttgtttaatgtgaacactggtactaaaatttgatcagtctatgctaggtcttaggcttgtgaaaagaattacaaaacttgctttgcgcaaaagaaccatagccatcctttgaatacccctatcatgtgcattgttgctgtggtggcttgctgagtacggttggtactcacccttgcaatatacaaacttaatcagaggccggagatgaagctccggaggatccctacgcttactactaggagggtgatggagacgatggcgctcagtaggtcttagttacggtcgttgcctgtggcaatggcgtgccgctgccttaactccgctgccttatctacttctgcttttggaatgtattccggaccgctcggtccgatgatctaagactatgcctgtgggcttatgatataataattcgcactagactctcatgtatgtgcgtttggtatttcagctatgaactcgtgcgtaccagactacttgatccagggaaatggtactgtttacacaggcgagtgaatgccttggaggttgccagtccagggatgacatgtacgataagctgccagcgatggtgccggattcccaagccagggatgtgcacaaggacatcttggtcgaaggcagaaggctctgcgaaatacttggaaagattccagagacggtgaacaagtggaagttgctttccgacctctgggtagagctgctcctgtccgtggcgccgtcggacaacgcggccagtcatgtccagatgctagcaaacggaggcgagctcatcacccacctctgggcaccgttgacgcatgccggagtcatcgagaagaggaccggaactgaaaacagtgctttccctgtctaatgtgtactgctcgtatcgtatcagctcattattcttttttgttagagttgtgcgtcgaaaatgtgtacaaggttggttatagtttagtacttggagttataccgagtgttaaaaatagagtaagagtctgactatgtcctaagaatctcttttaaatagagggatggacctattgtaacggcatggcgatttagtatagcaagagggaatggttgtccacagtgtcaggccatgagtcgttgtaactctgatacgctgttgtcagggttacggataagacatacctcctatcctacgacttatggaatacacggatatggtatgccttcacgtatacggatcattctcatatacgctgttggaatccatcacaaattatggaaaatatatctccacgagccaagtgatttccaaagtcctactcggaagggatagaagtccgagatagagtttttgttatatcgtacaagatccgatgtcttcgagttttacttggggattaaggtgatccacggtataaaagggaccccagggagaggtgcaaggcatcgaatatcatcaccaacacacccaccatagtttacgaagccggagtgcacggaaccaagtcgctaggagatctcatcggacacgtcgactacgatctcgatggtattgttagttccgtctacttctattgtaatctgtggatttcgtcatcaatcccatataaactgggctagggctattacttgacaaggggcctgaaccagtataatctttgtcttctgtttgcttgatgtcgtattacgtagatcctcattccaacgtaccctaatatccaaatcatctggtctacgagcatcactcgtcgacagtggcgtgccaggtagggagacttggtgctcaaagttctccaatatgacttcaagccctcctgacagcagtgcctagaccggcgtcgatccaggagctcctacctcgacatcgctggtgtggactcaagttggatctattgtcttttcggtctacaccgtctcgccaatctcgactagcccaatcaccatcgagaacgagaaaggtacggctacgactccgagaaacgacgccccgccggcaattcctcccacgcaagtagagaacataacattaacggccccaacacctagaaggaatcctcaagcggccgaattatgccctctgcacaagagaccagagccgacaaggatacccacccagaaaccaagatcttggtgtccagtccataagacatcaaagcatactctggaggattgcccggtgatactccatgtgaaggctgaactctatgcctactgggagtgtggaattcaacgtacttcacctacgggtgccacctactgcccgatccacaagtcgagatcacacgatctcacaagctgcaagatcttccttaggaccttcaagccaccgcatcatcgcgaccaacaaccacgagttcaagctcagtgtgttgccaaggagcgagatacagcggcgacttcagaccggttcgtgggctatgttggcaccaaccccaatgaaccatctatgctacacctgctggaagattacggatcctcttcagactcaccacgagatgtgaaagtggtcaataccgccgagacaagttcatccgcggtagcgggaacgcctgctcagcaattgcgaaacctcgacgcgatattgagataaagtcattttgatctggtgacaaacctagacgttgatcaatgggcagcacgattgcgagaaaccatggccaacctcaatagcgcagtcgcaaacgctgcagttgaactcgcaccgtgtgatccgccccgaggagacggtgaatcagttaacgagaacgcggaagtggaaaaccccactggagaacatccttcccgtgaccgatcacctcgggtagcccgagatcctactccaccacgtcgcgagaaccgtgatcttcatgaacgcctggacgaccggcggagggacagatgaaatcggaacgacaatgaccgtcatcggcgccgttctccctctcggtgaggagagaacacccctcattgatgacatcaccaccgcttcccttcacgccgaggaaggaatgatgatcgaggaggccgccctaacaaagaccgagatcggctggtccacagtgaccgtcgggatgacgacaacaacaatcgtcgtgacgctggcgacaacaatcagcgagaccagggggccgatggccgagtttaggacgacgtccgagatcaaaggttagacggcaacaataggcaagatcgcaactcccattctcccgcatctggtggagatcgagggtgcaatcaccgttcaagaagccgagctcctgaaccaagcgacccttcatcctcatcttcgttgtcttgttcctcggacagacctcctcgacgatgtcacaaccacgggccacctttcgtcccaggaggtgggtgccgagcattcacgcccacacttcgagatatacgatggcccgaaaaattccgaccaggagtgatcgagaaatatgatggaagcacagacccagaagaatttctacaagtctactacacaattctctacgctgctggtgcagacgacaacgcactggcaaattacttacctgctgcgctaaagggatctgctcgttcatggttagtccacctcccaccccgctcaatctcttcatgggaagacttgtggcagcagttcgtcgctaacttccatggaacatataagcgccacgcaatcgaggatgacctacacaccctaacacagaacccaggtgaatcattgagggactacatccggcgcttcaataagtgcaggaatacgatccccgaaatcactgacgcttctgtcattcgtgcgttcaagtcaggcatccgagatcgatacaccacgtaggaactggcgacacggcgaatcacgtctgctcgaaagctgttcgaaattatcgatagatgcgctcacgcagacgacgcgctaagatgaaaggagggatagagcaaggtgggtgttgagaagaagtcaaccaacagagacacaccagagtcgagcaagaagagaagtcgcaagagtgggaagtgcaaaccttcgggagaggtcctcgctgctgagcaggtggaaccacctaggtgcccaaacctctagaacgacgactcacgcaaataatggtgctctatacacaagactaacaatcacgccatggaagattgttacgtcttcaaaaaggagctcgcgcaacagctggcaatcgaaaggggaaagcgagtacgtgttgtcgagacggccgaagaagcggccaccctcgactccgactccaaattcccagaatacaacctacatgtctcgcacatcttcggcgattctacatcgtacacctcaaaaagggagtacaaaaagatagaacgcgaagtctgctctatgtcgcagggggctactgccaagatgatatggtcccaacacaagatcaagttctcaaaggcggaccaccccaagattgcaactacacctggtagatatccgatcgtggtcgagcccactattcggaatataaaggtagcacgggttctcatcgacggcgagagttcaattaacctgctcttcgctagtaccttagatgccatgaggataccacgaagtgagctaacgcccacagatcagtccttccatggaatcactccagaatcgtcatcaaagccgttgggtaaaatcacattacccgtcacctttggacaggacaacaacttctgaatagagtagatcatctttgatgtcgcagaatttgacactgcgtacaaagccatcattgggagaaccacactcgtgaagttcatggcagcgtcccattacgcttatcaagtgctcaaaatgcttggaccaaaagggacaatcactattcagggaaacgccaagttaacggcacaatgtgacaagcggagcctcgacatggtcgagcatactcccagcccacccgccacaattgagcatcccaaaaaggtgagcaagcccaacaagacgccgaagctagacggttatcgtcgtagagagggaaagagtacaatacctggtgtactaggtcagcgaggccctccacgatgcaaaaactagatacccacagatccaaaaactgctttatgctgtgatcataacatctagaaagatacgccactacttccaagcccacaaggtcactgtcgtctcttcgtttcctttgggagaagttgtcaaaaacaaagacgttgtgtcacgcccagaaattcccgaatagaattccaagcagaatgtgcattaaaatccccgtccaggaccagccggggtacacaaacgacaaagttgccatacagatccatgtcttacaaacattataaaagtcttacataaatgcagcggaaaaacaaaagataactggagctaagccttgacttgatctgcagcgggaacaccactcacaggcatcctcgacggcacggacgaagcctactcctcagagaaaccaccatctgacgcatactcaaactctggggtttggggaaaatagagcaagactgagtactacccactgtactcagcaagtcattttggaataggggtatgatgcagggaattatcaagggatagctataatggttcgtttgcataaagcgggcatttacaaacagaagttgaaagcagtaaaatagttgtaataattaatcaatattaatcatccactgtccaacgctataccccgttgcaacaggcccaaccatccacctatactattcaattccattagactagtctagggtgagtctaatcacggtgaatctggttgaccgcccataatcgcgggcacggctattcgaatagttttactctgatcagatgtgtacaaatgtacccacaagacacagccccacgacacgtttccgtgtgccgacatgccaccacgacatactggaaagaggccgtgacaggacccttcgcataaccccctctaaccaagcacaccacacctcagatttcacccccactccttgcaaggcagcgggcagtcccttctcgtgcctaggtgaatccggaagccgcataggctgtcgcagggcccatccaaactccatcatgcccacccttgcctggatgcgtcggctagaggaaagctacactataagcccagccgttgcccacgctggcttgtggtaagtacgaggaattcttctagggtttcccgcgaaccggtccttaatggtcctgggcgcgaccatcaaaaccatgcatccacggcccaccatttaatattaattaattaaccaacaccggagtggtgagcattaaccaacatcaatcctagaatctgatatctatgcatttaatgtagttccccattgtgtgctagttgaactaagcaaagctaagcattccctagtccaatctctagtcatgttatatcccaagctaacaaaggaacatggtacaagatagcatggctatgacagtaggtaaacatcccatggtgatattataaaacaatgcagtatttgaagaaaaacaatggagcatt

SEQ ID NO: 6974 - DNA, 18038 bp, Oryza sativa
ggccatggcggtgctcaccggtgaccggcccgaagttgggttccggcggcgggatccaacgaaaaaggggtgaccggggtggcccgcacgacggcgaacgcgacggcgttgtcggcgcggctcggcgtgtcggctactgacgaccggaacggtggcgtcgtcgtcaaaaagaagggcgatggcgctagggcgttagagggctcgggagggctcgacgagatggggaaaaagagagaaggggtggcggtggtgcttaaatagaggagggggagcccggacgtggccggtagaggcgggaatcgccggccgacgtggggaggtggaggaggagagagaggtgggattcgaaatttcgaatcccggccgtctcgggcgcgggcgcgtgcgacagggagggggagtaggtgcggaagacacggcgcatgcgctggcgtggctgacgtggcccggagaaggcgggaacgtgggcgcggcggtggttgtggagcgcgtcggcgccggctggaggaaggggatgggcccgataggtgggccccacctatcagcgaccccgggggagaggagggaggcggccggctcggctgggcctcgacctgtcggccggctcggctgggcgtcggcctgtcggccggcccagcggaaagaagggggggaaagagagaatgggccggcggcccaattgaaagaaaaagagaaaagaaaaaggaaaaagaaggaaaatggattttcctgggattaaatattgcttgtgctcaattttaatcggttaaaattatttctagagttatgagaattccactaaaaatcttgttagcgtttttcgacatgtagaactcaagaaaaattccacatgccaaatccgattattatttgcattaatttattagggttttctcttgctcttacaccggtattttctctggtggattataaattcaatttaggcttgggaaagaacttcagggtgtgacaaacctacccccctttaacggaatctcgaccccgagattcggaggagctggtgaagaggtgcggatgggcggcctttagctcatcttccctttcccaggttgcttattcatctgagtgatggctccactgaaccctgcagaacctggtgaccttattcctagtcctcctttcactggtctcaaggatacgaactggcttctccacgtaggtcagatcttcttggatgtcaatgtgctccgaatcggcttgttcttcgagtacccttagacacttctttaactgggacacgtggaacacgtcatggataccgatcatgttggatggaagttctagctgataagccacttctcctcttcgttccaagattttgtatggtcccacgaagcgtggtgccaacttaccttttgtctggaaacggtgtactccccggagcggagtaacacggagatacatgtaatcccctgcttcaaaagtgagttcccttcggcggttgtccgcatagctcttctgtcgagactgggcaattctcaacctctctctgacggttctaactttctcttctgcttccgttaacacctctgttccgaacagttgacgttcgcctgtttgattccagaagagaggtgtgcgacacttccggccatacaacgcttcgaacggtgccatagactggcctgatagctgttgttgtacgagaattccgcataaggcaggcttttatcccatgctccaccaaaatcaagcgcacaagcccgtagcatatcctctaagatctggttgaccctctcggtctggccatctgtctgtggatggtaggctgtgctaaaattcaaacgggtccccaattcttcctgcagcttctaccaaaattttgaggtgaactgactccctcgatcagatacaatcttcttgggtaccccatgcagacacatgatccttgtcaggtacagctctgccaatttcttccccgtatatgtggtatgcactggaatgaaatgagcaactttagtgagtcgatccacgactacctagattgaatcgtggccagatgatgtccagggcagtcctgttataaagtccattccaatctcctcccatttccattccgggatctgaagaggctggagtaaacctgctggcctttggtgctctgccttcactcgttggcaaaagtcgcagagtgcgacgaattcagctatttcccttctcatgctgacctaccagaacttttctttgaggtcttggtacattttggtgctgcctggatgaatggagtactgagtctgatgagcctcggtgagtatcaaatcctttagttccttatcgtccggtacacataatctttctccaaaccagattgtgccgtgttcatcttcgtgaaaatcctgggcttttccgaccctcatgttctttttcagctctgctatttcaggatcatttacttgagctgctctgacttgatccacgagtgtaggtcgtgcctcgaggacagccacgtacccgtattctacaagccccaagttgaggtgttcaagctcctgctgcaattctttacacatgccctcggtgcatagggcattgcagtagctcttcctgcttaatgcatctgccaccacattggctttacccggatggtaatgaatgctcatgtcataatctttgattaactccaaccatcttcgttgtcggagatttagatccagttgggtgaagatatacttcagactcttgtgatccgtatatacttcgcaacggttgccaatcagatagtgcctccagatcttcaaagcatgtaccaccgctgccaattccaggtcatgagttggatagttcccttcatgtggacgcaactgccgcgaggcataagcgaccactctgccctcttgcattagaacacatccaagcccgtggcgggacgcgtcgtagtagacttggaagtctttagtctggtcgggcagaatcagaactggggcggttactaatttctttttgagcttctcaaaactctggtcacactcagctgtccatttaaatttctcatttttcttaagcaactgagtcatgggtctggcgatcctagagaaattttcaatgaaccgacggtaataacccgcgagtccaagaaaacttctaatctgtgacacggtcttaggtggggtccacttggtaactgactccacattcgacggatcgattgccacgcactgagctgtaatgacgtgacccaagaatttgacttccaatagccaaaagtcgcatttactgaacttggcatataactggtgttcctgcaacttctcgagtaccagatggagatgtcgttcatgttcttcttccgatttggaatagataagaatgtcgtcgatgaataccaccacaaacttatccagaaattccatgaacactttgttcatcaggttcatgaagaatgcgggtgcattggtaagtctaaaagacatcaccgtgcactcgtacaacccatatcgagtggtgaaggctgtcttgggaatatcctcttcccggattctcaactggtgatagcctgatcgcaggtcgattttagaaaacactttagccccttttagttggtcgaacaaatcatcaatccgcggcaaaggatatttgttcttgattgtgacctcattgagtgcgcgataatcgacgcacattcttttcgtcttatccttcttctccacaaaaatgaccggagcaccccaaggtaaagtacttggtcgaatgtaccctttctgcagctgctcatcaacctgcttcttgacctgtgctagcttgttggttgccattctgtacggtttcttgtaaattggggcagttcctggtgccaaatcaatccggaattcaagttctctcttgggtggcatggtagtgaggtcttcaaggaacacttcgggatactcgcagactatggggatatcctccaatttctgcaaacccttctgctcggtggtcacagggttttccacttcaatctggtttaaggagattctctgctttggtgagactggtgacatgtacaccacggtctctcccttctcattggtcaaggtgactgtgcgattcgcacaatcaatgactcccttgaacttggtcagccaatccatcccaagaatgacatctaagtctttggattcgagaaggatgaggttggctagaaatggtgatatttgaatttctattagcactgaagggctataactgaccgaggttgaactatttcctggggtatgaaccctcattggtgtactaagcttttcttttcttaacccatgcatccccacaaatttctttgaaatgaaagaatgcgttgcaccagaatcaaaaagtactgtagcagggactgagttgacagaaaacgtacccagtacaacctctggtgctgctcgcgcctcctctgcggacgcgtggttgtcacgagcctggacaaaccttggcccgacacgccttggcttcgggcatttgtcagcaaagtggccaagctcgccacagttgaagcaggaccctggctttgttccagtctccttcttggcttgggcggatggagctgactgtgctggtgttattggtgggcgcggagctgctctgcggttgggctgacctccatggtggttctggctgccactggcgccctggtggaagctgctcgagttgaaagggcggtgctggcggacgatcatggtggtaggtccactttgctgtctgggagtgaagcgcggtcgcgggtggcttccttggttggaccggaattgcgctgcctttctcttcctgtccattttgttgcactgatcctcctgatggattgctttgtcaaccagcttctcaaaatcggcgtagcctccagagattaactggttggtcagctcgtcatctaggcctgctaggaatttctcctgcttctcggcgtcagtgcggacatcctccgatgcatatcgcgctagccgattgaactcatggagatactcagtcactgtcctgttgccctggtggagtgcctggaactcccttttcttctgtgccacaaccccgtctggcacctgcgccttcctgaagttgcgacagaactccgcccaagtgacttccgtgcctggcgggcgggtagccatgtgattgtcccaccaagctgacgcgggaccctggagctggtgtgtggcgaaggcgaccttctcctgatcattgcactgcaggagatttagcttcttctcaatggcatggagccagtcattcgcctccatggggttggtggtgctagagaaggtgggtggcctgacgtgtagaaactccggcagtttggactgagggggagggggaccaaactattgctgttgctgctcggcttgctactgcatcctctggtgcatctgctggtgctggtgctgcatctgttgcatcatggctgccatcatctgagtctgatgagccattacttgggccagagtcggattctcggggagcagtggcggaccattgccggagtcgctgttgggatgcacaccatcaatgcgttcttcgccgttgctgccctcgcctgctgtacggctaccattcctggtgtagaccatctggaggaagagcggacggaggggggggggaaagaagagaaacaggtgctcaggaactaagctttattatataggaatttaaactgcaattgttctgatctgaattaaaatacttaaaacagcaggcaaatccttattatgacagccatatcataggcacatgatattgaccatcgactgacccccaagcgaacagacctaaacacacaaactagcagacaaaaactaagcagtcgataaactaagggaaagcgagcctaatactcggaacggctcctgcggtcggtggagtcgagggcgtcctcctgctcgtcaccacgtccctctgagcggctcctggagtttggcagatacatctcgccgctgcccggctccgagccactggaactgctgctgctgtggtcgcggctgccactgggagtagcaggcaaccaacccccgttgccactggctggacccctggcggctaatgctggagcgaaggagagagcggacgcgggagctgacactgggacaggagctgggactggagctggagctgcaggagctgcgggaactgcgggcggaggtgggttcctgggcgcaagctgaatgcgcacgggtgccgtcgtcgacttgcggggcgtgttgcggattcttcaactgagcattctccttctttaggcgtgcgatctcatccttcttcaggcgtgcgatctcatccttcagagctatgatcctcacgagcttcccgtcattcaaggccctggatgccttgcgcagatccgagtgcatcctgtccattcccctcatcacggcacacatatgaccaaaggtggtgtcgttctcgccggctgtcgaacggaaggtgctgacgtcgtcgccacttgcttgacgagggtgaaaccggtacgccgtgttgcagaagatgtagttgtggcgctcccgtaatctggccatcatcaggtatgctgcctcctgacaggcgtgatctgctgtgcctccggatgcctcaaccaccatgttagcgaggcaggtatgcacatagccatgaacctccaggcgaacacggtgagggaactcgccactgagcggtggaacagtcgaatactctggcgcattggggtagcccaccaccagtgtcatgcgagccaactctgccacaaagtcatccatgccttctccgcgatggttgggtgggtgatcggccatctagagaagacaaaggggtaggatcaatgcatgctcaaatccaatttaaatgaaagagtaaaagactcaattaaaataagcgaataagagtggaattttatgcatagatcatttttgcatgaaggcgaataaataagacgaacttacatagcgataaaataatgagaaaattagatacatactaataataataagagcataaataccttgcaacccatattcctgagttaggacctaatgcattcctcccatcaaatcccgactgactgtcgaataaatcccaagtaattttactaaaagcctagactgacctggtttggcaaatcccacttaaacgggcgaccaaaattttcccttgcaccacaagaacagatcccaattttcctagaactaatccaattgcaaagaacatatgcaatgaaaaggattcagagggctcttaggtttttccatttggcttgtcctacggcccagaaattcccgaatagaattccaagcagaatatgcattaaaatccccgtccaggaccggccgaggtacacaaacgacaaagttgccatacagatccacgtcttacaaacattataacagtcttacataaatgcagtggaaaaacaaaagataactagagctaagccttgacttgatctgcaacgggaacaccactccacaggcatcctcgacggcacggatgaagcctactcctcggagaaatcaccatctgacgcatactcaaactctggggtttggggaaaatagagcaagactgagtactacccactgtactcagcaagtcataccggaataggggtatgatgcagggaattatcaagggatagctataatggttcgtttgcataaagcgggcatttataaacagaagttgaaagcagtaaaacagttgtaataattaatcaatattaatcatccactgtccaaatagttgaccacccataaccgcgggcacagctattcaaatagttttactctgatcagaggtgtacaactgtacccacaagacatagccccatgacacgtttccgtgcgccgacatgccaccacgacataccggaaagaggccgtgataggacccttcgcataaccccctctaaccaagcacaccacacctcaggtttcacccccactccttgcaaggcagcgggcagtcccctctcgtgcctaggtgaatccggaagccgcataggctgtcgcagggcccatccaaactccatcatgcccacccttgcctggatgcgtcggctagaggaaagctacactataagcccagccgttgcccacgctggcttgtggtaagtacgaggaattcttctagggtttcccgcgaaccggtccttaatggtcctgggcgcgaccatcaaaaccatgcatccacggcccaccatttaatattaattaattaaccaacaccggagtggtgagcattaaccaacatcaatcctagaatctgatatctatgcatttaatgtagttccccattgtgtgctagttgaactaagcaaagctaagcattccctagtccaatctctagtcatgttatatcccaagctaacaaaggaacatggtacaagatagcatggctatgacagtaggtaaacatcccatggtgatattataaaacaatgcagtatttgaagaaaaacaatggagcatttgcaatataggatcaacatgttcaagtgacaagcatgacttgccttgctctgcagctgaaggaacttcggcgactatttcaaggtacaccagagcgtcgggagagccgaaatctaagcgacatacaaagcaaacaatacaaacaagctataagactactgaaacagagaacaaaaccatttttaatggattctacacatttttcttgatttactgagacatgaatgggcttaaacggagctcggatgaattagatatgaattttagaagattcactgtgtttttactataaacagaaaaatccttaattgaattattgcgcaataaataaatcccgggagagagagggggcggcgccgacatgcgggccccacatggcagtgactcgaggagggcggtccgcggtggaccgagtccacgaaccgggaaaggacgacgcaccacgtggctctgacgtggcgccgacgcagcggccacgcggcagccacgtgggcggccgtacggacgaccccgatctacccaagggtagattggacggcgggtgtggctcgcggccggcgtgcgcgggcacggctcaagccggcccggcggccatggcgcgcggcggctagcggcgcgcatgcggcggcggcgcgagacggcgaccggccggcggcggagggcgacggcatcgcggcgacgcgggcggcgaagcggcggccaagcggctaagcggcggcgtggcggctagcggcgcgggagagagaaagaggaaggggaggagggacctcaccgacgacgaccgacgacggcgagcaacggagggcggcggcgacggtgggacgatctctggaaccacctagcgaacacggtggaaggggttagagagggagagggaattggaagagggcgaggacgctggccgaaggcggcggccatggcggtgctcaccggcaaacggcacggagtgggtttcggcggcgggatccaatggaagaggggtggacggggtggcccgcacgacggcgaacgcgacggcgtcgtcggccggctcggcgcggcggctagcggcgaccggagcggtggcggcggcggcgaagaggagggcgacggcgctagggcgttagagggctcgagagggctcggcgagatggggaaaaagagagaggggtggcggtggtgcttaaatagaggagggggagcccggacgtggccggtagaggcgggaatcgccggccgacgtggggaggtggaggaggagagagaggcgggattcgcatttcgaatcccagccgtctcaggcgcgggcgcgggcgaaagggagggggagtgggtgcgggagacgtggcgcatgcgcgggcgtggccgacatggcctggaggaggcgggaacgtgggcgcggcggcggttgcggtgcgcgacggcgccggctggaggaaggggacgggcccgacaggtgggccccacctattggcgaccccgggggagaagagggaggcggccggctcggctgggcctcggcctgtcggccggcccagcggaaagaaggggggaagagagaatgggccggcggcccagttgaaagaaaaagagaaaagaaaaaggaaaaagaaggaaaatggattttcctgggattaaatattgcttgtgctcaattttaattggttaaaattatttctagagctttgagaattccgctaaaattcttgttagcgtatttcgacatgtaaaactcaagaaaaattccacatgccaaatccgattattatttgcattaatttattagggttttctcttgctcttacaccgatattttctctggtggattataaattcaatttaggcttgggaaagaatttcagggtgtgacacgttgtcagccgcattgccaaatgggtagtcgagttaagccaatttgatgtccactttgtgcacagaatagccatcaagtcacaagtcttagcggattttgtagccgattggactatcccagatgacacaccgaccagtcaaacagacaacgaaacttggacaatggcattcaacagtgcactcaacagccaaggagctggaaccggatttatcctgacatctcttacaggagatcagttcaagcacgcaattcacctcaatttccgggcaacaaataacacggccgaatacaaagcgctactcgtagagataaaagcagctgctgcgcttggctcaaagcaactaatcatgaaaggggattccgagctagtcgtgaaccaagtacacaaagactacaagtgctccaacccagagttagccaaatatctcgtcgaagttagaaagctgtaacatagattcgacgggatcgaggttcgacatatctactgaaaagacaacatcgaaccagacgaccttgcacggcgcgcttccagacgagaaccactcgaccccggaacctttttagacatccttacaaagccttctgtcaaggacatgcacaacgaaagcaccacagccaacaccgacaacaggccgggggctacaaaggtcgcatatgtcgtcgcaaacatagagacaacagacaactagcgcatcccgcttatcaagttcctagagtcagatgagctactggatgacgacacggaggtagagaaactatcctgttaggccaagatatattgtttgatcggtaacgacctatacaaaaaggccccgaatggcatcatcctcaagtgtgtatcattcgacgacggaaacgctctccttctcgacatccacgaaggcatttgtgaatcgcacgccggtggatgcaccttggttggaaaggactttagacaaggtttttttggccaacggccctcaaagacgcctgtgatatagtgcaacgatgcgaagcctgccagttcttcagcaaacacactaagttgccagcacaagcgcttcagactattcctctgacatggctgttctcatgctgggggcacgatatcctcaggccatcccacgaggacagacggctatagattcctgtttgttgcaatcgacaaattcactaagtggattgaagtagagccaacaaatcaaagccgacaatgccataaaattcatcaaggggatattctgcagatatggattgcctcaccgcatcctcacagacaatggctcccaattcaccaacggtgattttcaagattactatattgaactgggagtcaaaatatgctttgcctcagtatcccatcctcagagcaatggacaagtcaaacaagctaatggaatcatactccaggggatcaaaactcacgtgtatgataggctcatggcctacgacacaaagtgggctgaagaactccaatcggtcctatggtttgtacgaaccacaccgacttcgtccaacaaagagacacctttctttctcgtgtacgtatcagaagccatgctccccacagagctacaacatcaaagtacacgagttcggaaatactctgacgaagagcaagtggaaaggcgaagcgacgatgtgaatctactcgaggagcatcgcgaacgagttgccatccgagcagccttgtatcagtaggccttacgccgatatcacgagaagcgcatcagagctcgtacacttgccatcggcgattacgtcctccgacgagttcaaaaccaggcagggcggaacaaactctcgcctaagtgggaaggaccgtacacggtggtacaagtcttatgaccaggtgtgttcaagattgcagatggcgatggctgcgaactatccaactcttggtacattgaccaactacgaaaattctatgtatagaatcaatgtatccaagtctgtaagcatcccttacaaaacatcatatcagtaaaggtacctaaaggtattttgagttcttttatgaacaaaacatttctaacagtgttctacccagagatcccttaccacgataatatctcatgttgaaatcaaacctaacgaccctttacgccattctaacaagcctctgagaaacctacgagaatttcgactggggacgaccagagcagataaggtcttgtcagaatttaagagctgaacgaccatgtaaaacctggtcatataagagtgctcaatggttgcgtattaactaagccatgtaatcggaaattgacttttccaacttcacgactaggggctaggtaaatcgcagtttcaactaggcaagtttcgggtcgctaagccttctcccccgagaacgattttcttcgaggacaagattgggggctagggagagttcccagctcgatagcaggcaagaaacggcttgtacagagagtagtactcatacacacaataccttgcttacacgcttagtagatagagttcaatcctgtttacagagcttaaataaaaatatccatagagtacaaatctttttctaggtgtttcttttacaagagttgaaatctaccatgacggccattgccagttgttgatgcgaaaaacacacactggcctggaaaatatgcttaactcctgtgcaggtccaaaatcttgcctttaggttcgtgagcgtgccagttgatttgatcctgcaatcaacaagaataaagacaagaaaaaccgtggttaaatccataaacgatagccgatcggctagttgccgatgacatatcatttatcttcgtgctgatgtcatgtttgaatcgatcggcaataatgaataaataagataaaactaaatctactcgatcggctgtagatattaacaacatacaatttttactttgatatatacttaaactaagtgattggaatagatcgttcgccatgccgagacagtataaatcacttaagtcgaaatatatattagagcaaagattatatagatgtttacaacatagccgatcagatagatctagcacgtatcggctaatactccgatactactttatactaagatatcgaaacaagcaagatatattaaataatgaacctaatataacttcaatgaaacaagatcttaatataaagggtagatttagcgtaacaaataagcatacgagacgtaaaatagctaaaccaggtaagatcggttgaaactccgatgctatctctattgatgattataaaacaggctagatatcacaatttcagatagaacttaatagatcgaactcaaccgatgcagcattaagcataaagataactgtaagatctaaacaagatgatgaaaaccttttagagatggtagatacacgatataatctagatcaatgacgaaatctaactctatcggctactccctatcaaaagaaaccagccgatgacaagttatatagcgcaactaacaaagattataaagtatatgtgataactcgacgaattacatagacaagattagagtttcataaagatggaagcactaatcccgagaacacaaaccgtcatggcaagtttacctctagttgaagatcgaatcgatgcagctcaacccgaaagcaagaactcgtcgaaatagaacgaaagtaaaagggtggcgatacgccgaaagtgttattgaacatgtgttttttgattacatgggttcgggtcatattaatacccaagatacaaaatatgtccttgccggacacgactcttatctctaacaaactctaagataccataagtctttgcagcagacttttgcccaaacatatctctatggaaattacataagttatcataattaatagatacaattgtctatctgagagctttatgtccattgtggcaattctcatgaagcacgttgatcgatcctagaaacagctttgaaaccaactccatcagaatccgctgtgccggctccatcggctgtaccggctccatcggctgtatcaaccatcccctaaccgatccaacatagccgatgccttcacagctgatgcacactctattcttcaacatctctttgccgaatccgcttcgattccaatgtcggacctggttcatatcttaccaaatttggtcgttaacaccagttcatggacgcaaagatcttctcagccaaaggagcaagggaacacgccagctgatcgagttcattcgccgacaaccgcgaagggtgaaacccttcacgcaggaactcgaggttcatctgcaagcaatgatctcggatgcaggcaagcacgtggtccccggcatatcggctggcgtggcgacactcctccttcaggtagttgttgatctgctggccaatgtctcctcaagctgggcacacgcgctcttcatccaagataggtagcccgccgtggtctcctcgggctctgtgcgatcaatcttcagctggcggcagacctcggccactgcactgcagcaactcttgaggtatgaattcaaccagacttcgcgatctcggagcgcttctacagcttgacccttctttaccaccaccatggaccattcgaactctgccacctcaaatttcgtttccgacaaaggactcgacgatctcgctcagcaatcatgctcttgaggtctggaaaaggcaagggtttaaggaaattctcccatgaggacatatgtctggagaatgcgaaaaacctaaggcaacccacttgagttctcttggcggagcgaaacacgcgcccaagcccgatgggtcagagatgacattcgtgttgtctaacacgacaatgtccccgacaacgtcagaagcaggtgcctcgctcagcaaggccaaatcggttgtcacgatatcagggcgtccgccttgctggacgtcctcggcatcaaaacatctacgaagaaaaaggacgctacgaattaacttaccatgacatcaaaagggatgactattctaccgtggacaaaacaaacccaaagtgtttatgcaaaagacacaaggatacaagaaaggaaattactcctcaaatagaggggggacaatttccccgagatccgccacgtccgacatctcgtcctcacacgtggcatcggctcccccttcgacagtatctctttcagatcagcgtcaggaagggcgagcttcacacacgcgagcacctgacaagcacccgtgtggatcccgttggagatctcctccgagactttggcggcgtgtttggaggggatcacttccatcgcctttgccagcttggacagggatgacatcacggaggtctcgtcggggtactccgggatggtagacttgacaccacacatgagagcaagctggtggaggctggtgaagctcttccggagcgactcgcggatggagaggatgtgatcctacatgtcattcatccgctgctccaagccttgtcactgcatctcgttgttggccatgatttccctcatcttctaaaggtcatcgcgggcaacatcgagttccgactctagctgggccacccgcccatccgacgctgtagcacgggcggctatgtggtccatctcggcggccacctcctgagaagccgtttcgaggaggcgccagccttcggtcatcatttgtgaccaggtcaatggccccgtcggagtaggaggcggcggtgcagccacgggcatgacggcggacgggatggattcggcgacaacagctgcggtgtccacgcaatgagaagcggcagcgggagtcacgctggtcgcgacctcatccccgctctgtgcagagatcgctgaggccgtcccgccgacatcagaaatacactcaaaagaccaatcaacatgacaacaaaaggaggtccaggattccacttacctgctagcggctctctttattatcctcctcttcggaggaggagggagacggcccgtatcctgagtaagatggaaaatcaagatctcacccccattgccctgcaaggataaataaggtagcaagatagggatggaatggcctacctcggagccgctggatttctgacgagatccggggccgccgatcgtacgagcccaacctttcctcttgagcccgctgccttcagcgctacaggtccagaggcgacggcagcgacttcctccacgactttctccttgagagaggaggaagtctaatgatcgacaagggggcctatgacatccgtcaaaggtagaacctgcgggagttgaagtcacttcgtctcccaacaaaatgaaaaggcgaaaggcgttcggttcactcacattgatggcgtccaccttgtcggccgctgacttgtagcagaggggagtgggcagttcatcggttgccgagacggggctgatcagcacgtctgttgacggtcgttatcgatcagtttcgatcatcaatattaccaaaatagaggagaactagttatgcttgcaatgcatatccttgttataataataatattccactagtattaggtatattgaccttttgcagggaataaccataaagtggaggagaatcaacatcaacccagacgataaatcaatcgaacgatgtcgagaatcagacttatgcatgaatgggccaaaaactcagaattgacacgatcaacgtccctcacccgctgcatcacgacatcggcggaaagatctgaaacgcaaggaaaaaggtgaagatgggtcaaaccgagaacacgagatagctattaaagagaagacgaagactgcaacacgagaacaagtaccccgcgacgagatccgtgtcacgtccaaatccccctcgaaatcgaacgcggggtgggcgcgggcctggagtgactggatgcgccgggcaatgaagtctcgagcgacatcatactcagtcaacccttgttctcgcaggccaccgatgacattaaggaaggcctcaagtgaaggggtcaatagaggtttggaggtccagcactcctgacgctttggttggtcctcaggcacgacaagaaccggatcgagttcttcaagctcaagatagaaccacttcgatcgccatttggtccgggatgtatggcattgaaagggtatgtacctcgctttcataccgtcatgtaagcgaaacccacaacatcccgagaccctgccagtttccatccagtggagttcataaaagaatcggaaaaggtccaagaagggcactaccccaatgtaggcctcacaaagatgagcgaagatgctcaggaaagcaatggaactggggttgagatgtagaagcgtgaggccgtagaaattcaggatcagcaaaagaaattccgaaggaggaggcaaaaaaccacaatggatgaaatcctctaccactaccatacgacctagggcaggggagcgatcagcacctcttttctctcttgccatggtctgtttggaagggagggctcagtcggtgtgaagcttcttctagctagctgcgtcggaggaagacttgccgaggtccgccattggaagaggatcaccggaggaagatgaagaaacttagggcttttgggagacgaagggttcgaggttgctagaagactggaggattttttggaaaacagacttgaaatggatcccaaaacccctttaaataggcgcactacctaacggttcgcattccaaggaaggagagagattgccgccgaaaaatcctaaggcccgttaagggcggttgttcagacttcaatttaaattcatattcaaaccgttggactccctctagcgttgttgacgactacctgtctcctcggttttgcgccgagatcgactaagtacgacaaggcgctggcaggagaagttgcgagcgacaacgtgaattc

SEQ ID NO: 6975 - DNA, 853 bp, Oryza sativa
tcgcaagccagacaaagagtggcagccggtgaaggggatatggtggatggagatggctgctggggagtgtggcggtggtgagtgccaccactacgaggccacgaagtctcaggcgagttagtgataggaaaagccaagccagaggtgacgaccagccctcaagcgactgctggtattttctacactcacaaataaatcggtaagcgcaaggatatcgctatagcatttcccccatgagtattatcaagggtatcatatttatatttccgcagggaaggcgacagtctgctttaatcaatatataattaattcaccatagtctaaacaggggttaaaataacactccctccatcccaaataaacaagtctaagattgtatgggatgttttctagtacaacaaatttggacagaagcttgtccagattcgttttactaggaaatttctcatccagtactaggttggttttttgtgggacaaagggagtaattgatgaggtagtagacatacacgagattcacctctataagaatatccagtagaaaatagcctaaggaaactacgaatcatctatacttctattctaatcttgtctagaataaacttaacatatacatgcttacaacctaggcacctaggtattatcaagagaccactccctgctagcatggttatggtatttacgcactcttacgtcatacccgaacgtgaaggaatacaaaggacggatagggctgtcaccacctgctgcctacctcatttttcactagagcacacccacatccaatgacatttatctagcctaagcaccatgcttatgcaataaataatatcactgactccctcgggactct

SEQ ID NO: 6976 - DNA, 836 bp, Oryza sativa
actttagtctataattcctgcatctaagttaattctccaatcataatacaactacattattttattattgatatacgtgtaagaaatgctaattttccctttatttatgcaagttggtggtcaaaattggtacttagcgaccgtcaacaacacccccaagtaaagataaaatttagaatgttgatcaggagttgctaccaatattttatttcacaatagtactatgtctacaacatatccttctacttagaatttgaataagttggcaataatagttttacatttattaccttagtcctcatggggcttgtagcttctccttgccttgggtagttgcggaacagaatggatcattgagcaccaatcactctctaactttcattctgctggttttcaaaaatttttacaattaaaacaaagttcatcaaatgatactctcggtcactcagggcatagtgttgcatcttttattattctacctctaaaaggtttatatgtggagctcatggtaggggtaaaatatatatagtaaagtaaatttgtttggtgctccatggtgcccgggtaccatgattgaaattgagtatatacccaattcaaatgagtatgaaacttttttaaatgtttaggtattaacattaactactttactaacgagttcaaaccaagtttgaactgaatttggacttgtttttgttagattttggttctaggtatatagcatccaaacatataattagttagttatgtaatcatggatttgtgaaataaagttaaatttgagatgttttgttgataggtataggtatgaatcgaattcttataactaggtatat

SEQ ID NO: 6977 - DNA, 653 bp, Oryza sativa
  unsure (1)..(653): unsure at all n locations
aaccagtttcggccagttccctcagttcgacgcactaccataaaaggtaccactccatagttgttggtttatttgaaatcgacacctattaccgtttctcatctctataaagaaaagtatagaaaaaaaagttaaaaactgatgccggtgtgagtttcatttaagaaatgacctatatttatattataggtgttagttctagataaaaactgatactacctataataaactaaaggtgttggtttttaaaaaaccgttacccgagccaagccgaaacaagcgagtgccggccccaatccccacccttatcccctggcccacacccggcctcgtctctctctcacatacacctctccaccggcatnctccctttctcttctcctctgcatncgacttccttcttttcctctagagccggctgtagcggtggaagaagctcggccggccctcttttttccgatggcccctccttcttttcggtcacccctccctcttcttcttcagatcccgtgatggaggcagtggtagaaaaagcccgtgtgggccaagtggcggtcggtggatatgctccatcagctggttttttttattaatttattgaatgctataagtactagttgggggttaagaacttgcacctataatctctacag

SEQ ID NO: 6978 - DNA, 749 bp, Oryza sativa
atcacaacacctgtagagattataggtgccagttcttaacccacaactagtacctatagcattcaataaaataataaaaaaaaacagctgatggagcatatccaccgaccgccacctcgcccacaccggccttctctaccactgcctccatcaccggatctggaggagaagaggggagggtggacggagaggagggagggccatcgggaaagagaggggccggcgagcctcctccaccgctacagccggctctagaggaaaaggagggaggcggatgcagaggaggagaggaagggaggatgccggtggagaggtgtatgtgagagagagacgaggccgggtgtgggccaggggataagggtggggattggggccggcactcgcttgtttcggcttggctcgggtaacggttttttaaaaaccaacacctttagtttattataggtagtatcagtttttatctagaactaacacctataatataaatataggtcatttcttaaatgaaactcacaccggcatcagtttttaacttttttttctatacttttctttatagagatacgtcttgcacaatcccaaatccttcaatgatatttcattcgagtgcttgaagaatttgtttggtggagttatagctttatcggccaggtaagcgaatggcaatgactcagagatgagattaacccccacaggtggattggtaaaaaattaacgttgttcccctctaggtgacaaggaagggatct

SEQ ID NO: 6979 - DNA, 702 bp, Oryza sativa
ctgagattgttgacgtagtcggagcggtaggtctggccgaggacgccatggacatcgtcggagaggtcgtagaacttgaagccgaggtcgaggtgggcgaggctgtcctcctcggtgacgccgtagttgtggatgcgggagtcctgctcggtgatgggcaccacgttggccatgatgtcgagcacgccggcgagctgcaccctgacggcgttggtggcggcggtcctggtgacggtgaggcctggaacggcggcggactcccagcgcgcgccgagctcggcggggacgtcgacgggcgcgccgtcgaaggcgagctcgaggcggtcgtcgtcgctgttccacttggcggtcttaagggcgcccatgtagaggcggtggtcggcgaagcggatgccgagggcctggatccaggtgaagtcgcggctcatggtggggttgcgcttgccgatgaagtgggcgttgatgtggaggtcggcgtcgaagacgatgcagaagtcgtggtccttcttgccgtgaaagtagaagttgttgccgtcgccgccggtgaaccgcgggtcgccgcacgacacgccggggtagaagtcgcacactttgaaaaaatcaaataatttcacacagagaatcacacaagatgtcacgatcgatcagtagttcaaatgaattgcaactagctagtgatgcttactgcacaaggtcttgcag

SEQ ID NO: 6980 - DNA, 22054 bp, Oryza sativa
aggtgacactatagaatactcaagcttgttttcaataaccgaaagccacttcaaattggcacagtttgatagacccttcagcattcaaaaccacaatgtgagtggaaaaaaaaaagatactctgatgaacacagccacagcaatgatttaatggaacgattagccatcaattctctacttcaatgaactcaaagaataatccagaccgaatgggacatcaaattagtccattatatgactttctaaaaggttattacgggattcatccttttaactattcaatgtttcagatggatttacccagtgcctatgcttgtagagaacacagtaacaccgacatcgcatatatccatacaggtgaaattcaccaagaatctacaccgatgctaaatatgatgtataaacatgtgcatttctcactagaatactgtgttttaacccgtagtacattgactagttacctcgagagtgaggaggcagttgtagccgaggtcgaggcgctccagattcacgaagctgctcaggcacgacacctacacaaaaaccaacacagcacagcaccgcacaacacaaggatgagaaaacatggcaggaaaaaaaacaccaatcgacgaggcagaggctacacagcaccgacgtcggagagggcgcggtgggagaggttgagcgacgtggcgagcgtcccggcggatcccgcctcgcgcttcgcctgctccaccgtgagccgcgccatctcctcctcctccggccgccgccgttgaggagggcgaagcgaagcaagcgctcgttgcggcggcaggcgagctgagctctcaagtctcaaagacttcaagagagaaaaataccctaacctaacaagggcgatatgcagctgacatgtggggcccactgtcagcctccacggagtatttctctctcttctcgttagagaggggggtaaagcgcaagagactcgcaacgcaggtcagagcggaaggggagaagaaggaggtgctcctctcgagtttggagaaaatttcccccgcagaggcctccgcttgctcgcggagatggcgatgaccgtcgaaggtgagggtcgctctgagtttccctcccccatctaagatttgctcaattgctagtctggttctgttcccgatttcggcgtcgtttgggctctccgattcgagtgtcggggtggcgggggattgggcggctagggttccggttcgagtttggtgttacgattggctggtgcgtgctttacggattagggcgtcgggttcccaattcatcgcgcatggtttgttgtaatgcttgtgaagttaaactttcccagatttagtcttggcattcggtgaacacgattatctgtttatatgtcattcatagaatcagagtgaattatccctgcaaaaaaaaaaagaatcaaagtgattagatcctccaagttagcaccttgtattgggtcttatgttttgccagtagatattgtagtccggcttacctacaattgtgcatgaaacactatcctgtatttcaactcatctgcatcctcccgagtttccaacagaacaaggagcataagccaaaaatatgcctgcaaaaatgtgaacttaaccatctagctcaataacaagtgtccctcagaatcgcttaactgatacccatgagcatttactatgtgcatttggttttgagttctagctctaggatataaattttaccatgtgcatttaaattattttggttgtttgctaccaacctgaaactacactgcttctgagatgtatttggatatcactttcttcaatttattgctaaaagcatacagtgatactgaagcatcaaactacatggttttgattcaaaatttgtaaccaaattctacttatgattcatggaactggacaatttgaagttaacatggagctctgcacatgcttgatgtatgtttagtccatcaaaaaacaacatcccagatcaacttatgttcttctttcgacctttatttgtgcaacctcatgttcataaaaaatatcatcgaacttgttcaaaagcacttcgaaaaccatgtcgtctttagattagcctttatgtagcacaacaccaaagatgagcatgaccatcctctgaagaaaaaaaaatcatgctgaactattaagcctttgaagtgtttttagctaaactgggaggaagaatatgcattaaattatggttatgaaattcagaccagcttgttgattttatagaatagtatttcatttgcatagagttacctttctgaaaatacagttcattttcactatcagctatttgttagactctagtgctccttattaggtcatgccatcatctttgttctcctgcaattggtttgaaagtttcactaacttaatgcttcttgtctttgcttttatacctttctgctggatgatgatgatgatgtcacttatcattgatgtgtgtcttgacagtgtaagtatattattcagattcttttctgaccattcttttacatttaagataagtgttaacaatataattgcttctactacaggctcgctggacttgcatttatgttctcaacaagtattcttttgcaaatactggtacataattctcacttgtttaaatctccacctagcctcttttatttgctaaaattcaggcttctgggtgctttgtttcatgacagttgctatttatttactcactaactatttcattactttgagaagtgagaacctaacagtttgatttggcattttgtttgtacaattcattcatgcacattactctgtatgtctgtcatgctaattatgttgtgaaattcataaaacttagagcaatctggagcatcaattgctgtccagaattactgtagaagagtatgcgtgctagaaataatacttcacagtcagtgaacaaagcgtgtagcattttgaagacaccatagcccacatgacggacatgctcttgttgtttgatcaggctgttggttctatagctaattatttttccttattttgatggtgcaggcttgtgctctgtacaataattggtggcctatgttagcaggtaattgttagttagttatcctcaatcagtgttgtctaatcctcgtcgaccttcaactgacatttgccatacttctgcagctcttatgtatgtccttgtaccgatgccatgcctattcttcggtggtggatctacccagttcttgactagcagagatggtggagggtatggtttgatttgttgttttcgttccagaaactttaccatacatactgtactacttggatgtaaactaacatatgtaaagaatagtttggaataaggaaattccttctgatttgtagttgtgacaaactaatgatagagtgtttatcatttcaggtggttcaatgctgcaaaattcctgactggtgcatctgccatgggaagcattgcaatcccagcaattctgaggcacgctggcctaattgagactggagccatgttcatcgagttcacgtccttcttcatccttgtatgcacagtgatgtgcttccatagagctacgctggatgaagattggtaaaaggctcgaggcacatggacacaagaaggtaaatctgtttcatggtttgcttctcagcacgtacaagagaaattccttagtggacactaacatggacatgtgtacaaagaagcaaatatttgagttggcgtgactgtctgtataaatgctcaaagatttgctgatctagcgacaatgccaatgttctatgtgcacttttcatgtgaatactcctcacatgatctatgggcaacctgtcagccatccgtgtgaaatgcgatcaaacgagcaggcaggcgccctgtttaattcccttgattggttctttgcattttgaagcatttggccaccgtgcggcagctcgtctcctgctgcatctctccaccgtttcgcttctctcatccctatcccgcgccaccgctcagaatgtcttgggctttaatttttctgtgttatactgttctcgatcaatgcgattaattttagacatgtgcttgttctaaaaaccaattcatcaaatcaatactggacagtttttactacttgggtttgaagatgaagattttctttttggaggggttcgattcagaattgttgcagaattcctaacctcttctccctcttttcaaaccatctttttattataagaaaaaatactttaaaaattatattaatttatttttcaaatcatgcgttaattcatcgctccgttttttatgtgtatggatgaagttaccaacttcttcaaacggtgcgttcctatatgatatttgtgctgtaaaacaagcagagatatttcacatagcaatcgagcattcagaattttatttaccggccaaaaacaggtaacctctgtcctcttctcagctccggcttgtttttctttttagcgtttttaaaatgtctttatgatttataaataacaatccgcctaatcacaacgaagacagtttggccgagtggtctaaggcgccagatttaggctctggtccgaaagggcgtgggttcaaatcccacagctgtcataatttttcttccttctgattgattttgatttttaatcctctggttttttgcgttcccagatatataggttccgtgctcatggattttcgttctggtgaaatttgcaaggattttcaaatcgtttaaaatgttatcatctcagcgatgaggtaataccgcaatacatcgagcacaacaacccggagagaaatgcagaacgtcagtgtgtgtagctatccagtgaagtatgagattttcagtagttcggtcagaaatatattctagtggacacggttttttcccctcccttttcctttttgttcttttttttttgggggggggggggtggggagtggatagagttcagacagcaaaacaaataaaaaacaaaagaaaatcacaagaggattttgttgacagactgctgctgaaaatcagagtccatggtcaaaaaaaaatagtttttctgcaggaagacccctgaagaagtgaagagagaagatttagagaagaaaaatgtacgagagaggagaaagacagaaacattgggagggtaggcaaatcaggaggcgaggaagtagaagaaaccttttgcaaagtccatgggacaagcaagaagtcttatgaaaatatgctaaatgatgcttagctggctcaaatagattcttcaaggtatattatggttgcagacagttccatttttttttcatttagaaccttattttgcataaatttacattaccaagtcaaacaaactaagtcatgctgaaccttccttaagctggtatgctccatgatattgcaacaaagcaaggtctaaatggaaactgaccatcctgttgaagtaaactaagtactgaatgcttagaaaactcctgtttggaccaatccaagcaagtttcattacttttgtactgctgggtcaccacgccaacaagttaacaaagtctttcacacatctcacatcgccatttggccatttcctctccaatggtcatggccccaataccccagccatggcatcagtggccctttctcatcctcttcttccttgtacttttctcctgtgaatctaatcttccctgcaggaatggtgtagaggccacacagagagtcttcctctatccacagtctccaaaggtctcctctattgtcagcaagggatacagaactggatatcacttccagcctccaaagaactggatcaatggtatgtctgcatgttttccatcagtttttacccttttgactttggctgaatccaaccagaaactgtattatccaatttggtgttccttttgtttcttgattcaagaagaaacagctgccctaattagttagtatcttttctagctgcagaagttaagccgtgtggatgagcttaatttcttgtgtctatatgaatttcatggtatagagaggaggggggaaaggtaggtaggcaactcactgcttgtgtgagctctactgctgattgttgcacacgtttatggtgctgcagattgattttcagtaaaatcgtaatatggttatttctatgtttagattttcgctggaaaatatttaccgctgaaatgttgtatttgtggccgtcttttgacgctaggcatcatatttgtattaacagaacgaacagtacaacaaatgtggagttttctcagataaagctactccacatttgttgtactgttctgttaatactagctccagttagaaaatgttgacctagataattctaagatttgttctaaaaggcctaactacataacttttttttctgaatatttagcagatcttttcttaaacataggctagtaactagtaatcaagcatgtactgattcttgaatttttcctcctgtttgctatgtcttctatattggacaattcttctaaagctgacattctctcttctttttcaaatgttccatgaaatgacaatcctggcaaatttgtggcaattcaaaagatccaaacggtacgcatcttcttcacataatatgcatccaaacaaattgtagaataaactgagacattgcgtgcctaaattatctcaaaatttacagggccaatgtactacaatggcatctaccatgagttctaccagtataacccgaacggatcagtctggggtaacatagtttggggccactcggtctcgacagatctcatcaactggatccgtcttgaacctgcaatagaaggaaatactccgagcgacataaacggttgttggactggttcagcaacaatcctcactggtgatcaaccggttatcatatataccggtgccgacacggagaagcgtcaggttcaaaacattgtgctaccaaagaaccggtctgatccttacctgagggaatggaccaagccaaaaaacaaccctttgatcgaaccggtcggtccgggtttgaactcaaaccaattcagagatccgacaaccggttggataggaccggatgggctatggagaatagcagttggggctgagctgaatggctacagtgcagcacttttgtacaagagcaaagactttatgcagtggactagagtagatcacccattgtattcttctaatgcatccaacatgtgggagtgcccggatttctttgcagtattgcctggcaagaacaatggactggacctctctgcagctatcccaaatggcgccaagcatgtcctcaaaatgagcttggattcctgtgacaagtacatgattggggtttatgatctgaaacatgacatgtttgtgccggatactgtcttggatgacagacgattgtggttgaggattgattatggcaattactatgcttcgaagtcattcttcgattcgaaaaagggaagaaggataatatggggctggactaatgagacagatagtacgtcagatgatgttgcaaaaggttgggctggcatccatgtaagaaaatcagcctctaatctcctccttgagtaaattgcatcgtcggtacacaaacttgtcaggtgggtgcaacctagtgcacaaacttgtaaaatgctcgttttggtgcatgaacttgtttggtgcgtgaggaggaaggtgaaaaggacactacaatactacatggctaatcttatcgatttaggggccgattaagatactatgtaaacatatatctaaaaaggttgctattaaacatacacctattcaatcaaaaataaaaaataaaaaatagaataggatataatgatagtagaaaatgatgaaaaagccgagcactgatttaagggttagaaacatataaaattcatcaattccatgatgaaggataaagtagagaccaaatttataaatattgcatgtcttatgcatactcactagatgtatgcacgtcacatactaatcaacatcagcattataaaattaacattgtcaagttattttggtcctcgttcgcacgaactagacaagttcgtgtactgaaacgagtattttacaagtttttgtactaaattgcatccatctaacaagtttacgtaccaccaatgcaatttactcctcctttaattttatactatggaagcaatgttttagccttagcatgtcagtgtaacatactgatcctcattcgtcatttcataaaggcaatccccaggacaatttggttagatggtgatggcaagcgattgctgcaatggccaatcgaagaggtcgaatcgcttcgaagaaacgaagtcagccatcaaggcttagaactcaagaagggtgatctgtttgagatcaagggaactgatactttacaggctagttccaatttacctcaacaaaagtattatgttttttttttgcagacactgtagctaatatggcacaccattttcttgaagcaggcagatgtggagatagattttgagctgacatccatagatgctgctgatccttttgacccttcctggcttttggacaccgagaagcattgccgagaagcagatgcatcagttcatggcggcttggggccatttggacttgttgttcttgcctctgataacatggacgagcacactactgtgcacttcagggtttacaaatcagagcagaagtacatggttctcctgtgctctgatctgagaaggttaatgctttttcttcatccagattctgttgatgcttaagaactccctatttgcattgcactgataaaagtgaaatgatatttgtagaaatctaacctttgacagtaaacactaaaaaaaagaacgaagatatctgaaaagtctgaacttgctcttttgtctgacagttaattgtccaacattgtgttcatcatttttacttgtgcagatcatcgttgagaccaggactgtacacaccagcatatggaggcttctttgaatatgaccttgaaaaggagaagaagatctccttgagaactctggtgagtgaatgaatcagtgactctgcatctgcacgatcaacacaacacatctaggaagtgaaatgaacaaacagtccgaaacctgactcgccggcgtgcgtgcagatcgaccggtcggcggtggagagcttcggcggcggcggcagggcgtgcatcatggccagagtgtacccggcggcggtcgtcgacggcgccacccacatgtacgccttcaacaatggcagtagcacggtgaaggtgtcgcagctcaaggcatggagcatgacgagagcacaggtcaatgtcaggaagggatgaactgattgattaatcaaaatggaaacaagagagcaacatattacatgctaattgtccagtaagtagttaattgactacccattcatcagaactcctttggtaggaataagaaggaaatccagaatcaaaatttttagctgctcacagacttgttgatgacatctacttgctttgtagcaatatgtttttacttgtagaaaggagatggaaatcaaatcattgttaagaaatggttcgcaattggtaacgagatactactcttcgtgttttacagtcgaactgtaaaattcgttgtccgtcagttaattatcctgctccaactctcatccaaaatcattccgtttccacattgaatttattacttacccaaatgatgttttttactgagagaattcatttcagcatgaagcctatggatcatggtttcatgcttgatgaactgatgaaaaaaagtactgacttatcggtgatgttattgttggtggaggggttcggggaaaaaaaatctccgaacccaaaagaggcatttgggccgtagtcgtaggacagattcgatggcctttcagctgctcctcagcctacagtgtattcttcttggcaaaagaactctgcccaatcagcgaattaatttggcaagcgaaggcaccggcaagaatacgtttcttcatgtggctggctgtaaaaggacgctgtctgacagctgataatcttgaaaaaaggggatggcctcacgctgattgctgtactttgtgccaacaagaacctgaaaactgcttacatctgtttatcaactgcgactataccatcacagtgtggagactgatgcggcaatggatcagcgcttacttccccatccctgggagcgaaaacacatgcctgacagagtggtggttgcaggccagaacatgttttcggaagtgctacaggacaaacttcgacagcgcttgtatgctgatttgctggcagatttggaaggaaagaaatgcgcgtgttttcgaccaaagatcgagaagccctaaccagttagcagaggctatcaaagaagagatcttagtgtggaaagaagcaggctatttcgagatttgcagatcttagttttttagttttttagtgttgacgttccagttctttagtttgccgggctgtggttcctgccacagtctaattcgacagcctcctgtcgttgcaagcgaaaactacttgtactttgattttattcctcccaatcttaatgaaatttggtcgccggttccttcggccgacccggcagattcgatggcctaagtgggctggcccaattgctgttgcatatacggcccaaacgactctttggggttcggagatttatttcccgacccctatgtttcctgttttttgaatcagcgtgtgttgtttttctgagctgaatgttgttgtcgagagctgttcttggacggattgcgaaagaggatgtactacatctgaatgaaatggaaggtttgctaagtttttgaattgatggactatgtagtttgatacgacgttgctttgacgatatcatcgcatcattgttcacaactggttcacaatcggtaacaagatactcgacttgtttgatctgcagattcgctgtccgtaagttaattatcctgttccaactttagcttctcccagacctattgatgacatctactagccttgtagcaacatgtgtacttgtcagagttaagaccgttctctcccccgagtcggttctccccaggggcggctcgggaggcgacccggccgcccctcttccccctaccccaccccccgaagccgcgcggccgcaaggacggcggcggcggggcgctcctcgtctcctcgcgctcggacggcctggggagccacccggggatgggctggcgacggggtaggcggcggtggcggcggggacgggcgacggtggctgctgaggtgagtgcgcccggtggtgtttgtgggtggcgacggcggtggtggaggccgcggatccggcggcggccggcggtggcgtgagcacgcaggcaccccgcggcggccactggcgtcctccggcgcccctctaggcgtcggccggcgttggtggtgagggggacggccggatctggctcccttgcccagatccggcgtgtcctcgagtggggacggggtggtttggcgtccggccgtcgtgcaggtgatgtgcatattgcaggtaccctcggtgtgtaggtgacatttggtagctcccgtcgtggatgctatagttgatgggtgctccaaggcgaaagtcttgctccgctctcggtgctagcaacggcgacgcccttgggcgccgttcactttcttgaaggcgtttgctactggagccctcgttcaactccacttcaagagttttctctgggtgaaaacctagattcgttaggatcggacgatgacgtcgttctgtcggcgtgaccttcctgaaggcttcgttttaggagtttatctcttgttggacaactgtacttaggttcagtttgtcaatgtcggggttttgccggttttcctttaattaaccgtgctgttgtaaggtttttgggtccggtttcccttataaactggatcaactctcttcttctatagtgaattgcaggagctccctgtctgtcccatcgaaaaaaaaacatgtgtacttgtatagacaggagacgaaaatcaaatcactgcgataaagaactggttcgcaattatggtagtacgtgcgataggggaagaggctcctctgacataccgccctctgatgtgggtggctgacatgtgggtccaccagctgtgaggctcatatgtcatcctctcaaagttagagggcaatacgttagaggatcacgtttcgtgcgataggacttaggagcggatcggagaagaaatctccgaaccagagacatttgggccgggggtggatggtgattgacccagttcgtactaaacggctggcggcgcaaatgcctcttcggggtttgagctcccatcggatggcaaaaaaaaaactaaattttaaattttcaaatttgattttgagatatttttaaggtagtttttttttcagcattggcttttaagtcaaaaaacatatatataaaagttttacctataaatccatttttattccctaataaatagttttggcttattatgaaaaaaaccaaacgatggggctctcagactcttctacaccgaaccccacaaatcacacgtacgcccgtgcgagactcaacgacgagtgcaggtggaagcccaggttttcgtgcgatgattgtttactccatgaatttgcttaatattctactgagtaaaattgaatcaatgtgtttctttttacagaaacacaaacgcagacgtccatattgcgcatatactcactcttataaatacacaccctacctctataatcacctttaaaaagttgggttggcgtatcttaaaattgatgaagtcatcacgaacacattgttgttgagggtaggtagtctatcactaaaaaaataattagccgtaaatgcgagtattcatatcaaatctaagttttgaattcggatgagctggttcaccgtaagatgaaagatgtttttcatattcttggaatgcgatgcagtttatatagcccaacgtaaaaggctgactaaattttgcattggttaagtacatagttccatatgacgttgtttttaccctaacatcacaacattgttcaccagtttgctagtagttaaataaaggtaaatgaattgaggaaaacaatgtaaataagatgaggtaaaaaaaatcgtaaatatcacatcttgttcaccagtttgctagttgaataaaggtaaatcagttgaacaaaaaaatataaatcagttgagttgagcaaaataatgtaaatcagttgaggaaaaaaataaacataaatcattttggagaggatgggctcgaaccggagaaaaaaaacgattttgctatatctcactcgaaagattttttcttatctctcactcgattttcttactcaaatttacagtgcattttctggtaagttacagtgtaatttatgaaacttacactgtaacttttgtaagttacactgtaatttttgaatcttcgcatgtaaattttaaattttgtattggatttggtctttttattgaggatatggtaatttagtgtccattatggtatttcttaattgctttttgctttttattatatctatcggattttaatctaaagattaaaaatctgtgtgatacgattataaaaatctttcgaaagatgtataggtactcccaaaaaaaaaataaaaattcaactgagggcccatccgggttcgaaccggagaaaaaaaaataaaaattcatccgagggcccatccgggttcgaaccggagacctattgatctgcagtcaattgctctaccactgagctatggacccttgatgtttccaaaccaaacagtttattacttgatttccatatttagcaattagccgattcttaatgataaaaaataattaaaatctaaatgaaaaatcacatatttcctatagcagaataatgcgtgacacattttatgagaaatatttttatttatcttatacaatattatagtatatttttttagcaattagcaaacacatgcatttagctagccatctaaaatgcacatactccctccgggttaataatatttgttgttttggacaagagtatagtctccaaaaaataactttgaccattattttctgttataatatgtataaaagtattaacaaatatatgattttattaaaatactttttaagactattctatacatgtaatcaccatatttgaaagataatgattttaaaaatgattcataatcaaagattctaaagtttgatctcatccttatctaaaatgacaagtattatcagcccggagggagtagtacttttagtcaaaatattcattttacctatcgtgaggacatggtcaactccaatctataattatgtgtgtagggtttattgcgtgtacaaattaactgggggaccgaaatttcagaaagaaaatatttgaagtttgacaaaaaaaattgatagaatttgaacagatgttactaaattcacaagtattgaaattttcggaaaaatatagtttcgtaccgggggttcaaaattcccgaaattttaaaaatttcaagccgaaattgtaaaccctggatgtgtatggattggaccaaaccatatatatatatataccccgatcgagtacaaccaaattagtgttgaattcgtattatattaacatgaattatctgtaaacacgtacgtttggtacgactccaattccgagattcttatctcgtgggagctaaagctatatcaagcacttccaagatcttggataacataggtaaagctaccacaccgcttccaaaagttacactacaagcatggagcggcatattcccgccgctttctcagctcctctccaccatagtagctataccaaatacacccttaatcgatttagtaatctttctagcgatagaacatactagcacacagaagggagtggattttaaactgacatcctctcgttatttacatatcatgcaaataactacaagaaaaaaaataagataaattaatatgtgatatatcactccaccaacatgtaagttaaaatttaaatttacaagttgcaacataaaacaaattaaactatagatagtttacgtatacaatcaaatttgcctttttttaacttgtagaaattaaatttgatgttgcttatttatgaagtaatatatcacaaattaatctaccttaatgattctttctttaagttttttccataattattcgagtgacacttaaacaataagaggagtctccttaagagtttagaatatttcagatgaccaggtgcacacacaaaatagctagcctcctgggtatacacgtatgtttaacacgaattgttcgacaatcttggacaaataatttagtatagttcggcaagcaaacatcaaacaagacaactatgcatagatatactactctcgtgctttgactcaatatatacagcagcattagttaacggttacaaaggcacacgtcgacacacaacacgtaagagtaagagacgaactactaatccaataattccatgcttaattagtacagacaaaaccaacgcgtcaaaatgaaagccatctgaattaactggagtatcttccaactactaatactaattaatctaaccactaaagtctctttcattgcatgagataatccatggcttttcccacaaattcattcattcattaattccatcactcactttgcatgatggctgctagtggccgtcgacgacgacgacgacggcgccgccatctccacgtagttggtgatcttctcctcctcctccggcgacggcggtcgagtggcggcagagtcgtcgtcgccggccatgttgtggatgcggaagagctcgcccatctgctcgagcgtgcgtccacgagtctccgggaggtaggtgaagaagaagagccaagcaagcgaggcgacgccggcgtagaggaagaagctgccgccgatggtgatggccttggagagggagaggaaggtcatggagatgacgccgctggtgacgcggttgaggccgacgccgagagcgcagccgagggcgcggaggtggagcgggaagatctcggagctgtacacccaggtgatggggccgaggccgatggagaagaaagcgacgaaggcgaggatggaggcgatggacacggcgatggcccagccgccgccggtggcgtcctcaccgatgacggtgaggcctaagccgagggtgacgagggtggcgatcatgccgccggcgctggccagcagcagcggccgccggccgaagcggtcgagcgtgaacgttcccaccaggatgaagagcgtcttggtgacgcccacggcgcacgtcgtgccgagcagcttgttcttgtcggtgatcccggcgctctggaacacgcgcgggctgtagagcacgacggcgtcgatgcccgacgactgctggaagaagtggatgccgagcgccgacaggagcacgcgccggacggccggcgtcggcgacaggatcagctccttccacacgcgcctctcgccgccggccctcttcggcacggccacgacgtcaccgtcgaggtcggccgggatggccaccgcctccttgatttccgcgaggcgggtggcggcctcctccgccgtgtccgaggtctcgccgaggacgaccttggcgtcggcgaggcggcccttcatgacgagccaccgcggcgactccggcatggcgagcaccatgagcgcgagggcgacggacggcgccgcgccgacgccgagcatgaggcgccagccgagctgcaggcggaggcgcgagaaggcgtagttggagacgtagccgaggaggatgccgaagttgatgaacacctccgggaaggaggtgaggaagccgcgcgacgacgccggcgagacctcggcggtgtagacgggcgcgatcatgaaggcgtagccgacgccgatgccggcgacgaagcggccggccatgagcatggggtagttgacggagaggcccatcatgatggcgccgacgaagaagatgaccgcggcgaggatgatggtgaggcggcggccgatccagtcggaggtccggccggcggcgaaggagccgacgagggagtagaggttgaggatgccgagcaggatctccacctcgacgtccgtgatcttcatgtcctccttgatgaacagcgacgccccgcatatgtaattaatgagactgcatatgcaacatgaggctctctggagactggagagagcgtgtatatataggcagtactggtggctgtgtgtgtgatcgacggtcagagtaatcaattgatgacagtatgacatttggagcgtgtatatataagccatactggtgtgtgatcgacggtcaaaataatcagttgatgacagtatgacatttgcccattgcaacttgtttacttgtaaaggttggaacttggaaggcctccgtgccgagcccagctggctcgtcatccaccctatttggaaggcctccgtatcaactttgatcctgctaccatcaccatcgacaggtacacccaaaatatttcaaaaattcatatttttaaaaaaaatatttcaaaaaatcatattttctttggatccctcgtgggtttggatcccatgccactcgacttcattttatcagtttctcatggattctcctttccttgatttcccttttaccatcaaattaaaatctccattccttgatttttcctgtgcacttttgtttattttatgccatctagttacgaattaagaagcgggaaagctggacacatgtgcacatattgcctcataacaattcacatactgccatactgcgatacaaggcagtgcttctagcaattcagaaagtgagaaatcaacacaaaacataaccagtcgagttccaaattgtcttcagctaatatattgatgattcaaacagatgctaacgatgcaagttagaagagaggtaaatccataagtcataacaactccaactccaacactcaactatcaaatatagctgattctggcccagttctcttagacaaaggcgtttggacattgctaagagcgacgtagcaaagaggcaatcctcgacacaagactatatagataactcatttcgggtttttgagcacaatgatgaccgagtccccacgtaggaacatcttgctgatgaacctgtccttgttcactggaagagccttcttcttgcctttaccagtctttggtacctgcagcaagagtaacacatgttattactgaaaacagcactacactcaactggaacaaaagttcaaaacttcagataacgccttgcatgtacctcggtccacatctccctgacattctcaagaaccatgttgcaatggctatcaaatgccctcacacgacctagtaacttcttgttgttctggcaattgataagcacctagaaagaagagcatacacaatcaaaacaatgcatatctttagaagcatcaagtgtagtcaggagaaccacttatggtcggctaattctataggtaactcctaaagatacacttattaatataaccgcactgctagccgcaacaaagatctgaggtcggacccatacaatatacatcaagcagatattttcagagtttttgcctagtgtacacaaaatacagtagcagctatgaagaagtcagcacaaatttgcaactatggcttgttttcccacatcatacaaatgaccaaaattgacaaatggttacacatagcacagcatgataaagttgaggtatctaaagaaaaagacataacaccaagtgaataaattcaacatcctagtaactgaaagcaagatagcatatcaaggtatctaaaccaaaagatatcgcagggaatgaatgaattcaacatgcagtaactcaatatccatgacaaaatggcatatttcaaggtgtaaagggcaaagataggtgcgtgaattcaatccagcaactcatcttgctattgcaccaactcaacactccagtaagtaaccagactcagaaaatcaagtaaataatgaaatactaatcccacaacccacaacgattctggtcgccaaaagttcaaattaggactccatacgatacacaaacaagagcagtagagcatgttaaggtaatagcatggcgagcgcgaacctaagatatggacatacctagacaaaccatagcacaatccaagactactgtttgaactgataaaagtgaacaaaaagtaggtaattaagaactacataactaactaaaacagaaaacaaccttactgaagaagtgaagatagactaccacgttgcaatcaactatgtttcagaaaatgaagtggcagcccagatgcaacatttacactaacactacatgaaaagatgttgactatgaccaattattcagatacatgagaaaggctccattaatttaacatgacttacagagcatccttattggctaagagagttgagagaactacagttcattcacccgttaggagaagggtacttccttatttcagaaatccagatgttcatagacagttcaattgcaaacgaatcagcttctaaggaatatcaccaaacattcaaggcaaatcggttgccaaaacttttctaaggaaccccaacccatgagccagtttacaatctgtggctacattgtccattgctctgttgtaagaaattaaacttcttttgttctttgcattagatgcgataaagcttatcttatagtcattgagttcgcagatattagagttagtagaattgtctgatgtatccagttggaggatggagaaagctttaaagaaaaggataattacaatactgtggtgcccccacacttttaccactgtagataaaagtgtaccagctgtgaattattatttaacaaattcttgttttgccaaaaaatagcccaccatcagagatcgcacagagtaatagttagaactacctttaattcgtccctaggagtctgaaggccacctcaactccatcttatacttgcaaagagcaattcctgtaaaggggttatatagcaagggtgatcactttcgtactcagcaagtcaatagtagcaaaacatagatgcataaatgatacctttatatcctacatcatggtcattcatatttcatcatcaaatctaagtttattttgtaaaagggttttcaaaagggacttataaaaactaaaatacactcataacattgacaaagtttgtagcaactcctcgtacaaaagcatgaatcacgatttaatttagcactgtgcaggcttgtaccgctttacccacagctactctgatttttagggcctttgcattccattcgattgctagacttatcagagtacaagactttttccctcatttccatttactacactccacgacaccatatacgccgggtcgtctaatggggtttatatcatctcccatctatcactatgcattcgatggggttttatatcatctcccatcattgctacgcatttgatggggtttatatcatctcccatcctaactactcatagatggggtctatatcatctcccatctgaatactatgctcttgacggggtttatatcatctcccatcctcctacaactacatacccatgtggagtataataaacttaataaggtactaggcccagcccatcttgagacagatccatggttgatcggtatacatggttctctggtacaagtgaggatcaataatctttatatgtatatcaatatctccatcataatcagtctagcaaataatatcatctatattatatttattttatatgaataatggtttgatgcaatactaagagtaaaaaattttataaaataggtttttaattagagggagcgtatcctatgcacacaggccctcacgtgtacacaccgtgtacaccaactaaaaattatcaaaaaaattctaggaaaattcatacatatactttcaatagtattacatctacgtgcaaagtcgcatcttcaaattcattctacatagagaataacaaaaaagataaaattctgacaaaattgcaacctcaaaactgtcagattttttgtttttttgttacagttaaaatataatgaatttgacgttaagattttaaccctaggtgtaatacaattgaaagcatgtgtatgattttttctagattttttggtgacattttttagttggtgtgcacgtgtgtacacgtgagggcctgtgtgcataggatatgttgccttaattagaatagaaggatcatcatctatcaatatgatcaaagagagacttgcctgagtttctatagttttttaattttttgaggttaataactgcctagcatttgccgagcctgagtatctgtagttgaaatcgaaattatctagtgccgattgacccattttccattctagctttatgaaacttaatcatgatgtcattgttttccaactaattgaaccatgtgccatgaattaatattaatgatttctatttaggatttaattaagtgcgcgtcgtttcaaatatgcacataataaccctgtattaagctgatacccgatgggtgagagggggatctgactattcttatgttcttatgtaacaggagctctaaggtagtttatcccctcaattcagtattcaatttgtcagaacaagcaactcttagtttatcccctcaattcacagaacaagtaaagatgtaccttctaccatcctcgaacagagctaaaagagcatctgaattaatacttttccaccatccctcggacagagtaactgagttaacttaggctgagtttgagtaggaggagattaagaagattgggaagatacgcaaaacgagatgagctattagagcatgattaattaagtattaattattttaaattttaaaaatggattaatatgattttttaaagtaactttcgtatagaaactttttgtaaaaaatacaccgtttagtagttcaggaaacgcgagcgccggaaacgagacaagctcactcacaatcttctcctgccgaacgctcccttagactacttttttcttttctttttctcttctcttctcaacgtctcagttctcacgcctaggcaggaagatgcaggtgtgcggccgacggcggagcgggcgcggctgccggcgcagcgggcgctgcgacgcgcggggaagaagctggagagggggagaggaggc

SEQ ID NO: 6981 - DNA, 8512 bp, Oryza sativa
agcgccgcgcagatgctgtcattcggcgccctcggaatcaccaccactacgtcctgcagcgcctgcctttgcacgttcggcgacggctggtacagccggagcacctcgttcagcacgcaccccatcttcgtcagcttccccagcgccgccgcgtcgaggaggcccgaccgcccggccgcctccaccacctcctcccgcaccgccgcctgccactccgggtgcgccgccagcatcagcagcgtccacgacagccgctcccgctcaccgcagtgctcgacacgggtagcgacctcatctggacgcagtacgacgcgccgtgccgaaggtgcttcccacagccggcgccgctgtacgcgtcggccaggtccgtgacgtgcgccaacgtgtcgtgctgctcgccgatgtgccaggcgctccagagcccgtggtcccgctgctcgccgcccgacacgggctgcgcgtactacttctcctacggcgacggcacctccaccgacggcatcctcgccaccgagacgttcacgctcggcacggacgccgccgtgcgtggcgtcgcctccgggtgcgggacggagaacctcggcagcatagacaactccttcggcctggtcggcatggggagaggcccaccgtcgctggtgtcgctgaagaagaacgtcttgcactcgtccaccagctcccgcgtcgtcagcttcctctcgcgcccccgcgctcgccttgttccctcccagcagcagctacagcaggtcgttcgtcttcttcctcccgctgcagccgctggtgacgccgcgactcgatgatgtcgagcaggagcgcgtcgatctcccgccccagcttccacgcctcatagttggcgcggcacgccgacgaggcgggtggagcggaacagcatcgcctgcatggcctgcagcttgtggaagaccccagcgccggtggcgtcatcgtcggtgccgatgccgaagctggccttggcgatgatctcggcggcgttccagaccacgcccttctcgatgtcgatgcagctctaccccgacaccaccatgtcgctccactcgcccagcatcttcgacgtcgtctccggatggggagaggcgggcgctagccgccgctcccgccgtcgcgggcgttcgcgccggccgcctcctctccccctctcccgctttttccccgcgcgccgcagcgcccgctgcgccggcagccgcgcctgctcagccgtcggccgcacacccacatctgcccgcctgcgcgtgagaactaacaagatgagaagataaaaagggaagaaaaaaagatgtgggcccacatcattttctctcgctgacatgtgggccccatatatttattttattattttttactgactagtatgccacgtcagcaaaaccagtcatctatactgccttggatccaaattagacggttttgtatagtttaggggtgaagatttctggttttgtggttaaggaaccttgaaatcttgatgttaagttgagggaacttattcctatttacttccgtttgaattttaaatacacatgtactaatatttacagagttaacagtttcttaaagaaagtcttgttttatagaagtaattttataaatgtatttaataaaactaatttcagattatgacttttctgggggatgtcattggactatctttattaataagaaaatatagttacatcatccacgctcataataaagctaggggctggttcattgatccatatacatgattttcttgaaaaaaaaaagacctagccaattcatgagttacctggtttgcctctctattacaatactcaatagaaaccctatcaaaaccattatgtaaattgttgcaatcttcgtatatggctatcgatgccattgtcaagaaacctccatctaacataatgtcaacaacctacttacaatctatctgaataataaacttattccaaaccatgacttggtgctgatggaaaactaatttcacaagtaatattaaatgggttcttgccatgtacaatatttataagctaaagtatataagttgaaatccgtttctatttcgactttagaatctcaataagaagacctaagtaaccatactctatatcccttagctctagctttaaatactatgctttacatatcagatgttttaaaaaaattcttgctactaaaaaataccaaaaagtatgtccattgaagaatgcagcggcggtgccctgaaccatatctcccgcacattaaggacacacgttattctcctcctgctctaaacaaatcacagacaataaaaaaaagcaatggttgagctagtaggagctccgcttgatccggtaaatgagctaatatcaatctatcatgtgtctatgctcctaccctacctcgatcattgttctccttccgagaggctaagcggtggacttattaaacctgattggagccatgtttgaaaacacaacatagatttttctttttaaaaaaaaaaaagattttgatgccaatgagaaagggagatattagctttgaatctccctagccatctatacatagaatattctatgttatatggttttgaatagaatattctatgttatatggttttgaagtactaagttgaataaggatcaatatttaccaattcaagtactatgtacacttacgaaacaattcaaagcaacttactatcatagaggttctattttatagatatcgtgaagtatatttaataggaacacactgtctggcaccgtttgtaaaaaaaaaaatcctctatatctatccttgtgaatactggcacactgaaatttcagtttaagaatttatacactgataatccaaattacaaccacaagttgtggcgatttggacagaattttgttaatcccaagctaggtgttgaccatgggtcaacaatctcccatggtgcccgtggccgtggtgtacgcaacttgtccgcagccgcgaccccgacccgacccgaccagactcggcacccgctttctcattttttttttctttttgccgacttcccccctcagccgccacacgccccctcgccgccggcgacctcgagttctagggttagggtttttgccccggctcgccaatccactatcgcccaaggcttcggccccaattcgacgcccgcgggttcaattccgagcgctcccaagtcgaattgtccgcctccaccggtggaattcccatgcctctgagataaggattttgggggagacgcggggtgagccgggcggccatggcggggagctcgaggcccgacctcggcggtggcgggagcttccgcgagggcccgcagctctccggggcgggaaccccgagggcgctggcggagccgcccccgctggcgcagtacctccccctggagtcgttccccgtcggcgaccacaagcagtcgcgcgccacggagcttcggcgggtgctcggcgtcaccgtggaggggagcagtcgttcgggctggtgcagaccaagccactcccttccatagcgtccgaggaactcaagcggatccgtgggggcgtcgtggagtcgtcggccaaagccaagtacatgctgcttactagttactgcacactactgcttcaatctgcattgctcattaacccgcaaccggtgaaatgttgtgcagggagaaaaccaagtcgctgcaggattctattcagaagctggataagtacaggaacgttgtcacgcggaggcggcagaggagcgaaggaggtgcgactgagaggtcatcagggagtgggtcgggttccctgaggatgggggctcagaacagtatggataatcctggccagcggctggaggagagggctaagagtgcgaccacaagcaagcgtgtccgctcatcgctagcagcagatgcacgggtttgtacttgtgctactctaaagattcatccagggatttcattttgctcgtttgccactgtctccatcaatgtaaatagttacgtcgatactacaggattacagaattacaatcataagctgctctgttactgtaatataacaaattagtttgaactttcaactggtaattgggcatatgccgcatatcagtgtgcgttggcagttaacatggagtagcaatttaaattttattgcatgctaaaaaatggattccaaatgcaattggacccaattacgtggtcatggttaccaatttgagtgaaggaatacatcctgtgagtagacgtagctgatcaggttaatatggaatgtacttaagcatcctttttgcttattttgtaaagagcagctgaagcttatttttgggtcacttttatgtctttgtatctctttgttgctgtggtatccatgtgagcaatattatattattatatatgagagcacattttcgtcattctaaattcaacttagagctacctatgaggcatggtatttctttttgggcgttatcgtacttgttatgtatttactgtgcttccaattttccttttctttgactcttgtgatatatatttcagttagaagggcgtggtaatgttcctacaaggcaaggtcctctggcggacagtgagaaaagttcctctttggagaaggaaaaaaactctttgaggaatgtcaatgctgcatcagggttttctgaagacaaattacggggcctagctcctggaggtgaaggttgggagaaaaagttgaaacgtaagcgctctgttggaactatgctgaacagaggcaatgacgtagaccgagatgttaaaccgttggttcaacatagaccaaacaatgaagctcgcatgcgatctagtgatggtcttccaattaggtaactttcatacattgttgttacttgttaaccttgttatatgagttagtttctgtacagactttagcttcaaatgaaaacatcattgaaacgagacaatgaggtttactatgccacacactataatgacatcataggtggtactcctatgagcattgaggtctgtcatcatccctttaatgctgtgttgacaggcatggagcttctgctggagcattaggaggaagcaagatggatggaggttctcaacagagtaatgcaggttcccgttatctactgaaggcagacatggactccacttctcttccaaatgaaagaagagagcgccatttagggatagacaaagaacgggttttggtgaaaggaaacaagtaagcatagtaattggtggcattattttagcaatatatgctatgatacaagcacactgatttgcattttggaatgcctttaactctttgtgtgattggttacactgatactttgtatacgcagtttcttgtattttatgagtactccttttttgcggggagatgagtcctgttgaagtgttgattatttctactctataccatgaatgagaaatgatgtactgaatcattcttctcttatttagggcaaatacctctgaggatatgcaacctggaactttaaatcctctgactaagggcaaggcatgcagagcaccaagaactagttcccttgttgttatgaattcatcatccactcttcagcgctcatctggaggaatcgatgaatgggaagaaacaccatccaccaataaatcctctcctttgggaggcactgcaaatcgcaagcgtcccatgactgcaagtgggtcttcacctcctgttgcttgggtgggtcaacgtccacagaaaatgtcacggacaagaagagcaaatgttgtttccccagtctcaaattttgatgaaggcctatctgaaggatcaccacttgatgctgctgttagaccagcggtagagtcacctggccttttgcttccaaggggtgtagctagtaataattcacaagttacaccaagaatggataatatttcatctccagctggtctgtcagaaagcgaagactctgctgctacggaaaataagaacaaggataaaatcagtaatagtggtgattttgagaacgagggcgcaaattcagcccataattcagcagacttaattatctcatcgaagaaaagcaggatactgttaaaagaagagcttgaagatggaagtattcgacggcaagggaggagcggaagaaacactatgcatgttaaagggtgtgcatccatgccaagagagaagttggacagcccagaaacaagaaagctgctgaagagcggaagacctgtatctgaaaagaatgaaaggtgcttgatgattggaacttattgaggttgttagttatatgtatcctaatggaactaattaatttctaaattgattcagtaagttgggccgccctccaacgaagaagggttcagaccgcaaagcatcatctcgacactcggagatcctaaattgtgggttaacagatatatcaggtttcctgaaaggcacctttattatccacctaatgccttcgaattctataaggagttaaggatgttaagagtcttgacattaaactgtgtgtcataggtgaatcagaagatgaccgggaagagcttctagctgctgcaaatgctgcgcgcagtgccattggtgtgcaattctgcaaatcaaagtttcctatatgatttgcagagagctgtaattttattggctcatgcttaataggttccttatcctttctgcagttaatgcatatgctggtccattttggaagaaaatagaaccgatgcttactttcatcagctctgaagatttatctttcttaaagcaccaggttggattctgtttgcccttttgactttgcataagttgctttacatttttgcctgtttgggatgaacttccacttaccagaatctctggtcagattacatttttggaagagcttgagatgggcatgtctaagtcatccgatgaacataatttgaacacatcaactaactacagtgggccattatcaatggtattttgcctgaattactccactacagaatttcaacaaaattcttcaacctgtgtattctgttatatctccactctaaacttcatgcatatggactgatatcctctttccatatgttcttttcataaacagggtcaaaattcatctctgcctcagtcaaattcatgtgtgtcattggagcaaagcgaagcaaatggacccaggacaagagaatctattgatattttgtctcccaatgatgaaaacactgcatctcaaaagacacatgcagaagaattgtttggtggaatggcttccttgacacacaaactcttctctgcttttattgtagaagatggtgataattcttctgaatgcaatggaggagatatacttcttgagttctcaaatgacttccttccttatgctgccaacatgaacttagaaaatgattttgaagctagtgcagtaaaatccaactttggatcaagtcctgatttcaagcactcaaaccatagctcagtgcataacagcatgtccaatggttttacagcttccagcaatttgagggcctcatatagtccaaattcaatttgcagtgagaatgcatcggatgcgataaaatttgcagtatatccagaaaatggtggttttcatgaatttgtgccacatatctcacaacagtatcaaaactgtgcaaaaagtacgcctttaccaccatatgaatatcagtatgaccagttgcctgtgcatgacagagctttaatcgagctgcacagtattgacctttgtccagagatggtatggttcctaaaaaccttccattattttgtaaatttgaagaatatatactgctttcctggttataatgttatatgccaaggtgtttctcaaacatctcaattagcatgaatagaagttgagaccatacattttcttctgttgccagtttgttgctctggttctggtgtttaggagactttgatttcttatgttatgctatgaatgtagatgtagctttctatttatttgcattcctggtggggcatatgtaaattcctgttggcacaaggcacctagtgcatcaatggtgaggaaaaatatcgataaaatgtagatcaccttaagaactgcaaaagtagtgtgctgtaatttgcatttttatcttaaccattgttcttaggagctgcgaagatattagcaaaaactttttatgataataaaatatacaccaatacttcgattggaacagaaaaatactgaaattataactttgatctgagtggaaacagctgaggggtttagaggtcttgaggataggaaaggttagtgcaaggggttggacgccaatcagttgctagagtgactgttgcccctgttcaatcatgagttctactagggtgaaccagtggtgcttattccttgagagagagctgaaacaattttggtgcaaatctttgattcttgtacgaatgctccctactcaatattcttgcttgaaaaagaagtcctgacaattttcttcttccggtagccaaagctggatgatggagaggatgaggacattgataaagttattacggagctgcagaaaagactgtttgagcaggttctctctctctctctctctctctct

SEQ ID NO: 6982 - DNA, 10984 bp, Oryza sativa
atggccaaaactactgacacaactggtcgtgtggtcttgccaacttctctagcaagttaactgtgttcagtaaaaatctagcatgatttggggtggattctcttgataggagaatatgtcatagctttctcagtgccaagttttcaagcaagcaattagtagaatagctgagtcggtcttgaaattacttatacattgtgcatcatctgggtatgttatcaccacaaatgagattttcgatcacagttcagggcttcaagcgatcctgatttttctgtatttctcatacttggatgatattctttaggcttcaatatcacataaaatttgtatgagaacacctacatttcattgtgatgtttcctggacagtatttcttttgttacttccagatgtattctgggaaattgatgtgctttttctaagagttaacacctatttaacacttgtgctcctcgacttatttcaggtgaatcaaaagaagtgccaattacataagttggacaaagcaatccgtgatactaaaaatatggaggagaggtattaaatattccacccctatacaactttccattataaacacatatatggaagttataacagcaactaaacttggatttcaggagtctggagcaacatgcaatgaacaagctagtggagatggcatacaaaaaactgatggtacttgaatattcttttggttacattaccacttacttaccttttataagtgtttatactttacacagcattataggttatagaaacagtctaatttataccagacgaataagattaacatcttttttgataatcagattttgggaaaatatgctatagagattcagaatggccatcttatacgatctattttcaaacacctaatagattcctagtagctcggttttgaaaggcattaattgttgcttgttagctttacctgtacaactgagtaaatactgttggtctataatgttactttgtactaatgaatacacatacactttcttaatgttgacctgtgcccctgattgcatgccatatttgttctattttcacagggtggccgtggtagttctagtcataagggtggtctcaataaagctgctaataaggctgcaaaacaagttgcattggcttttgccaagagaacacttgcccggtgccagaaatttgaggaaacagagaaaagctgcttcagagagcctttcctttggaatgtgctgtctgcacctttgccaaagaatgatgcaatagatggtaatacacaaactattgaacagccaaacaagttgcataaaacccagttgttatgttacattaccatcaatataattttctctatgcttcaggtggtctcccaggatctgcagataggccaaagcttttaaagcttgacagaagtccattgagccaaggtatttcactgtttctagcattcttcaacaaatcctagtggaatatggcgtgcagaccttaagtagggatcattaatgtactacttgatgtttgttagaactctttcttcaagagagatgttaagcttctgctgatccttttccaggtactacaaaatggaaaaagagtgaccgagaaagggatcaaaacagagacgcgtctttgaagaattctaattcgaaatcaggacgcaattcgtccggcaatgcaaggagtgagcgtaaaactaagataaaaccgaagcaaaagctagcacagttgtcgacatctggaaatgttcttggaagagttacggagccatcaaatttcgcagcacccggccagagagaatcccatgattggacgagtacgtcgagcacaagacctactcaaccagtcagaaacagcgcagctactgttgcccaggataccttagatgctccattggcaaatttgcctgcaatagatccaatggacatcttggacgtgcctgaaggtaacgacatcagttcgtggtttactgatggtcttgatgattccttacaagattttgacttctccggaggcctagaaatcccagatgacgatcttacccaactgggattcatgtaaactgaaccggtaaatatgtacatgttcatattaattttaagtgttgatcctatgttagcactggcattgcttggttaccgtggtaacggtgactgattagtctcttgtgcccctaagggcagagcttgcaagttgcaactaggaattgattcatttatatatagcgtaaaacttgtagtcgccttgtcgcatatctgcgaccagattattggtcgtatgatgttttatctttctttggccaccaggaaagaaagccagcgtttattcacaaggctctctggagcatttgtggcacacgtcttgatatgatacgagtattaaaactaattagtaataaatcctctgatttggcggagcggacaaagctgtccgagtgcatttctcaagcagttaacagctaaacataagatgagagacgatgggttgtccctccctaggcagaacatcaaatttttgaggtttttttttagagttgaggggggaatgtctgagtagaggagaagatacgcaaggcatgcaaaaagggaattgagaagacaggagaggtggagtagtggtgcaacccacgtctgtcccctctctcgctgcagcttaactgtatctccgatccattcgatcgacgaccaaccacctctccataatatatccactcgtcttaattagtctccaccaattctctctttctctctcaattagtctacgacatttcgttctgtcctcgatcgaattaggaggttcgttgaagaagagaggagagagatcgaggtaggatatttgatatttctttcagatcagtaggtggcttgtcgcttgagcttgacaatggacgtggccggcggcggcgaggaagtcgaggaggtggaggcggttgacggcggcgagcagcagccgccgatggagatcggttggcccaccgacgtccgccacgtcgcccacgtcaccttcgaccggttccatggcttccagggcctccccgtcgagctccagcccgaggtcgccggcaacgcccccagcgcaaggtaagcgtcttcttcttctccatctccggcggccggcgcggcggctgacaactgtattattattatggatatggaatattgcagcaagacggtgttcggcgtgtcgacggagtcgatgcagtgctcgtacgacgcgcgggggaacagcgtcccgagcatcctcctcctgatgcagcggcggctctacgagcagggcgggctgaaggcggagggcatcttccgcatcgccgccgacgacgcccaggagcaggcggtccgggagcagctcaactccggcgtgctcccggagggcggcgtggacgtgcactgcctggcggggctcatcaaggcctggttccgcgagctccccggcgggatgctggactcgctgccggcggcggaggtgacgcggtgccagtccgccgacgactgcgcgaggctgtgcgcgcggctgccggcggcgaaggcggcgctgctggactgggcggtgcagctgatggcggacgtggcgagggaggagcggagcaacaagatgggcagccgcaacgtcgccatggtcttcgcccccaacatgacgcacgccatggatccattcaccgcgctcaagcacgccgtccacgtcatgaacttcctcaccatgctcatcgaccgagctctcaacgacgtccaaacctgcaacaactgatccatcaatataattaagcccaccatgcatctcgattatatatgatcactttaattatagcacgtaattacattgtcattcattcgtagcagggttaattaattaagcttaatcaaaattgtttgttttagtttcattttactttcgtccattactcagtttaattactactacatgtgtcgagagctgacttcttgggtctgactgtacgtagcatcgagcaaatcagctctgtcatgaactacatgcatgttaatcattttattccattctaagagcgtacctgtatggttggttggtctgttaatttgacgtttgagatatttgtgacttgtgagtgcatcaattctcagcattactgttcttttacttgtacagtaatataatcgattttttctacgcctgtttcaacaagaacttaaatttttctccaatgtgatgagatctcgctggtttattatatagtttttgaagtaatttggtgcattgatggcaaagtgcgtgtcttggtaagggaattgggccttgcactcttgcagccgcatatgggcctgatcatcaaagaagacttggtataggcccattaaactcaactgaggcctatcccgggagagtgaaaaagagcgggaaaattagtgatgacgccggattagagggtggtcttcacactaatgataaaaaagaagtgctggtcaatcgtagttttaacaggcacagtgcacaaacagaaataattgccacaagccagctgcgtgtgtcaggactcaggagaggcaggagagggagagagaaaggggaaatcaacctgtccaggagagggctggtaataggaataaaaaaaaaaaaaccctccagtgttcgtcttcgagagagagagagagagagagagagagagaggggggagaaagcgtcttcttcgcctcttatgcgtcctgctctcctcgccgcatcctctcgcgttggtcgttcgtcgcgctcccgttccggaggtaatcctacccacctctattttttttttatttcggtcgatctgccgtgcggcggccgaggcggttgcgatagggatagggcgattctccgatcatgggggtggcaggccggagatgaggtcgccggtcacgcgcgcacccaccagtagcacggcaggctgagcgctaggcgccgagctcgagcaagactgcgcctatctaggctcgagttgggtatgttggggtcggtcggattcggctcgtccgagcttttctcgagctgtttttttttttttgggatttgctattaatcactagtgtgaaaaattttgggtttacactcaaatttctgtccacttgatctgtctcaagatctttgctgcatttgcgggttcagtccgtgtttgggccgcgcccgcttcgtagttttcgtctcaatcggcgcgtctattccttttttttttccttcttgatacgcggattctccaaacgatagctccgccggagaatctcgtcggcgatcggcaatgtctcgtggcggcgggctgtggcgacgccttggcgcttggtgagttggccgcccgtgtgtgtgtcacaagtcacaaccttgaatgaagttatcttccttggctgccggtgaggtcaagtggcaatggcatagacgccggcagccggcgagaaagccacggcgttctaggggtagttgacgaggtggtcggtttgctgctgtggctggcggcaaggcacccacgccatttgcagcggcaaccagtgaggcaaccatggaaacttccatggtaagtcacgttctttgccccccctgttgttttgctcttgttgacgaccatgagagcctggtagatctaatgattgtgtttttctccccctctaatctgttgctggggatggagttagaaggtttgtgatagctagctggataaaatgatttgtgtattctcctcagatctgcttctcagaagaatggatttgtggaggttgagagagtgtcagcagactagcatttcattttgcaattaccagaccactagatttctgatgtgaggaagtatcattatgtgaacggcaaagcattttgttgctgccccttttttatctttatgtcaaaaaaatctagtggaattgggcagcatacatgatcctaaacattagaacgttttgcatgttgaaataaatttactatcttgatttagatagggtgataatttttgggatcagttttctatacatacctttgtgtccctatattttttttcttaaaaaatatttgtttctataaggtttattttcttggaatgtcttgcctcactacaagaaacagaatgtttccaagatcaagcctttcatgcagcacttgcctgcaactaggactgtagtaacaagttactccctccattcttatttagttgttgatttgagctaaaatacactgaccaaagtagcacttaatttttagtattgtgacatgattacctctaattactctccctgctaaaatacacgttttgcatttgtgatactataagcacttgagcatggtttatttgacaaattaattctttgaactgcattctcccgatggttgtcatgttcatcgaaatttgttcagttcccaaacaaaagctttgttacatctaaactttctgttttgcttttgctgtttgccttctagcatttgtttgttctatatacgagcacttgaaacaactagctctgttagaatgttttgcagctaaaactagttaaaactagttctcgttttgttcggggaaagggcgaggggttgaggtttgacaatttctcccccttcgtagcttccttaatatagttagtattgttttctacgcatctaccaagaacaagaatacctagttttgtaagcaaatttgaattaaagttagataaggttatgttctgtttttgttattcattctccctttttatcttcctttgttaagagtcgagtgcacctgcatttacagaggttttgattgttgacattgtagtagttttgtggattgatttgttttgtttgaacaaaattagattgttttcactgaaacatgattagcaaaaacttgtttattattagagatgtgtacttcttctaatagtactttgtagcagcagaagtaggggatcaagttagtttaaacctaaaatttgttctgttaaatatttcattaacagtagaaatgtagaaatttgtgttctgtgatccaaacatggaattgttttgttatttggttctagttttacctaatgcagtggatgaagaaacatattgttttttttaaaaaaagttgcttagttttgtcagccactaaaattgcttagttctgtcagctcttaatctgaatttgatgagatcaatgattctatataatccatatacctaatttagcactgagcatgactacatgattactcttgttagcaaatttcagtcacgtggcataattttggggctgtttgatagccctatggaatcggcatctatgaaatgacacacatccaaaatttctgccaacagttcattttgtgaacaaattagaagaaaaactatagtgaaagggaacttgcagtgggggatgaagcacaaaacaaaccattttggtatcccagatcacagcacaatagcagtcctactcaatcaaaagcatcttccaatcttgtaatgtgcattttgtgttctctcttatgtttcctgtgaatcagtcaccaatgatgcatatgcaagcgcctcaagcatgctcaaaacatcattagtatcatccattagtattgaccagatagtccttgctttgcttctagctagttgacagtgcatgcatatcattgagagaacaaaatctgcttgtcttctattatctatcagcgttgatcagcaacaaatcctttgttgttacagtacctagtatatacctgttggtactgtcttttgctagtttatcttactactagttcaaatcattttgcaatccattcagtccatccaagtctattgcatccttcaatttgtcgaagttatgtcaatccatctcttcatcgtcttttctacatcaccaattccctgtcagagttggctttcatcatcaccagctcccagtcggagctagccttcattgtcacttcatcatctccacgtcggagcttctcgtcatcatcatcatcatcatcaatcagtgaaggtccgaagaacaatttgtgaagggccttcatcaacatcaatatctcatcatcagtcaaaggaccgaagaatagtttgtgaaggttcattgtcttcatcatcaacaacatctctgaatcaatgaagagccgaagaacggttcgtgaaggcttcaaggtaccgagggccgaagaacagtttgtgaaggttccgaggtccacttcattgaggaggggatacatcttttcttcttcatcatccaagaattggctcacttcgacgacatcatcaagactttggagataggctaatatttagtttgtgttctcttgtttagttttcactccaaatgcaatgttattgtatacacattacatttgagtgggggtgttaagaatatatgtattagtgtgtttgtgttaaggggtatttctatctttttgcgttgtactcttctcaacatattagcccttagggccaactcaatggatgaatagttcaatccccaaatttctctcctctctcaagaattcacaagacaatcccttttctttagaaaataaagtcggaaattttaagctacgcgggaagcctctggcagtttaggcccctctcattgtcgataaactaatattaatggacacttatatttattttgtaggatgatgaatagtgatatccaaacccgcaaagaattcttccgtaaggctacatcatatggagaatgcatagttttggatcataagcggaagttaaaggattttgatggaagtctcttggatctcagtgaagctgaatatgctatcggaccactacattcgaaatgtctcgtaaaatattttgataaagtggatcgtaaaaaggcaaatgcatattctttgctgaaaaacattcggcatcataacatcgtgtttctaaaaaacttttttgatggaagtggccaacccagatttgtatttaactgggtagatggaagcatgagtgcatgggttaaaaccgaaggtgccaaagtacttctgaagagaacagggacgggtacctgtcgaaactccacaatccgtcagcttgtaaggtagtaagttaaaaaaacaatttatggaataacacgttgaatagaatgaacaaaagatgtgttttctttcttagggatttgtgcagtggactggaatgtctatttgagcatggtatctatccaattcaaatcactgccaaggacatctatgtgaaaaaagttgggaaaaatgccttggcgcaacttcttatcgaagaaggtacctacccatatataatgcattttctgctgctctgttcccttgaagaaatttcctactgtaacacgtttttgactgaactagtttaccttcaatctagcttccatgccatgattgagttcctctctaaaatatgtttgtgcagctgaagctttgccaaaaagtgatgctaggaaaaggcaaatccaggcaaatctttggcatgaaatgagagatgcggtgaagaaaatctttgctgatcatgtggattcccccaaagacatgcccctcgtgagattccttgattacattgcagagggcaatgtgaagacgctacagaggtatccgttggattgggatgaaactgagaaggggaaatacttgttgaaggtcttgtgtatgaacccacataaggtagagcaggaggttaacaacctcatacagtggccacctgtgacctacttggggaatttaccatcccctcttcaggagatgataagttatgaccaaacaagaagccacccatctggttacgatgataagaaaccatatcactacctaaagctgtgcaaaaatataatcaagcattggtggctattgccagaaagtgttaaggtagtgaaaattgaaaatattcttttctataatttttttattctgatccttttatgtgtcttacaccttaactttaataggtggaatgcaaaacatggcaaaggctcatccaaaaaatggaaacatgggatcctaagatatggtgtaagctttacgagacattcggttgatcaagcaggtacttatgctccaatatctatataatataaccttttccaaaacttgttgcagtagctaaggtaatggaaaaaaagatggaatttgttcagatttagagagcaacaagtggatagagggctgtgaaatggaataaaatccaacatggttgtgaaaagatacaactgaatggggaaaaggacaaactcatttggactttaacaaaaaaatggaatgttcacagtaaaatcattctattctgctatggaacttcaagaaagtggctatcgttttaaaataaactgtggtaatttaagatgccattataatcaaagtgttgttgatgaggagttttgctctatctcttggattgaatttgacaatgtgtcgtagcttgctgcttgtttaagtcatctaggcagtcaggctatcagtaggggtagatttgagggtcagcctcttttctgctttgttcaaactttgtagtctcatttctgatatatggaaatgggaggggctgagctcctcttgattaaaaaaaaaagtagtaagtacttatgcacccctgttccatattttatcaaaatgttctgccacacgattccatgtaaatattatagttcattctttgttttacaggaaggcaaacgaagctgacgatgggataggcatatagcatgtttttactccagtgcagcatctgagtcgccctcttctttctttctttgtggtcccatctgtcttgaacagccagttatgtaatgttactccagaccaggatgttcgaccttctgaatctgtgttcttcttgttagtaacaccttgctttagtgttaaactaaaatgcttgacacatagtttgatgattgatggatgacttttttttcattgcctgaatattttgtgttcgagagctggaagtctggaactattcagatttcagggcttcgggggtacttatagtacttcttacttacatcagcgttatactattgctgtgctccagcatttccacgatgttattttgtggcgtgcttcttctggcgacattgctcccttgtggccatgacacatgc

SEQ ID NO: 6983 - DNA, 58880 bp, Oryza sativa
gtaaaagatgaaatgagacattagtttcatgagcatcacatgcaatcaccttagtaacactttggccaagttagcacaaaaatgaaaccatgcacgaaagaaccttgtttccaagtcaatcgatgtgagtgctattatagacgatccatgtttcttccacaataacatacacaacctagtgattgtgcaaatgctacaacgaagatctatatcaaccaggacgtaccagaggagatataagaccggtgcggcgggtagacctaggagggcagacctaggagatgcgcagaaccaagctggcgagcagtgggagctccttgtccagccagccgggctctgggaatagtcgcacggatatcaactggctcttctccaacaacatggacctgcattttttttcttcttttagccatcgaacaattgacatgagccaagattcaatcaaactaacaacaaatcacacataattggatcaaataggtgccagatttgataggatcagggcataggatatgttagcatatttcaattccaaaatcgtccatatagagggcaaataattcaacataaatgatgagcttaacaacaatagggaggcaagtaagcaatgaaaggaaacactaacctgcatagtacatggaagatatttcccatcaaatgtgaccacacgatcttttccatcagcaccatgtaccttgtttttccatcagcacctacctagtcaaccgaacagtagaagtcgatagctgacatgctgcagtaggaagcaattaccctaatgcattattttttttgcaaaggatataagcatgtcgaccaaaattacacagtcagtagcctttaaatacatactattagtccgcatcctaatactcacatttccacctgttaccaattaccactattgaaagaatatagtgattgatctagacaacgaaatactgaaaccccaggggtgggtggctttatataattttttgagtgaaaggtgcttactttacatcagttctcactatatacaaacctaagcttatcagttcattaaccgtatcgcgtgactctgtattacatggacaaatagaaaatagaatgcaataggcagaaatcttacatttcattgccaaacttctcatcgataatttctttgatgctctccacaaaatgtacaacagatttattcaacctgtgtccaatatataataaaaaaacctattaatatgaattgccatcttgtgtatctaagcaagaaagcagactgatcaacataatctattagaaaacaaatagaccaaattagaatccacctagcttatgaatatgatagcaccactctttaatctatcttaagaaccgaaggaaatcaagcctagaatatagatgacaatcaaattttagacacagagaaagatccttttgttgcgtacagtgtactacgctgccaccatcacccataactttatgtgaggcaccgttgcttctagggatgaaaatggccgaaaacaatatcattactttattgtttttgacggaaacggtcgggaaatttccattttcttgaattcaactatttagtgtcaacttcaatgccactctgacaaaaattggaaaagctaaattttagacagcaacagtcagtaaaattattattatcatattagttttgcggaaacggtatcgatgtggtcggaaaatttccatactattttcaccctagccgcttcactacttctactgcttacctagtcctgactgcaagaaagcacaactacattcaagataaccaatcacacatgtcattgaattcatgatttgactaaagatcattttttttatgaattaaaatcttagacacaaagacatgaactctacctaaatgatactatagaattgcttggaacaaattatatttacgcatacttagttattagtaaaagctacagaaatgtacagcaattcaacatcaacataggtgggtttcatgacatcagtttgaataaaaaaaattgacgtagcaaatgcctatattcaaaatagtaataggtagtaatatggtggaagaacaacattaccagtgcacaaccctctccgcagcttccaattcatacatgtaacaaagcaattgtagcttgcatgctcctcttctcatcaggccttcctcgcattgcctgtcatcttgacagtgacaagaacctactctgccactagcacgcaagcctcaaattcatcggttgaccaacataggaatcagctactggattgataatctagttcaatataattatatcttatcagctagcatacaaaagcacgtagatagaaaaagacaaaagagcagataacttacaaaaaatctataaatctcttgctgcaggttgcaccacctatgatgaatggctgaggatacctataatttttttttaagataatagatgcctgtaggtagcatcctccaatccaaacatagcttttaaaaatacataaaactggaaggtatcacaaaactcaacagtaactacttcctgaaacatacctgaatcacttagtaagaaatccatccccaccacactatccaacactgaagatttaccaggattctgttgaccataccagtaaagttcaaatgtcaaattacaacattacttttccaaccatgcatataggaatgcaaacgtgcttaaaatattaatgaaagcagtaatctagttgagaaaatagcactgaactctgacaagcttgacttggagtggcttgaagctgatttccatgtctgcccggtcgtccggcaaactcaccagcttgctgtcaggctgtgacaaaatagagaacaccacaaatttgcacagtttgcatagaaaaaactgaccatttggagaaaatttgcattgcaaggtggtaaaaataggtactttggggacctggccaaggtcctgcaagaacttcttgataggatggccatgatctctttccaatttgggctcggtgttgtgatgcagttaacaggctaggaaaatgcatcaatgaatgaccctgcatttattaatatgaaagtcagttgtaatgccactttaatctttaatatctgcaattgcttgcctctgcagctcactgaatcaagttatggaaaagttcttcgcaacaaaactaaaatgttctagccatttaatgaactctacgaagcatggattctatcattaaaaagaagtaaagatgtaaactgtgtataaaaagaattgcaatacagccaacacattcatagcgcatgacccaattcactcaaagcaaacaaaggaagcgaaaagaagatggaaacatatgcaaatgcagacacatgcagcaactgaaaccaaaaaaaaaaagtccataaattggaccacgagaattccccgtcagctaacaatcaagcaaaccactgccggaatcaagcaaacattgaactggccagctctttcttacaggaattcagcaagagaaaaaaaagaaacacaaaaaaatttaaggaacacacaatgacagttttacacaaaattagggagggtaaaaggaagttatcttaattaagtaaatataaggcataaaataaacaatgtaaaattatccttgtcctgaaaaggaaaattagcattctatcgtaaatgcaacatgtagaaacttaaaattagccgcaccaaaccatgcctcctagaaaaatgactctttgacagttattggtataatacccatcacgatacttcagatgagacagggatgcaaagtataaacaatatatctacatataatagctaagctcacctacatagaatggaaaggcagaaaacaatatcataagcaagtccagatagcagtcatcacgtcaacaacattagtcatcctgcttgatctgaaaaagaaagcaacaactgtttagcatccaagaattagactgatgttcagtctcaaatgcaaggaaaaacactaaatgggttactaatataacagagcattattctagactatttccatctaagaatatattgcatcaaaacagaaacaaggtcgacacatgaataatttcttagcactgtagtgatgtaaatggaatctagtatatgacacaatgctactggtgtaataggacatcctagctaggaaatattactgctgccttctaatcatcaccgaataaatagacaaattatgtaaccttgttttttccccagctgataaaaaaccctctatacttcaaccaaaaaaactattccctgcagatgtgtagaaaaaaaactaagtagatgatacatcatgatagtaacccttttctcttgtgagaaggcgcctctgttccaatgatatgtatggacctgacattgacaatgatgcaacgcatatcatcttgcaaagattggttcaaacacaagtagcagttcttttttttagatggtacatagataacaaacaataatgatagctctaagatgccaacaagaaagggatggaccaaggttggcacaaccctttatgtgctgctgatcccttctgcccacctacgtatctctcccttattcgtatgctttttatgatctagtttttgtttggggacacagatcctctgccattgtgtgtagtagacagtggtagtagtattatcatgcacaacacatggctctgacaaaatgaatagttggtcatgttcctctcagacaaaaaagaaagaaaatccaactcttttcggttctggaccctttttgctgcctacccatgcccaacaacagaggatccttaattgcttcctagggtttgttttttttttctgttcaggattcatctagttatgcagctattgatccaattagtttgcttattgcgttgtcatcaagctgaaaaaaatttatgtaagaggtttcaggtatacaggcttacttccagttggtgaagggcgagagggcactcgctgaggaacttgatggtgagcatgatgagaaccgggacggagtccttgcgggtatcatgaggtcgatcatggtgtcagagatgagtttgtcggtgagctcattgctgccgtctccgatgaggacatcgatggcgtcccgcggcggccctccttgccctcttgtcctggatgatcctttgtatcagcctcgccatcttcttcttggcctgaccaccaccaccacacacacacatcccaggttcagatttcaaaggttaacatgtaacatctccaattcagtgtcaataaggttactgctgtaagcaaacatgtatttttccacacactgtggttgaaacaataatacaagcatttatgttttttcaaataaagtcctgaaagtaaaatgagcaatgcaaaaagaaatccagatgttttctatattgaaatgttctttttgctacaacatgacaggccttacatcaagaaagttaacacaaagaaggtaaatatgccccaaaaaattatatttccactatggtaaaatttcaattaaataatgtcaaaggttaatcagtgaaacatacaaaatcataaagattcaacctgtgaaggtgaacttgcccttttaccaacaggatgcctttgtctactttgtattaaaatacaaccattgtttaataaaattttaaaaaatgtgctactgaaagtataacaattcccatatgttgataaacaaaattgaagcagggactgccaatataataatccattcaattaatggtccaaaaatggcagcaagccagcaacgcatgccgctgaataaaaacattaaactgaaggcccagacaaaatgagcacctaagaaaaaaagaccatatgcggataatgaagaaccataagactgaattacttgggatgcttgtgcccacaagaaatctcggagccacccattaatcgtagtggaactctgtgcaaagtttccccctgtgatatgagttaccaccccttgatcacttatagtaccccaaacatccgattgcattttccaactgaaatggaaaatgactaccgaaatggaattgtacatccagaatagacataagaaaacatgatcccaggcggatacttgatatgttccccctcgcccaagccaatcgcaagggaagcgaaaaccaagatttgctttatcgggtatcaaacggaaactgcgagcaaataaaacaactttcaaaagtattaaactcaccgcaagttatcttgctccaattgttagcatacactgtgaccaattcaccctacaatgaagaagagcgactcatcaaattaacatgcatagttcctaggtgtaattactgccatagtaaaataaccatgtgtctgtggtgtggataattctgtttagaagttcaagcccatgaattaacaacagatttcaagcacactcatattatcagtgcacaagcacatagtacaattatttctctgcagaaaaataagaataggcagacattttattcccatgaacatacactgacatatgcataacaattaatcattagcagatcaatttttctatctatgttgtccttgagacatgtgtgtaggtgaacatacactgacatatgcataacaattaatcacagcatgatgtttactgtagtgagatttcaattctatgtagaaagatctacattttcatcatattggagtcaggaagggtacaataacagcagcatatgcttagataaatggataaattctggtacctagaccaacattcaaatatactagatactgggacgcgccacctatacacaattcttgttattaattgtttatacagttaaataacatataacaattagaaatgtacaaggcgagagacgaagaaaggaacactcacaattttgtgctgaacttattgaagaaaaaacatatagatacaaaacaaaattcacgagtccagcctgacgttaaaccatgtaagcagatgcattggcttgaaccctccattttcaaccaatttgtagtgatatccttttgggtggggttgggtgtgggggggggggtgcatgctgggccagccagtgtcactgacaaaacacaagtaaaatggcttgcaacaaaaaatatatttccacattttccttcttaagtagcttgcaaaaatatactctagtcagtttatctggtttactgcttcaactataagttaagtcccttaatttgtcaacgaatccgatttcatccttcaaactgaaaatcagatataacaggtatgtggcatatgaagcaaaattaacaatttaaaaataaaaacaaaatatttagacccacatgtcagtcaaattataagattaaaaataatggaccccacttcctccacttcatcatctccctttctcttctctatctcctccccttcttccccagatgcgtggcattggtgagagcggaggcgcaacggaggccggcgagtgggggcgtgacggggagggaggagcttcaatacggcggaactataaaaaggccctaatcccaaccaacacctgcatgtaaccaacaagtgcgatgaccaaatttttcgcacgaactccacagcgcttcacgatctgaaccaacatcccgatcaccgatactaaccaaaacgaaaacgacctaactgcatctccaacaaatcggcgagatctatatttccacctaaatcttccatagcctctcacgaataatcaagatacatttgtgtaaaccaagcagctgcaggttgtgatgataagttttttctatgatccttgtccttgtttgttttggcggtatttgtgattatcagtgatatagatgattggggggggggggggtattatctttatatgatcatcagcatgtccttgttatgttgttaggaatagtatgcgtaccttcaaggtcaacttttggaggagactgtctcagatgaaggctgatcacgagccgtcagcgagcaacaagagactccctgttattaaccataattacaaaaggtaattatttcaatcagcatgagttattgttggctgtgtacatccaatcggatgtagaggccaggttaatcccattttctaaaaaagcatgagttattgttgcatgaaactaattatcagaagcatatcataagagaatatatatgtaaacaattatgtatgtcgcctgagtttgataaattccttctcctccctattagatttatcttttattccactgatgggaagtcttcatatatgtaacattctgaagatttgttcttcatatatgtaacgttctaagaacaattacctctaatcaagagacagcataagcatatgttgttcaatttgcagtaaacggtatgctaccttgacgccccagatgatgaggcagaagatggtgaacaggaggacgaagcactgaagcagaggaatccgaggaggatctggcagcggcgggagatgccgctgtcgccagcgcggtccttgtccggtccctcgtgcgctcgccggacttgcgggccccgtcgcggagggtgccggagaagcggctgacggaggaggaccggagtggcgacaggatgcggccggcgaggacggcggagtggcggcgtgcggatggggaaggcgaggacggcggcggggcggcgcgatgtggaccgggaggggcggcctgcagcggggcgacgcggcggatgggaaggcgaggacggcggcggggcgaggaaggagaaggtagttgcattttttttacttacgcggacgcggaggagacagtcagagcaatgtcgtccgttggtaaaataaaaataaatcagtactctcttcgtcccacagggattttgtgataaaaaaataaaaataaattagtaatcccttcgtaccacaatacaagggattttgagtttttgattgcaacgtttgatcactcgtcttattcaatttttttttacaaatataaaaaagggtgaatagctaaaatggtccaccaagttttatctgaggctcagtttagtccttaatattccaatctatccatattagtccttcaagttttcattttaattcaaacttatctttgaaccaacaactctctttataaatgacacttatacccctcatcattcacatatataagagaaaaattgcatgcttaatttttttatagataatacacagtatattatgtaaaacgaaaaaaaattatgtactaacaagtatatacgatagcaattgcttaagttttatgtgcacatgttgaaataatgggaagtacatctgtaatgttgtttatttatgtttgctttctcttttctagtatatagatgtatacaaattaagggcaaaaaggacattttctaatagaaatattgactagaaaaagccatatgacatattaagtggacccaaggatgatttcaagccaaaacaaatatttgaaggacctatgtggacaaaatgaaacgtgaaggaccaaattgagccttcactgaaacttgagggactaaattagctattcaccctataaaaaacgaaaagttgtgcttaaagtactataaataataaagtaagtcacaaataaaataaatactaattttaaaaaaatttgaataagacgagtggttaaacgttgcaaataaaaacttaaaatcccttatattatgggatattatgggatggaaggagtaatccatatacgtagagattttttgagctggtagtgaaaagtggcaaaataaaaataaatcagtgaacccgaatggcaaatcatccaagtcctgactttgggaagatggcaattggcaaatggagtagtccaaaatcccacactcgtcaggcccgctagggtttcaggcttccgaatccgagcagctccattccccaaatcgcctcttgtctcgcgccctcccgccccgttgccggcgacgagcgctgcagggcacagggtgctcaggctgcagcttcgcctgtccccgccatctgccggacaccaagccccgccccaagtcctagcctgccatccgcccgccgcccgccagttgctgcctgactgtctcaactgttcaccgtgcgtaccctgcaggtatttgtttgtttcgtgtgtatacctttagtttttggcgcagattgtagtctgcagaatcgaccctacttgtcaatttcagggctaaaatttcattgttgagtcagtatgtgctatatttcacattgtttttttgcaccatagaataccgttgatgtgtcaggaaccaaatgattttggttcagacaaattcgaaagagattcaaatatggcaattagctaactagtaggaatcctaacacagcaaataattaaaattgtaatgctgaaattaactagaatggaaggaaatatatgtgtgcgccgcaagaacaagaggggaaattatattagggttcagattcgataaagagttacagccaaaacacggggcttatattgagtacgccctctgctagacgacaacgacgatgacgtccacagtacggcaattcttcccctctgtagcacatcgcggcgaatcagggccacccgatcttcataacccttccaatgaatcggtatctcacaatctcagccgtcgattctactacagctatcccccttaactctgaacttccaagtctgattcttcttcaggcctcacatgatgcgtgtttcttttgctgtaacagcgtagttaagatgaatcaactaccatggagtctttcactaaaatcaagacttctcttggtttgcgatgaaaatgaagtttcaaacatgtattcaattacttttgctgttctggcctgttcatggtgtgaatatcgcattgtaaatcaattgaatgacgatcattccatgtctaatatggcagacatttacccatgaatggctattttgttggtgctcgcaacgacttcctgggttatatgctccagtaatgtggaaacaagtataaaaccttgtctgccgtatgcttttatcatgttaacttgttagtagattctttttcttttttaaaaaaaacatggcagatatcaacagttgcggtagtaatttcgcttcatattattcactttcttcgattggtcatcttgagtggtttcctctttcttggttacattctgctactgtgttgttccttcatgcaagtgtactggtcatctttttttcccataatgatgtttgctgaattaactaggagcttagcctgttgtgttttgtgaatgtatccggaaaatgaataagattttgtataaaaataatgaactgggtatttttttttcaaccttctgagtcctttcatgcaaacaacaataattgttttctcttgataacaaagcatgaactcctggttatcggtctgtaccttgttcagtgcctttcataattagtttaagaatttctaatacactggatgttttagaaccttccattactgggagttgcaaaagttaattgaagataatctaaatgaatccctttattagtgttgttctgaaaatagaaatgataggccattttcttttctgcagtttcctaccaaagaaaggtgcttaacaatttgttgtcacaaaccagaatggccccaggcacatcaggtagtatgcccacctcttaaatatactgcatattttttaatgtcttagtattagtatgtacctttgcatttttgtgcagcacaaatggtgataatttaagcttccattagtgaaaatttcttgttttagagaattagctcgtatagaaaattataatgacttggttgtcattgaaactgaagttcttttaaaatttactttaggtcagccggagagcaaggggcagaaaaaaacggtacaagtctaattctacctcttttttcatataaaactttcactgaatatttttatctagcaagaaagtatgaatttgcagattaacattggttatgaactggcgcatcaagcatgggacttcaaaatacaacaaggaagttgcagggcaaaaattccttcaaatataccgcggcagtatgatcctatacagaaccttgattctgtgttaatttttgatttgatggataattcaaatgggcttcactgcttggagattatgacaaactgcctgcataagaacatattgcatgctccaattgttcagaagaaggaggatgttgactgcatttctgtatggcatgagccttacacaggcaatcttcttgcatatttggaatctactttgttaggggccaaacatatggttggggaaaaggttgtgctcccaacacctgtgctacagaatcttataaggtgtgtctttgttgccagctttacgtaatgcattaagatatataaagtcatgtaatagtattgttgttttagtcaagtttttgatggattgaagatgctgaggctctgtgggaaataccatggaaactttacacttgagaagacatactattacaagaagaatggaaatgaaatcattgtgaaacttgctaattttgaagttaaaggtaatgcaacctatcgaccgttgagatacaagatcaccatttagggtagaaacaagtagagatatgtaagcacattatttagatgacgttttcaatataattaatgtttcaatttcagatcaggtgaagtctactccagtattgcaagctaaggactgccaggctgttggtgatgcactcagaaagatctcaaagatggctaaagatcgaaaagatcttgattttgattgcagtcaaattgatagccttgctgaagaacttagggagttttccttgtaagtataccgtgattttctagagagttaatatcagtatatgttccttgtaagtatatgttctgatgtgtggttaacttgttctataatcgcaaatctttaaatttcaaagttagctatgcctattgtgaactgatgcttgagtacctgtctatagtttatctactaaacttttgctttgatttgaatcatggctgcttttggttagtcaatgctcttttatctgaggaatcaattgatgattgtgtaatttggatggtcttgagtgttcctaattttggctaagcagttcatattcagcaatagcatctttgctgtaaaaccaagaacaatgtaaatgatcattgtttcgtactttaggtagctaactgcatgccaaggaaagcaggttcctcacaaggatatctccgaacttaattcctaagtttgtgaatagtagattttagtcgtttattttaaaggaggttggtcaatctagtttagagcgtggaatgtttcaatgtcaatggtttttgtttatttccttcaataccgctcatggatcaagaaggcttatcttaccgactttagtgacttaacaatgttttctgcagtggttgtttacctgctgtaaatattgctgatagcttaagtataggatagagacctagatttcatgattgaattgtaagaaatctgtgcttgaattaagtgatgccaatgtgttggaatggccctggcttgaattaatatgggccatgagaaggaacttgcagctcttcagtgtagctttcatacgcttcaagtttgtttccaagtatattgtgagtttgattgtgacaaaacaattggtattctaaaaccaatagcctctaggtgaaagcgaaatacttgatagttgaagtgaaacactgatgacataaatagcttaacaatatatttttttatgcgtgcattcgtaatgagagcactctctagcaattaagagtttaatgactatctaaaaagctatattcatgaatggtggtgctagactaatgatatattgtttattttatagcggggatttatgcaatattgagaaaaagattggaggccatcctttcttttgggtttttgatgatagaaagttccttttgacttgctcgattcctttggccatgaacaaacgcgcatttcgacaaaagattgagggcaatgaagatttgattgctcttccttgggacaaagaggactatgatggattaattaatttgatgatgaagtacagggcagatcatatgattaaaaagtttgatattaacagcagagttgactatgtgctgtgtgtaagtggaatgtatgctcatgaaaaggagctgaaggtattacatgttttaagcaaataaattaacttactttaattaccttctggttacatgcttgcagtaaataaaatgaacttactgttgtaaattatagaccaacattcaggtcgatagagtcatcatggagagaaaccccggcctttgctgtcgactataatatatgttaacatgactgggaggacttcagcagacatgataatccacactgaaggtaatgttttcaggtttctttcccaaacttgtaaaactgtagtggtagatgttcttaaaaaattcattatcagagcattgctcgattagtttgtttagcgggcatgggaactttgtttcacctatactttgtttctttcaaaagataaatatgatgggatcatttgcagctttgttgtttgcttgatatttgtggtgtaaaataacgtctgttgttgaagaaacgtcttgtttgtcttattctcaatggctcgagtgtcctgaggttatgggcatgcacattattttattttagtaacatatctcttcaacacagatataaccctgggagctgtgcgagaggtaggcatgaagtctggaacaatgggaaacagtggcttttggttcctacttgtctttgatagagctagcaggaggcgaagagaaacatagttaagttattgataatttagtatttgcaaaagagggagatgcaccactaaagatcttataaagattggtactgttatatttggtgctttcaatattttcttggtaatctatagtacaatgtccgtgcgttgcaacgaatgaattggcaattgcaattgtatttaagcagaaaaatgttaagagtaaaggtaatgtgcgacagagtgacattaagatgcgttcattcacatggttttacacaacactattagcatttcatctgaatatctctgtattattagaaaccgatccatcccaaacgaaaccaattgtataaacacacacacaaagttgctaatatatgaccatccaataacttggcaatgccaaaaaatgttagcaaatttgacttaatttgttttttttttcaacctgtagaaattgaattttaatttgcatgtttgtgaagtgatatgtcatatattaatttatcttgtttatttttttcaattttttataacaatttgcaaacaacgatgaaatgttagtttttttttttgagagcgatgaaatgttagtttatattataatccactcctaggaagaaaagatgcatgttcactgactgtagggctatcataatttttatttatttattggttgaagtgtcacgttttaattaaaaaaaatcaggtatagtactgctgtgggatctcgtcgtacgctggcaataaatacttttacttattcatcatgtgacatatctaagagcaggtacaatagcagactataagccagttataaacatattttaaagagataaaggaagagagagaagagcagcgggctacagatttgtagccagctgcagcacggactccaagacgtaatgtaagtatgacagatgggaccagatattaatagtatagtaagcaaatattgtatgaattggctattacgttggctatagatgatttggagctagtagtgggctatactattaaacttgctgtaatgatgcaaaatatagtttaacaaatgcttttattaatcattcatcatgtgacatatctaaggattcattcataatcaacggaatgaggtcgatccgacggctccgatcgatatcaaatcgcacacctccctcctccccaccagtatcgtgcaaaacacgtccccatccaactcgcggcgcagatcgcgcactctctccctctcgatcagatcgcgcgaagcattatccgagggctatctgccttgaaggccgggaggatttggagggttggcaatgggagcagtatagatatatgggaggatccttggatccctgctggagtcacccgaagaccgataactcctcgaagaggcactgtgctgaacaaggtagctgatcttattgacccagctacgggctggtgggataaaccactagtggaggagattttttgggagtctgatgccaggaacattctggccatcccggtgagattagacacaaatgattttgtagcctggcattttgatacaagaggaatgtactcggtcaaatctgcgtaccatgtcctggaagatcaaagggagagatcggcgaagaagcaagagggcggttcatcctctggagcggtgaaccagcggaatttcgagtgggataaaatctggagtttgcaatgcattcctaaagtcaaacagtttatctggcggcttgcccataacagcctccccctgaaactcaacatcaaaaggagagtaccagacgctgaaactctatgcccggtctgcaaaaggtttgatgagaatggtggacactgcttcctgcaatgcaagcccatgaaactctgctggagaattttatgccttgaagatatccgtttaagcttgactcagcttgtttctgctagagatgtggttcagaccattttgaagctggagaatgatcgaagaatggaggtcttctttcttttgtgggtttggtggtatgcacgcaacaaggtgaactcgggggaggacgtaatcagagtggaagaagtggtccacaaggtgaaacagctgatctgtgatcatgcctctctgcgcaaaggaaaacatcccaaggtgaatgtgcaaagaaataagtgggttccccctgtagatggtaatctgaagctcaactttgatggagccttccgagctgtaaacaagtctggtggttatgatttcctggttcgtgaccaccgtggatgtgctgttcttgcgggtgccggctgcctggaacatgtacatgatgcttttgcagctgaagctgaagctggtttagcaggcctaaaatctgctatttcgcatggtattaactctgtccaggtggaaactgattcaccatcctagtgagagcctttcactctcatgagtacgctctctctccttgcagttctatcgtaagggagatcaaggatctcgtccatttaaatttttctagtgttgtgtttaattatgccccgtgatcatgtaatgtggctgcgcataagttagctcaaatgggtgtgtgctgggaattgggtcaagcaagtgtgtgggctgacctgtccctgacattgtacaaactattgtggatcgtggtatcactgatcctagtatttaataaagcgcgccggtttaactcaaaaaaaaaaagatcgcgctcgctcctcctctctcagatcgcgcctcgcgctccgccgctgcatctccgacgattgtcgcctcaaccggcatcacccgccgccgccgatccggtttcccgccctcctccaggtcgcgcacctcgcgctcgacctccgccgcgccacctttccgacgaggcgacgactgcctagtgcctaccgccgccgcgtcaaccggcatcgccgatccggtctccctccgctgtccctccgccgctgaagtctcctcagactccggctcgccgatccccttctccgctgcatgcctgcatgtcgcttgaccatcccgcggggcctactcgcccgcgagctcctccccgctgccatcggacctgcgcggactcccacgaccaccacggtgtgagatgacgccgctggcggcgattgtgttggccggtttctaggagctctttgattcagtccgccgctctccatcttttcccgtcccaggggcagcactgcagtattcctcgacgagcaggttctgcttcgagcgtagagcttccggtgggggttcaggggtggattagcatgtgccttcatgagtcgggatgtcagacggtaggaatggagcaggaggagaggagaacctgctgatccagtggagagatagcaatctcatcgggaacagcgtgctgagcaggtatacctagcatggacctcgattcctacaaggggcttcaagtttcgagcaataggcaattctgattggatcggtcttctgctttccttttggtgcaggctttgatcagaaccagcaatgccacagaggagaagacccaagtgagtacgtttggtcagtttcttgtttgtctttattttcctcaccaactgcgcaactgtaaatcttaatgctcttaattatttgatcccactcttaagtgtttttcatcggaaacttttgattagtgacacataagggagcttaaggatgaagtgaagctactcaagaacctctcacattccaaaatgctgtgagtacatactagataactacatatggtttgtttttcaattcgatgatggtgtttgatttatctggtatgctttgaacaatgatatattggaacagtatgggaggagaactcactaaatattctggtggagtttatgctaggaagatcaatacaatcattccttgggagggttgggccattccatgaggctgtaagtgctaactgttatatatgagcgtcctcttttgatgtgtttacaactaaagaggttttttaactgaatgtatttgtttatcaggtcatcaggaaatacgctaaacatattttgcatggtcaggagtatgtacaccgcaatggaatcgtacacatggataaaaaggcaagcagagtatttgaattttgttgaccctgaacgattttgttgcatgggctagaaagtttatatgtgagattactgtttttttaacttttcagggagcattctactgataaaaaggaaatgcaagacaagtgactgcagtgcttgcaagatgaatcatcatcataattgggtagttgctattcgggttgttgaactgctagacgaaatcaattgtagttgtagtgccatggtagtaatcagcaatcaaactccttgccatgattaatcaggtatgtcattttttgctagagaataatgctaaacaacattaccttatttactaattatctgctagatgtctacggttgaaattttctcttgagcatgattctaaaaagttagttgagttgttcagttacaattgatgatttagcactgtctggaactattttttggtaccaacttatgtgctttacgtgaatagtattggtctttcaaggttgatatggtagtgcattactgttgtgaaacgagaagcttatatatcctgtgcatcttcagtgatttctgagtatttaatcctagaagattgcatatttgcattacattagtttccaaatttctaaagtattaaattatcctgttgatgctggttgcctgagtaaggagattgatgcagattgttaagttcataatatattagagatcgtatatggctgcatatgaaattatgtatttgtgttcaaatgccaatgtcaggtaaaatctgaatgcatatatttttttctatataccttagtttagtagctcagatggtaagatttaaaaaaacctaacaactgtcagcaccgctacttgtaatagatttctttcatgctgtatggtggatttgattttgtaattttaaccattaaaggaacctccttttactgtgggtgggacggacctgtcagcggggtgctgttggtgatgacggggtgctctgaattgatggagctatgcggattaatttagctttaccactgttaagttgcttgcagttctggttctgaacagctttgtgtctactctctcctacagaccacagtttgatagcaccaccattactatatatgttgagactgtgagcatgcacagctctgaagccttttgtagttttgtatgacaaggatcaggagttcaggatgcaagtccaccatatggattgaatttggtggccatgtattttctgtgtcctgcaaaggacgttgctgttttttttacggctgctatgttgctaccttttcagagaaggtattgcaatctatattcgcaagtctttatcagttcacaggtatgttcttatcctatcgtccgacaaatattgttctttcatctttcatattcatgatgaaacatcttttaattgagccacagtgagattgatgtaaactatcagcatacaattaaatgtagtgcatggagtttcagaccaacatattctaacaaggaatactttaattgaaggttcatgttagacctcatagctctctctcatctgtgctattctaaaatgaaaggaaacgatgtggtttatgttctttcttgttagacttcatagctctttctcatttgggctatgatggaattgcaaaattgtggatgcaaagttgattaattgggttattcaaacttcaatctttttttttttgccattggtaaatggcatgcatcatgcccaccaattaattattagttgagctattgatttttactgtaagtacagaaaaggatggccaatttacatacatttttctcaaataataattaagaattgttcggtgttgtgcaaatagactcaaaataataattggaattgtgttcatttgtgccatgtggtgctattgcatctcttatttctctaccatgagtgaatagatgatatggctcttgttgattggaaatagaggatgaattttgctttgaagatctgttctttatgaacacctaaaattctgtaaacagtgcttgtggtgcatcattctaaaatgaaaggaaacgatcgtttcgaagatggtgactgtagtgctaatattactcctagatctatggaatttatgttcattatgtgttccattagcggatttattggtagtcctaattgctcgtttatttcaccaacttgatgtggtaatatgttctattatcatcgagagatggatttaatattgcacttgagtctccagtagagaaaacgaatggtgagtatgagcagaaatattatttctgcacatgactttgaagtccatgccacttccatttacatgactgtatcagtttctgtaacttgcaagaatcaaactggagaaggaaaaacaggagaaagatggagcaactgcaaatttgtgcagtactacgactatatatggatttgctgtgtttttttttttgtgatgtatgttgtaattgatattgtgaaatatttgttgactgtttgtataagaaatcaataatacatgtgcatgtattaattgtgttttagcgtttcagatcgcagcgtgatgagttgttaacaaccatcttgtttattctgaaattgaaaggaaaaatatgaagtagtagagaaaaaaaatgtacgtctcattttcttcttaatcagtttttgctatcgttaattaattatataataaggaaaaatatgtagaaactaagaataaaatatcgtcgtagcgttagcactcgtatctcatatttataagttaaagagaccagctatacgcgatattacaattcaaggacataattttaatggggaaattggttccataccatctaaagttaataaaacgagggacctacaatgggatccgatccgatataaggagtcaaattgaacttttttttttatcctttttccgccgaggcgaaccatcccgatttgcgatccgatttctcctttcaatcgagggttgcccgccacgtagcagtgcggtctctctcccttatcgcttcgcccttccttttccgctctctttcaccgtccccgccgcgtccatcgtgagaagacctaaccctagtcatccaccaactcgatcggagaggagatcggagaggagaggaggtgcggtgatcccgacttcactcggtccaggccttaaatccaaggcaatcgagagaagagatccgcggatgaaggaataaggaaaccgatctcgatttggttcgtcatggacttggagtgggttgcggaaaggggaggggaggggggcctcctcgtttaagaggaagaggaagaggaggacgaggacgaggagtaagttacttgctgccgccgagtcaaggccgagccgaagacggcgaggaggttttgtttggagcttttccgtggcgggaggggagggattcccgacgcaaccgtcaaaaatcttccacccaacactctccaaaggatccaacgggctcgagtggagagattctgcaggacgagcaccgcatagaggagaaggcggagatggcttctagtggagagaagctgcagaagcaccggccagaggagatagctcttagaacgggctcgagtggtcagacaacgcagaagctccgagagaaggcagccactgagaatcaccgtccaaaggagattggcccaagtggagagaagccgccgcataagctcctccgggcaaaggggaaggcgggcacgagctcaattggagtaacgctacagaagcaccgggcagagaaggcggactcaagtcgagggataccgcacaagctccaggcaccggccggcacaagctctattggagtaatgccacagaagtaccaggcaaagcagcagatgggtacctctcggcttggacgccatccaccatgtatccaagtccaaggaggagtaagcaacagagaggcacaagcggccactaccaaccggcagaagcacaccaaaagtaacaattcattatcgacgagggccactacaaagctcagatcagcaacaaacaccccatgtcaaaagcccaccactgccccttcctccaatggcaacactgctcctcccaaggatcgtaaagaacctgctacaaacgctgagaataatgctgttcctgtcgcagagaacaatgatttgcaagaagcggatgaggcaatcaaaaggctgaatgaattgggcttgggagagaatatcagctctgaggagttccttacatacattgaccagctgaatgaacaacctaaaatcgatacttccattgaactggacgatgcacaggtcactaccctctattttcagcatgcgcgctatcgcgtcagatactataaggtcggttcaatttccatcactgctgctaaataaatactaattaatcatcacccaacacatgcatgttttgtactatgtttcctatgtgaatattagatcaacaatcattgctttaatgtttatgtctgtctaatttcagcacttgtcacaacaacctaatactgagttggtagaggattcttaccacatgaaacttgttggggaagatgaactctccgatgagtttattcgcgagatggaattttttatgcgtttcgaggaagatggcacatttgattggtatttctaccctgattactgctggcttgctgctctgaacgactaccaacgtctagtaccgataaactgtgtacgtattacattatattaatgcatgaatagtccttcaattcttcagttgtgtcttggtgttctattttgtcagttgtttttgcaccatcacacataacaagtgtacagatcgtaaatctgatgaccacttagttagaatttgaaatcatcatatatacaaaatgaagatgtctggttggaaaatctacatggcattcaaaaggttaaaaagatgtgtttatttgtttaataatccagcttttatactgctttactattagttttgtggatgctttcatgctatatctactgaattatcgctgcgtaagacaagcatttgctttgttgttttatcagcctctacaagaaactggtcatttttttctaattcaaaaccagagccaacccaattcatgttatttctgtttcttgatactctaggtgctcggtaccttttttctttcttcttccctttatggaacagtttctggcatttctgtaaagagtgctactctgtaattctcctttaaaagaacaaagtgaacaaatctgcatccctttctgtatgaatactagctagtaacttttttgctgcttatttacttgtatattttttagcttgaagctcttagttattgaagtcatcgaattgtttcttcaaaactctaaatcgcgagtttcctcttaccctccttttcaacataggttggtgaggagtacgcttattgggacgactaccgcggctattttaatagctatcatactgaattgcaatatctcgacttctgcaaggcattgtcgaaggaacttaaggtgtgtatcataaaattgaacaaaccaataacattttgtacagcgctttgcattcttctgggattaaaaacgctttttatcttgagacagtggatggaagactatgtcctgaataaactgccatcttctaaggtaaacaagctcaccatacaaaaatgattgaatgagcagtgttatatgttgtagtactataataactctgctgtacagtggggaagaatatgcagcagaggagcctaccaagcaattaagattgccacccgcttttccaagatcactgctgctttggcctataatgcctactatgtacgatccctcacacacactaattatttttaatagaaaaaaggtggtttgtatttagtaacaattccattcctttcaggattgtttacagcacatgcgcttttatgttgcttattgcaaggacatggatagcttgtactttgagatttggcagcgggtcaacatgcaaaaagttagtacttaacattgttatccaggttcctgcctatgtttatgttgtgtatgtttgtttagtaatgcatgcctttttctcaacaatgttcagaagagtttcagagattctttggaggaagtctacaacctcaacaagttcccttcacggcaagataaaatgaaggatgcattggagaataactgttcccacatggaaactgtggtaggttatttttcatggatgatctgagaatttaatgtggtttccaaatttttaattgtgctttaattttattatctattgtcatatcttttcagtttcatgtttgcacggcaagtgttaccagtgaagtaagtactgtatttgtctaatattagttgaatacgtggaatgtgatcttaatgttgatcatgtctgtgtgccttagattgcggaggataaagctctggagctgattgcaaaggcagttgaaagtcgggtactgtacttgtatggaattccattttgttagatggcacctatttctatggaacttcatcatacatgttttggcttatagcatactgaattgaaaaattcctctgcattcaaaaaagaaaaattgtacggaacttcatcatacatgctttggcttatagcatactgaattgaaattcctctacattcaaaaaggaaaatttgtgtggaagttcattgtacatgctttggcttatagaatactgaattgaaattcctctacatttagaaaagaaaaagaataatgaagtgaaatttattttcttctttttttttcagatgaacaaagcaaaattctacgagcagtatatcgaaaagaagatagatattgcccaagctattggattgatttccacggtattgtcttattgctgttgacaattgcacatgagccatgttttctcactgtgaataaccaaattagcttccttcaactaactgtcatttaaaatttacatttgcaggatgggactgaagcaacatgatgtgcttaacttatagtgtttttttttgggagggcttagcttacctttctttttatatcagtatcagtagatgtcgatgccccgccagcgcctgcagaaataaagatcccgaaccaatgtttttttagctgttatgattaattcggtttccaggctccggcccgatcgaaagcattgtaattgataatgttatgtgcgatacatttagcgtacgttgcaatcgtgcctcggagtgattcgacttgctgattcggaagatgaagtttttttttttgcatgaaattgggctatccaattagcttgttgtttgctttgtggtcgacatggatgaatgtgattgtatatagaggctcacaaccgtgtctttgtgctaactgccctagctagattatgcaagttgatatcagcaatttgctgctttataggacactgagaacaaaatacatctacaggagagttttttttttctttgaagtttggtcaagttttttcagttcttttttttctattaatcctgataagttgagacttcctttgaaattgaggaattgcatataagatctctgtaagaactgaactagctctgtgagaagtgttataaaattcttcgttccaaatgagtgctgggctccatatatatatcataaaatttgatgatttgacactttatatgttgccaatttgattgtatttacactcgtgaggatgacatgtgggattatgcgagtctatcacaatggctcaaatagtcagatttttcaatttttatgtttggctcctgataagtcagttgaggcttccttctaaatgaaaggaatttataattctttgtaagaattgaactaattttgaggaagatgttgtaaaaggaggccatagtttcgcttattaatggaataagcgaaacggtatatttataaacgaaaaataatttataaacaaaacttttatatacatgttcttagcaatctaaaagcaaaggctcgaaaataaattacgatgaaaaacccttacaatcaactctttttcaaaattcaaaattagcttataagcataagccaaattgttttgtttcaaatgagcgctgggctctaaaatctgcggtgtggtcagttgagctcatcatctcctccatcctgaggcggcggcgcaacgacgacgacgacgacgatggcgctgctccgcgcgcaccacctcctcctgatgaggccgcgcgccgccttctcctctcgccctccccctctctcatcctccccgtgccgccgcgcccttcccaccaccgccatcgcctcgcgcctcctctgctcccaccacgcctcgtcgccgcccgaagatgcctccgcctccgcctcgccctctatcgtcgccgacctgctcgactacctcaacgagtcatggacgcagttccacgccaccggtgagcgcccccaccacgctttgccgcttcgcatgcatggatgccctcaacctgttcggtcctattcctcaccgggaaggacgcgagtggctgctttgtctctggcatttctgcatgtcctggactgctcgagtgcattgacctttgtgtttaggcatcggtacagccccccccccccccccccccccacatgtgctgtgtttgcttatgctttcagcggaggcgaagaggcagctgcttgatgcgggcttcacgctgctcagtgagaacgacgactgggacctgcagcctggtggccgctacttcttcacgcgcaacatgtcctgcttgattgcctttgcagtaggggaaaagtaagtcagcgacattggcttctgattatttaacttatcactaagaatctgcaacgaatgtggtgttcaaataccatttgaaagtcaatgcctttgatttaggtacttaaacttgctcaaaaggaacctctagtgtaaaacatggccaaagtatttaactgattgagatatttaagctagtggaagaggcaatcaatactatgaaaaattcctatgtatgtacggcagtcagcagggtacacactccagtaccttctcaaaaatgtttttgcctcttcacttcgttgcattcctttcaatttttgaagatatttaaaatctctccttgatatccatggcatcacactgataaatgatatatgcgtaagtgccaaaagtttcaaagaaaaaaaattatgataccgctctttctactccctagttgtaaatggatatttgaagtaaaattattttttggacgcaggtacaaattgggaaatgggttcaatataattgcggctcacaccgatagcccatgtctcaagctgaaaccaaggtctgcctcctttaaatctgggcatcaaatggtaaatgtacagacatacggaggtgggctgtggcatacatggtttgacagggacctgactttggctgggagagttatcctcaaggatgctgatggctcatttaagcatgagcttgtcaaagtgagcagaccattgatacgtgtaccaacgctggctatacatcttgaccggttatttctcattccttcttttactgatctattttctgagaactaggtggaatctatctggtagtatgttctgtattgctaagcaaatattgctagatgttctctctttcagtactgcatcatcatgtaaccctgtcaagttatagcagcttagtcttctttgaactactatttatatctatctcagtgtttggaagttatctctgaacactattgtcatgttcgtttagtgcatatctgaggatcacacaggctactgctgctatcatatttgactgcctgttttaagtttgactttctctatttagctgactgaattccttttgccttttagcacagtgaattctgatgggttcaagcctaatctggagaatcatctagttccacttcttgcaacaaaacatgaagagactactgcaaattccagtgaaaaaaatagttcaagttccactaaagttgtccatcatccactgctcttgcaagtaattgattttatattctgagcacttgctctatcatttaatcagaggtgtactttcaaagtactacagatggcttcaagttgaacttatagcatttgattttctcgctctgctccacaggttctttcagatgaaattggttgcaaatcaggtgaaataattggcatagagttgaatgtgtgtgatacccaacctagctgccttggagggggaaataatgagttcatttattctggtagactcgataatctcgcttcgtgttattgtgctcttagatctctcatggactcctccaagatgccagaagaattgtcaaatgagaaggctataagaatgattgctttatttgataatgaagaggtatgctatatctaatgaagtctcacctgattgctaaaagtatcatgattgataaaagcacatcaatgcgtgctcaagatttccattcccgtttggagtctgttttgatttgtaggcttagagtggctttagatgagaagtagtgctgctaacttatttactgcttgtcttcacttaaattatctctggtcactagtatttgataaaactgatttttttggtagaactatctacacggtattgtttcggtttatttcttgtacttggtcccttcttgttcatattataacctcgactctattcaggtgggttcgaattcgatgcaaggggcgggtgcaccaaccatgttccatgctatgagacggattgtcgattccctgatgcatcaatctatgggagagggtgctttggaacgtgcaataaattcctctttccttggtaatatttatgtatctgggagatcatcaccggcctatagtcctagactaaatagtgcacaaatttaattcttgtttcactttcagtttcggcagacatggctcatgccctgcacccaaattatccagacaagcatgaagagcaccacagaccagagctacagaaaggactagttatcaagcacaatgctaaccaacgttatgctactagtgctgtgacagcttttctgttcaaagaaatagcaagacttcataatcttcctgttcaggtattcaatattttacattttaaccctcaataccatctttttttattgcaaattcccattatgtttgaacaaataagtgtgcttcaagatggataagaatcaaatcatcgtctatctctatcattatcatctattgctagttatattatttctgataggaaatgttaaattcaagaaaaacaaaatcagcatgtgtcatctagaagtctttacttttgtaaagctgatttgtctttagaatacatgaatgagtttgaggaattgcactgatgtatatagcttataggaatttgttgtaaggaatgatatgggctgtggttcaactattggccccatacttgcttctggtgttggcatacggactgttgactgtggtattcctcagctctcaatgcacaggtatgcacagttggctttatccctttttttgacaaattgacccttttcaaaaacttatttcgaaactaacccctgacaaaaacttcaaccaaaaataggtcgtttgctcagcgccaagcgcattggcgctgaggttgggcgtgtcagcgccaacggtcgtggcgctgacatcgtgtcaccgtggcggccgggccgatcccccagctgacgtggcagctatctcagcgccgaccgctttggcgctgagatggccaatctcagcgccatccgcttcggcgctgaggtgggacttagccttttcggccgagtcccgacctagcaggccgtctgtctggctggcgggggggggggggtacctcagcgccagaagaaatggcgccgagactaggcacatcagcaccacgtaccctggcgctgagatgggacttagcaagcttggccatggcttagcccagcaagccttctggatggcttgcgggctgggacgtcagcgccagccataatggcgctggccctgggcacatcagcgccagggcacctggcgctgaggttggacttagccggctcggccatggcccagcccagcaagccttctggatggcttgcgggctgggacgtcagcgccagccataatggcgctggccctgggcacatcagcgccagggcgctgaggttggacttagccggctcagccatggcccagcccagcaagccttctggatggcttgcgggctgggatgtcagcactagccataatggcgctggccctgggcacctggacttagccggctcggccatggcccagcccagcaaaccttctggatggcttgtgggctgggatgtcagcgccagccataatggcgctagccctgggcacctcagcaccaaggcacctggcgctgaggttggacttagacggctcggccatggcccagcccagcaagccttctggatggttgggctgggagctcagcgccaaggcatttggcgcgggcctggagtatgtcagcgccattttgcttggcgctgaggttccagacctgctgtaataagcagcacagctctctgcccagtcctgcttaacacaaccacacatccaggcaataatttattcacatcacaggcagtattcaatcccgacgaaatccccttcgatttgagtggatttgggggagatttggtgaggggagaagaagggcgacgaaccctaacgcgcggggtggggaagaatggaggagaggctggctgggggcggcctcggccggcctctaagtaccaaaactcagcgccaggcccattggcgctgagattggccatcttagcactgtcggcgctgaggtagctgccacgtcagctaggggatcggcccgcccgccacggtggcacgaggtcagcgccacgcccgttggcgttgacacgcccaacctcagcgccaatgcgcttggcgctgagcgaacggcctatttttggttgaagcttttggcaggggttaatttcgaaataagtttttgaaaagggtcaatttgtcaaaaaaacggtggctttatgaccatcctttttcgtatttctgaattagcagtaactgcatgtagacagtacttccaatcgttttgcaattcatattgagcaagttgactcctagctatatagggaataagaggtcagtttttttcttacatgtatcatccttgtcaaaataggtatttaattaaattgataacataggtaagaaaaatgtatgcttagatttcacttataccttccccatcgttgttctggccgtgggtgacgcattactgaacgtttaactgctattgtattggtttgcagcgtgcgagaaatgtgtggcaaagaagacgtagatacaacatacaagcacttcaaagctttcttcgagatgttctctgatattgaccggaaactcaacgtagactaacttttagatcttatcagttcctcatgttcagtatttgaatttttttttcctggatcagaataatgaccgtatatcagagtatcagttttttcttgtcccaacatcccaatctaattctacgcatgaccaagaggggtgaaatcattttacatgtaaatatggtgacacatcgccaagctcacttttgagaagatggccttacacatatcatactcagttactcaggcctgaatggcaagttgagattgtaatgcttatattgaaattccatccaaccacagccggatcaacaaatgaaataaatggccatccaaaattgtttcgccaagatcacatcggtaaattccaacattctacaggtgttccagaatctcgccacaaaataacgtgcatacgttctcctacatacagagtgcaactgacctttcattatatatgaagaaattgacggtgcaaccagattggatatttgagtgttgcattacaaagttgatgccaacacaattttcatcacccagtgacccttcgccaaaaatgtcgcaacaaaatctaacccaccggagctcagcttagctcaccttagtgtagtttatggcgtttcttgccccatgtatatgggaatcttgggatgcaccgccgctgcatccctagttgagaaatacatcagcagaatgcaaaatacaatatgcctcctctgctcaggaacgacacctcaagctacatggcgatcaatttctatcctttcttttaccggttaaggagccaccattatgttctgctcgcctctgctcacatccatgagatgcctcggtgggagatacatcctggacaaccccgtttgctgcaggagcttcatggggatgtttgcagtgccctgtcctatcaatacaaagccaaatcctagctctgtcatcaccagatttctcctccataggcacatgccaagatcccatctccgattcctacgatgaagattacatcagaaacaacagatagcaagctctaaagatgcctgtagcccagttacttacctgaatctccgaagaatatggaggtggcatcataagcaccgcctttcctttactaaaggtgtacttgacctaaacaattggaatgagaaacaaaatcaacaattaagcaggaatggtaatatccaatacgtgaagcagtatcactatgttacaacaggataaaggacccagcatctgtttacatggttttaagtttaacctggcactcaaccttttctaaatcagggttctgtggtaataaattatgcagaaagaatggccagtatgttaaataaaaagaagtgcagagcacacctgatgccgttgcttccacttggggaaaaaagatgaccccaagagctcaaatatgtgatctctcatttcatcattagtcacaagcaaacaattcaacctaatcgccgcatacagccaatacctgaaaaagtgcatatcgtactgttagtaacatcgatgaaatgaaacacaagtgcatcaaaccggagactgatgggtgaaatatccaacctattacctaattgcacatattaatcaatgaatgcacaaatacaatataaggtaccccaaaaaaaaatgcaagtgcacccaagactagagactgaagagcattaccagtcatcatttgacccaattggtgaagtgtacaatgccccgttcgctctccaggtttcaatcaggtgtctattagatgcattttccataagcttggcaatgcgtttattatgtaatacgacaagtggccatttaccattatatctatcccgtagctctgttacaacagcgtccagctgctctatattaaggatgacagataggaaaagcattagtaccacattacttcactgataacattgataggtcaaagtacattgaaagatggagttcagacctgagtcaaactaaagccaccctctgcaaaattttgttgataaagtgcaatatttgcaccatcaactatagcttcatatgctccatgttcttccaaccactcctataaagtcatagcactcaaacttgtaaggaagaaaaaacatgtgttccaaatttataaatggattatcacctagaggcagtgttctaaaagtcggctctaggcgccgcctaggcactgggtagcagccacaattaggcattagatgctgcattaggcggctgaactaacttgggtggtgctttattgctattttagggttacatagtataatttgtatgcaatatgccagctaatttcttggatttcttgtatgcgaactgcctaggcgctagaggcacgcgaagaaaaaataagtatctgaatcatattctgacttgcatcgagaaacacatgcatgaggtatcttacgttcttaggaaggtaaattcaatgcttaactcataagggaagttccaaataatgatttatctaaacatagaacaagttacctgggcaaggaactactgagcagacattgctcaaatacacagcagcatttaaatctctaaaaggggtgaaacccaatatagataaatcagctgagcactattaggttaggccacaatgaagcatcaaatggttttttgaacaaagcagggagacagaccgatgggcttacatctctgactacaatttttctatgttgttatgatcactgagcccacaaggccatgttagattgaatagaccaagcaaaacgagtgatcttcctatcacacttaatagtaaatcaattgcagtcagtaaaatcaactggttacatataccaagttagatatggatacaggttaacactacagaagggcagaggatatgcacctgaaactggctgaaatttattttggtctccctctgaagggccagactggcaacagaatcggcaaacctctgcgtctcctcgacgtcaatgtcaacacatgctagacggcaaccacacccctcacactggccatctcctccaactcttactcgctgcacagtccaagggccggtcccaagccatccaagccgatggcacccgccaccattggccacaatggcgtccttcaccttacaagcatcccactcggccttgcccgccattgccgccttaccgctccgaaaccaaccctccagcaccttcgcagtctcctcgccgacacaatccacggtgcggctcagcttgtgcatatactcatacaccttgtctgcgtcccctgccttggcgctgacatcaaggagcgcggcgatctcgggctcctcgggggcaacagcagaggcctccatgtgggcatcgacggcgtaggccttcccggcctcccccgcgcggcggaacgcggcgagcacggggctgtacgagcggaggcgcggggcgacgccgtacttgtccctcatggtggccacgaggtcgaaggcctcgtcagcggccgcggggttggaggcatcggaggcggtgacgcgggcgagcgaggtgatggtggcctcggagggggaggccccggagccgagcatgtgggagaagacgcggcgggcggcggcggcggcgttggggagcgagtcggcgtcggcggtggcgaggaggtggaagagctggttgtactggtgggcgaggaggcgcggggcgtcggggccggagagggcggagtcgaaggcggccatggcggcggcggcgtcgccacggcgggtgcagtcggtgagggtgcgggagaggtcggagttggggcccttggagccacggcgcgggcggcggcgcgccggggaggaggcgccggcggcggtggccatgggtgggaccgtgtgggtggtggtggggtggagtagtggaggaggaagaagaaccctaattagcgaggtgggtttggaggtggttagcggccataggcccataggccgcgttagcccatgcctcatcgtcacctcacctctagctccttcgccgcgcgacagcgggagaagggaaagcttcgcgaagacgcggaagccgtcgattcgagagatgggagccgtggatgtaaggatcgacggtccgtaccaagatgaacgaaaatcggagtcctttccatctataagcaaaatatggaaatacaaaaactctatatcacaatcttcttttactagatttttggaatttatattgtcgatgttttcttttagttgatttgtatggactccaaccatggggaggcaacactatgagtcgactagctcgttatcactttggttaaagttcgttatttgtaaggagtagaatgatggattagtgttttccaagctttcaaatggtgcggttttttttaaaaaaacttgtatgcacataaatttcttgaaatatagtttcaaatacattttcaacttgcgagagttaatttgttcgtttgtacatctcaataattatcacaaaccatttactctccattcatttcatatcataagtcgctttcacttttttttttcaaatttttccaagtttgatcaaatttgtagaaaaatataacgatatttctaactcaaaacaaacatattatcaaaatatattcaatgttatatttaatgaaactaatttggttttacatatgttactaatttttatataaatttagctaagtctaagtagtttgactagaaaaaaataaaagtaacttataatatgaaactaggagagtacctatttaggctttagccattcaatacaaaaggacaaagaacggatggattacatttgacacaatttcttttgttttcattgtttggcgctagagaatcgaacacaacagaaaatagtgaacatatgctccagtataattgtgtgttatttcatctttaacataaaattgcataaaatttgtgtgctctcagatatcaaataacatatcacgttggtgatctgtatatgtgtagcccctgaacttaaaaacaaattaacttattccggtgtttagctctattgctgtttaagaaattaatagatcagagctcccagcgatgaaggtcgttgaagcaagcttagttggccctgccagtgaccatggagatgccggcgcggcggccgaacctggcgacggcgcagtcggtggagaagatgtcagagacgacgtagctgggagcgccgcccatcaccggcatgctggcgctgacgctgagattgttgacgtagtcggagcggtaggtctggccgaggacgccatggacatcgtcggagaggtcgtagaacttgaagccgaggtcgaggtgggcgaggctgtcctcctcggtgacgccgtagttgtggatgcgggagtcctgctcggtgatgggcaccacgttggccatgatgtcgagcacgccggcgagctgcaccctgacggcgttggtggcggcggtcctggtgacggtgaggcctggaacggcggcggactcccagcgcgcgccgagctcggcggggacgtcgacgggcgcgccgtcgaaggcgagctcgaggcggtcgtcgtcgctgttccacttggcggtcttaagggcgcccatgtagaggcggtggtcggcgaagcggatgccgagggcctggatccaggtgaagtcgcggctcatggtggggttgcgcttgccgatgaagtgggcgttgatgtggaggtcggcgtcggagacgatgcagaagtcgtggtccttcttgccgtgaaagtagaagttgttgccgtcgccgccggtgaaccgcgggtcgccgcacgacacgccggggtagaagtcgcacactttgaaaaaatcaaataatttcacacagagaatcacacacgatgtcacgatcgatcagtagttcaaatgaattgcaactagctagtgatgcttactgcagaaggtcttgcagccgggacacatgacgatgcactggttggggcagcgcttgtcgcacttggccatgcagacggccttgttgccattggagtcggtgcagaagagctgctggtccctcttgccgaacctgccggggttgatgacgtggtagttgcttggcagcctcggcgacgacggcgcctgcgcggcggcgcacaccaccaccaacagggcagccgccgcagcaaccaccgcggcgccccgtgccatcgatcgctacctcgttggctagctaagcttcagaaatcgatcgatcaaacgaggaggtagctaggatgagatgaggaggacatggggaggcgccaatttataggcagcggagcggagcgcgggcgcgatggattggggttggatctaaagccggtccggcgcgcgcgtggtggtgaaccgatgcatatgcatgcgttgggtaagggttgcctagcttggcgacgcacgcattatgcacatgtccatgcatggggagtggattttcataactcgaggggaaggataaccctcaactaactaaatagttatgaaaaaaaattaaaaagatatattaacatgtaatatatcactccacaaacatgcaagtttaaattcaatttctacacctcgcaacgaaaaaaacaaattaaactacaactagttaacgcatattcacagtcaaatttgtttttttcattgcgaggtgtagaagtagaatttgaatttgcatatttgtaaagtgatatatcacatattaatacatattctcaaattcttttattttttttcataaccatttgagtgacatgcaaataacgagggaatattccctcaagggatgaaaatgatgaaaatagttttcctacatgcatgcaccaatgcaaaaaaaaaaaaagattatttcttttgttttgctgtacacacgtacaagggcacagtacggtgcatggtgtgcgttgagtggcatctatctcgatcggttagaggctgcgatgcacgtaaagcggctagctactagcagcatcgcttcaaatgcttgcatctgcatgcgtggtaacctatattattgttctgcacatcacaacacgttacaagcatgcagctgccacctgatgatcgatcgatcgaggacctccctgcgatgctactcgatcgatcatacacccttctctgctgttgtgcaccacacgctacaccgaatcaaacgtacgtactccctcctttcttaaatatttaacgccgttgatttttttaaatatatttaaccgttcgtcttattcaaaaacttttgtgaaatatgtaaaactatatgtatacataaaagtatatttaataatgaatcgaaaagaaataataattacttaaattttttgaacgaacggtcaaatatttttaaaaaagtcaacggtgtcaaatatttttgagatggagggagtatcacattaaaaaaatcaattattgattcactgtagcagcaccgcgaacgcatggggtatccggccatccaacggcagagcatgctcgttgaccgtcggatcgatcggcactcggcaaatacatggatcagatcgatttataccatgtcctgcaacaaggagactttgcacaaacttcgatctaatattggtcgacgacgtacgactaaatcctctcatcagcatcagaccccttctctctaataatcttcacatagcccaatttgttttatctactctcgtcaatccatactttgcaaatgagcactactacaaaactcttacaaacaaagctatcaaccaattgaatttattttcgagaatcaaccattcaaattaattagatactccatccttttcacttataagtcattttgatattttaagtcaaacttcatgaaagtttaaccaagtttgtatgaaaacatatataataacacaaattagtttcattacatataacattgaacatattttgataattttttttttgaaaatattgctatattttttctataaatctagtcagatataaaataagtttgacttagaaaaaaatcaaacaacttataatatgaaatggagatggtagtagttaataggaatctagattcaatcacaacataccacattagtgttactaaaagttttatatgcatagactttcctttgtgcatcctatattatcattggaattctcaaaattaaaaataatacttatatacttaattcactggttaatattactttttcgagttataatggaatagattaaaatagaccaagtgtatcacagtttgttggttggtctagttaactaaacataattcatgctatatatcgaatatatcatacataactacgtgggtcggtcaattggggaaatgagttaagccaggcttaaacaaggtcaaacttactagcataacgtctacttcggcacctatttttttagatataggatttaaaactcggtatttacatcaataaggatatacacaacaggtaaaaaaaatcactgaataggcaattagtttgaaaaaaaaggagaagcagtagcaagagcaacgccttcccttggcggtttggtggtttgtaggagtagcatgttaggagatatgaagagtaggcttaacggtaatgtgagcatgcttagtgctttcggcaaaacagctctatggcctgtccacgtcagcaaaatcagggaagcagaaccaattactgtgtgattttatctggtattgcattggtagatgagggtgttcaataaccattttttaagtttttttataatggattaaaccggcctctacatccaaatggatgtacacagccaagccttttttaagttaagggattttttaagttaaggcatggttgatcatccttagtgagtctcgctcctcatggtgaaccctacgacatagatcggtgtgcatgggttgatggctaagttatatgtagggtgcaaatataattttctatttcatacataagtaaatagaacaatatatgtatggcaaaaatataatgatccatgataattaacatattcaatcatcgtcactatattcattcaatatttagtttgacgaaataattattgaacaataacaatgatggttgtacacccatcatttgtgggaggggtgaagagattatatcatccttgtgtcaatttgatcatctcttggtgatcgatcttcctgttaaaattattcccggctctcatgatagcttggccaaacatcagaatgcagacggcacacgcaccctttgtcgaaggcaacactctttaactggccctggcggtgaccatggagatgctggcgcgccggccgaacctggcgacggcgcagtcggtggagaagatgtcggaggcgacgtagctcggcgcgccgtccatgaccggcatgctggcgctgacgctgagcttgttaacgtagtcggagcggtaggtctgcccgagcacgccgtgaacgtcgtcggagaggtcgtagaacttgaagccgatgtcgaggtgagcgaggctgtcctcctcggtgacgccatagttgtggatgcgggagtcctgctcggtgatgggcaccacgttggccatgatgtcgaacacgccggcgagctgcaccctcacgccgttggtggcggcggtcctggtgacggtgaggcctggaacggcggcggactcccagcgcgcgccgagctcggctgggacgtcgacgggcgcgccgtcgaaggcgagctcgaggcggtcgacgtcgctgttccacttggcggtcttaagggcaccgatgtagaggcggtggtcggcgaagcggatgccgagggcctggatccaggtgaagtcacggctcatggtggggttgcgcttgccgatgaagtgggcgttgatgtgcaggtcggcgtcggagacgatgcagaagtcgtggtccttcttgccgtggaagtagaagttgttgccgtcgccgccggtgaagcgagggtcgccgcacgacacgcccgggtagaagtcgcacacttgaacattgaacattgtcagagaatgagagaattacattgctgatcaaccgattcatcagtagaccatgaaatggattatgtacatagctagtgaagtggtgatgcttactgcagaaggtcttgcagctggggcacatgacgatgcatgcactggttggggcagcgcttgtcgcacttggccatgcatcctttcttcttcccctgggtgtcgtcgcacgacagctgctggtctctcttcccccccatgtgacccgggttgatcatgtggtagttgggcggcagtttcggcgacggcggctgcgcctggaccgccgcgacggcgcacacggccaccaagacggcgagcgcaccgacgagctgccgatccatggcgattcaatggatggagatgtgcttcaacctctgtgactctgtgttgctagctgttgttgttgttgtgacttgtgaggattcaggacaagagaagatgttcatttatagggatcgcgagtgcagtggggtagtggatcgatgagtggccgccggtgatgtgtcgtcggcttcggctctctccggctggccggcggcgcggccgtggcggtgaagccaccagcatgacatctgagaatccaacactttgcgttcaccctgaactatgcatgatcttgctagcgtacgaatcgaaaacgtcgtcctaggatcgaggtcaacagtaataatataaagaaattaagctagctggttcttgtatggcttcatgcttaatttgcttcctttcttccaacaatggacatggttttaccgttttttttccttctagctagttccttaaaatctactgcaattagttgattcagctagtagcaaacataataaaggaagtaagcttggcttatggacctgaaagctgtttacctttttttccatcctaatcaagcccctggtcaactccattttgatctacacttaattcttatcttcagatattatgttcctaaatattactggctcaatgcacggacctctgttcttcagtaaagccaaattacccaacatgcatgctcgatcacacacacacacacgttgttgttatcgtttcatatagaacagtatagtggttaactaattgtaaattgtgatgagatttctcatcagtaaaccagccaagcaagaacggatggtacacaagtttttgtaacagagtttgctgattgtaaatttggtggcgtggcatgctagaaaagctggacaaagtactccacatgcaagctgaagttagctagcaaatattcagacgcacgcaatgcgtcatgcgttctcctgaagacctgaagctagatacggcagctgctgggagctttctgatttgccacgacgacgtatcgaacggccagccgccttcgccgcgacgccgcctggccggtcgccatggcactgcaccacgaggcgctctcgctcgcttcaccaccacgcgcgccggctcgccggcagtcttccctgccgagcaccatgcttgcatgctacctcatggatggatcatctccattgccagtccagtgaaatgccggcctagctataaatacgcgcctagctctcatagccatcttcctcaccaccgatcgatccagagtagccaacttaaccaaatttactgtacgttgaccaccagctagctagcttagctagcgacgatggcccgggcatacatggctgtcgccgtggccctcttcttggtggtcgtgtgcgccgccgtctccgaggccgcgaagccgccggcgtcgcatcccaggctgccgcccaactaccacatgatcaacccggggagctcgggcttgggcaagagggaccaggagctgtcgtgcgccgacaccaagggcaagaagaaaggatgcatggccaagtgcgacaagcgctgccccaaccaatgcatcgtcatgtgccccagctgcaagaccttctgcagtaagcatcactagctatgtacataatccatttgcatgttgtactgatcaatcggttgatcaagtaatgtaatgtaattctctctgacaatgttcaatgttccagtgtgcgacttctaccccggcgtgtcgtgcggcgacccgcggttcaccggcggcgacggcaacaacttctacttccacggcaagaaggaccacgacttctgcatcgtctccgacgccgacctccacatcaacgcccacttcatcggcaagcgcaaccccaccatgagccgcgacttcacctggatccaggccctcggcatccgtttcgccgaccaccgcttctacatgggcgccctcaagaccgccaagtgaagcagcgacgtcgaccgcctcgagctcgccttcgacggcgcgcccgtcgacgttccagctcagctcgacgcgcgatgggagtccgccgccgttccaggcctcaccgtcaccaggaccgccgccaccaacgccgtcagggtgcagctcgccggcgtgttcgacatcatggccaacgtggtgcccatcaccgagcatgactcgcgcatccacaactatggcgtcaccgaggaggacagcctcgctcacctcgacctcggcttcaagttctacgacctctccgacgacgtccatggcgtgctcggccagacctaccgctccgactacgtcaacaagctcagcgtcagcgccagcatgccggtcatgggcggcgcaccaagctacgtcgcctccgacatcttctccgccgactgcgccgtcgccaggttcggccaccgcgccggcatcaccatggtcactgccagggccagttaaatttgcttgtatgcttcaagcttgatcgttgacagctcttatcgtgtacccaatcaagcattaatagagctagacactggaataagtttattttcaggttgagggaaacataccagtcatcaatcaatataggactcaaatcatttgatattcgcaccgtctcgtgccggtttgttaatgttaaaaaataatttgatatttgtgatcacataaaaatcctgcaatttaaatttcatatgtataaaaataaccgatacatggaatatactcctttacctttcttttttttcttttctctagaaaaaagttgaaatcgaataaaaaagtgacacaagaaaaaaatgcttaggcttaattcttttaagataatgtataatattgttaaaacagattatttgctccatgcttcggaaaatacattttcttaaaagaacacatggaaaaagaaaaaaaagaaaaggtttagccaccgtggctgatgagttcgtgaccgatcccaaatccagtctccaccgcgcgttccaactaccggaatcgaatccatctctctggtctctagttagagtttttaagggtgcccgcgaacccccgatgtgaatcgattgaggaggggatctccatgcatccatcgaaacacttgcctccttagtcctcacctagcactgccgcctcccctgaccagcgtgttgtccccagaaaaccatcctcaccaccccttgcccctccattacctcccaacccagaaaatcgtaatccccgtgtctttgtcatagttgcgacactgtcaccaaccgctgggaagtcatcgttgctgatgagttaccacctcctccctttctccctgtcctcctcatttggagcttgaggacgactcggccatagagctggtgactggacactagcaattcccaatcaaatattatataatccatattttaatttgaacacgagacatccatatgaaaacatatgattcgatttcgctagaaatctgtcgtgtgattttttccccggtgatttcacggatttgctgaccgcacgatggtggaggctgcatgcgtggtcagccggtcgggatgatcttgttcgcactgtgctcgtccctttgggcatgatgagtggagacgatcgccggacgggacgaccttctctgcacttgaatcttgtgcgtaaatctgaaccaagccaaagctaggatcccacactagattacaccaccatgcggccatgcctaacaaatctaccatcgctagaaacctgttctattcatttttttttatatatttgccgataaatttttttctagaaatttgacagatgtaattacaatacaatcatagtgtaattacactgcaacttgtatataattacactaactaaaattatatttgtaaattcagttgatatgatatgtaagtgcactgtaattttgataaaactaaagtgtaagtaaatatgtatttgttattttctttaaaatataaaattacagtcctatagaattaaaattacatttgtaaattcagttgatatgatatgtaagtgcactgtaatttttataaaaataaagtgtaagtaaatatgtatttgttattttctttaaaatataaaattacagtcctatatatagaactaaaattacatttgtaaattcagttgatatgacatgtaattatttaaaatataaaattatagtcctatataactaaaattacacatgtaaatttagttgatatgatatgtaagtgcactataattttgataaaaatattgaataagcaaatttgtattagttattttattttgtagtccgttggatataaatctaagtgtaaaaaaaatctgggtgatttcttgttaaaaatcacccgacaaatgtgtaggcaatccccatatgatttatttgaatagtgggaatggtggatcacggcccgtccacatttcaaaaaatgtagttagtattttttttatagaaaaagttcaatatggctcccttaagataagtcagatttgattcatttccctcaacttcataagccataataccggatatatcgacccctccaactattaataccaacacaaacgacttagatccagtttaaatattttggctcttagagtcattttgtatccgttttaacaattggagtcattttgtatccgttttaacaattggagtcattttggctcttagagtcattttgtatccgttttaacggttgagaggtatgaatcaaatcatacttatatttgaaggagccagattagaccttttcttagttttctcacacatagaaatgtcggaatggacgtgcagcccagtccagtaggccgcaaacaaaacagggagtgcatgcttaaacccaacttggattctcacgtatattgtcatttagtatgtactccttccctctcaaagtattaagggttttcttttgttagacttagttgagacacatttttatagtataatacgtatagcacccttgtcaccgccactgtacgtaggtcaacgatgaaatctagctatctaaggacgtctcccctgcccaggatagatgcatattgcgtagagctgaatccatgcaggcattgcatgggccggtaacatgcactttaattaatctggggacttcgttgctagcgagtatatatgtagcatacgcggtcttcaaaaaaggcaaagtatgtagcacgtagcttgtaaactcgaccaccacgacgaccatagctctacctagcttcaactctactaccaattagtagtagcaaacgtaccatagatgcatatgtactgtcactttgtcttcccctacgccacttcccactgaagccacttcaccctcaattaagcccaggccggcgtcttctttccatcttcccataagaaccctaccccccatgtacatttgatcctcaactccgatccatcgatcgatcagcaactaagtagctagcagccaaacaatcatcctagctaggctgattgatccaagctagcttcgtcgtacgtgcagcgcatcagcctagctagctagcaatggcggctctggtgcaggtggtggcggtggcgcttgcgctgtggtgctgcggcgccgccgtcgtggcgtccgccgcggcgtcgagcccgccgctggtgtcgccgaaggcgaagcccggcgtgcggccgaagctcccgcccaagacgaagctgaccaccatcaccttcagcccccaccacaagcgcgactaccaggtcacctgcaccaacaccggccgccgtccctgcgtcgtctcctgcccttccaactgccccaacaagtgcctcgtcgcctgcgcctactgcctcaccttctgcagtacgcacgcacatatatatatttcgattattcatccttcgtttccaattggattaatattgatatatgtatgaactctgtcatgtcagtgtgcgatctgttccccggcacgtcgtgcggcgacccacggttcaccggcgccgacggcaacaccttctacttccacggcaagaaggagcaggacttctgcatcgtctccgacgccgacctgcacatcaacgcccacttcatcggcaaccacaacccggccatgaagcgtgacttcacctggatccagtccctcggcatcagcttcggcgaccaccgcctctacatcggcgcgcgccgggccgccgagtgggacgacgacgaggaccacgtccagatcaccttcgacggcgagcccgtcaacgtcgacgccgccaagggcgcccactgggtctccgccgccctgccgtccctctccgtctcccgcaccgacaccgtcaacgccgtcgccgtcgagctcgacggcgtcttcgccatcaccgccaacgccgtccccatcaccgacgacgactcccggatccaccactacggcaagaccgccaaggacaccctcgtccacctcgacctcggctacaagttccacgccctctccggcgacgtcgacggcgtgctcggccagacttaccgccccacctacgccaacaggctcaacatcaccgccaagatgcccatcatgggcggcgccgacaagtaccgctcctcgggcctcttctcgccggactgcgccgtctccaggttccaccgccgccgcaccgccggagaccatgtcgccctcggttttgcctcgtaaatcgccgatcactcgtctactccaaccaagtgagatacgatcgatcgactatgaaataaatcgacactgatcagtacgtacgtatatacatactcgtgcaccacgtcaaagcaagaaataatattctcattatgtggatggtgcattgattaattccaaaattttattgactattattatggagctctttcgattgaacatggagtaataaggattcttgatttgttttgatgaaaatgtgtcacattcataactttgttccattattttttaattagtctatcgatcagattaatatattacctaattaacctgtgttaaacttcaaatcgcggggtgtactatatgtaccatttctgcgtcaacgctattacgaccaaattaagttaagtaaactaggaaaaatattgcgtgaatgcttagtactacgaaaaaacaccggccttgacttgtttttgaagggggaaaaagtacaccgaaggtccctcaacttgtcatcagaatacaaaaacgtcctcgaaccgcaaaaccagatatcgcgagtcttttaactatataaaaccggtcacaataggtccctcggtggttttattcccggttttgtcctacgttgctactgagtcagcgtgggaccccacgtgggccccgtatgtcaggatgccacgtcatctcccccttctctcccttcctctctcagtcatctctgccgcaggagaggagaggcgcggcgccgctacagcggctgcagcggggaagcacggcggctccgaggcctacggtggaggccaacgagcgagcgagcgagcaagacacggcggaggcgcggggaggccggcgagctccaccgcgtggaaagggaggagtcggggtggcccgcggtcgtcggcgaggagctcgcaggtagggggcccagaggaggccgtggctcggcggctgccgccctcgcccatctcctccccccggcggaagacgccgcagttccgctccgccggccgctgcgccctcgcctgccgccctgcgcctccgctttgctccgccctccaccacgcactcgccaaccgccgcgcgctcgcacgccgcctccgccctccgccacacactcgcccaccgccactctgctccgctggccgccgcgcgcttgcacgccgcctccgccgaccgccgctcagccccacttgccgccgccagtcgatttcgagcgtgcacggcgtgctcgtcgctcagcgcgccgtaggccttgttcgccagcgttcacggcgagcttggaccgcccggcctcgccgccccacgcgccggccacgtcgcgcaggtaccacttgaggttgtgccacaccagctcgttcccgtggtacagcggcgccgtcgggtacctcagtacctggggacgacgtcgcgtgtgttgtgaacgcggaggaggcgggggccaaggccacgtgcgccgtcgaagcgactcttgaagtcgtgcccgccgacgcgcgggttggcgaacacgaacgcggtgaccgggcagcccgtcgccgccagcgccgccaccgcggcgcggggtgccctgttgtatccattcgcgacgatgtcaaacgcgttcagcgtcgcgagtgcggcgccaaggctgtgtcccgtcaccctgatgctcagctcctcgccctggtacatgctcaccaccctcgccacctcgctcaacacctgcatggcgacatccatgtcaatcagtaacaatgtggcaggtgaccgtgccgcgctactccggccattacctgatctcgagcattgtccttgttgtggctggactcagagtcactggaggtgtacatggacagccatcctcggtgcaccatggcgtcggaggctttgtcccggaggaggtccttgggtggcgccattgacgaactccatgtccttgatccattgtagcgactgcaccgtgccgcgccacgcgacgaagatgttacggcgcccgagcgcggccttcccttcgtcggtggccaccgcgacgtacccgatccagttgctctccctgcacctgcggaagcgcgagacggactgcaggatgaacggctccggcacggcgacgcacgacctcgcatacaggaggatcccgtctcggcgtcgaagccgaacggcccgccctcgagctccccgaaccccgcgaagaaggcgcgcagccgctccgctctcgcgcccggtgcgacgttggtcacgtacacccgcctccccgctgccgatgccgccgatgccgcgacgccagaggatgggttcgcgccagcggtggcgaactgggcgaagacggcgcgcggccggcgacgacgacgatgccgccgcggcccacctcgcggagcgcgcggcgggcagcggtgcgggaccgcgccccaccgacctcctcccctcccgtcggctagcctgcccagagaagtgggagagaaaagggaaagaggaaggtgagaagtgagagagagaagggagagaagagggaaagagaaatgtgttgacgtggcatcctaatatgtggggcccacgtgggtcctatgctgactcagcaaccacgtaggataaaaccgggatcaaaaccgctgagggacctattgtgatcggttttgtatagttaaaggacccgcgatatctggtttagcggtttgatgacgttttttatcccgatgacaagttgagggacctttggcgaaaacgcttacaatcggtcgttcgataccaccgaaaaaatcggacgctccacgtgtttctctgtttctcacacaacgagtccacgacttttcctcctccccctcgctataacttttcctcctccccctcgctgtaaccgcccctgctttccccattctcgctccatccctctctctcgccacgcgctgccgtcgtcggccgtcgagacgccgccgccgcaagccttttgtgcctccttgttcttctcctctttaactcctcatgtactcttcctcctctcccattaacatctcccccaacgtgggtgttcctcgagctagatctagccatccttgacctcaagtatcagatccggggcaaggccaccatggggatagggagagaggcacggatatggcttcagctcaggagcttcttgtagccaccaactccgtcgtcgtgccctacctatgtgatagaggaggtgaaaaagtagttgccggcgctgacaaaggtaaagctggtgtgcctaactagttgggcaagaatgttgcacaccctattcttttgatgttgcacacaatgtttacttgatgttgcaattagtcttttttggatgttgcacaaattggtataatgatttcttgatgttacaatattctgttttgtgtgttgcaacaagtgttcttggatgttgcaatattctggttttgtgcgttgcaacaagtgttcttggatgttgcatgtgattgaaacatcttttgataaatcaatgaaacattcttgatcgagttatggaacacgctggaacaattcttgttgaaacatttttttcatcggattatgaaacatctgaaacatttttttatgtgtgatggaacacgtccgatgtttcatcatccatcggacgtccgatttgtagcgctccccggacctttggtgtactttttccttttgaaggggtggacttttcgtactcgtggatgggcctaccaaaatgaggcccaagatggagtttgagatgggcccgtttctgtctccaattccagcccgtctcttatctctctcgtgtcttcttcacaaaagaaaacgacaaaaaaaaagtcattccaacacaagcccacctaagcgagcacgatgcacggcggcgcgtccttcgccgccgccggcgaagacgccggcgacgcggttctcctggagatcaccgacgcgtccttcatcgccggggaagctgacccctcgcctccacctcccgtctccgtcgacgacctcgccggcctagaccccctgccgtacccgaccatctgggttcgcgccgaccgcaccaggcaagccctcgccgcgccctcttctccggattcaccggccaatgagctgcttgtattctaatcccgcgtcgcgtgattctggccaggctaatcgagagctcctcctacttccgcgccctcctcggcggcagcttcaggtcagtaatctagtcgccccgacgcgatcgagctctcaatctctcaaacctatcaacagcaaatcctaagtaattgtctgacattttcccgcggctcctgtgggcagtgaatctgggagagcgcatgtgcagatcagctgcaacctcgaggcggccgtgcaagtcctcatctatctgtttgagccttctgggagtttgacgattacgcaccacacctttctaccgctaatggaggtattcagtcttgggttagctttttaatggctttggtgcagaagttgttgaccggcatttgtgtacatatgaaatcacagctgctaatcaacacaattactagtaattggtcagttagctcaatttgagtaaacataccatgttttggaaattttgtgttatgtgaaatgtgagcaaaaatgccatgtatttgtgtctccatgaactgttgcttaactgggttcgagctcgaaggttcagattgtggtcattatgcacctttataatttgaggctagtgctattaagttttggtgtatggtcagtgatgctcactggtggtattatgaacttaatatttgcagggtggcttgtttctggctgctgagaatcttctaacagaatgtgaaaggtggttccgcaccatgagctctcaaagttcctcgctattggccccattagatttcttaattgacacctggtactttgctcaagagcatggtgagccatattttgttgccgctttgttctaatggttcttatacttttgcataacgaaatctattcaaagatctaattcttgttgacatttgtatgattgcagggattaattatgttcaagatatatgcccaggatatttagctcagaattttgtaggtacaatatactaagttgcaatgctgccatacctttctgcatactatcaatttgtttcctaacaatatcttccttcagtttgaaaagtttatgtgtgactgattctacaagcagttagttttgttccactcatggtcctttcggagattctagaacattaaggacccgcagtcaccatatttgactcacataaaccatgtttgtagcctacaattgacattaatatttcacattttcagataggaaaattctagaaactgtagaggctggatgaattttcatgtgctctatttatggttgatgaaccggtgcatgttggcatttatgaatgatgattactgcttgaattgaagaaaagggtttgtctagattcagaggaaaagctcactgattttttactttttatggagaaaataaagatattctctttgttagcagcgtcatgtcgtttatagccttatagtgttttagaccatattttttccccttcttgtaataattaaatagactatgcctttcttattcagacactgctttaaccaagaaagcttatgatattctataaaaaagaaaaaaaaagttatgatgttaaaatgatgataggccaacttaccagttgaatatatatgcagtggggctacctttatttggcatgaaatgtattcatgtataattaccactgggtgaatcccatacaggtgcaggttatctccaggaggtcgtttgttaaacttccctatgatttgttatattctacaatcgagtgcccctttctgaccgtggataggtttgttttaatttttcagcgcttttccataatcaaatcgctgtgctttcatctcgatgctaaaatttgatctactgaccttgtccagtgaaaaacaattatgcgaagcaatcctatgctggattactgaaaatatgctatgctgtgaagaactacctcccaactcagtagatcaccagctgtaccttcttaataaagtacacctctctgtgacccatctatacaatgttacatgacttataccatcatatatgtgttgcctccttggtttgttcattgactacatttatgtatgttttctaccacttcactgaatattttggccacacagatttaagtctatctttctgtttaaacctgttctgcaggtgaggatatgcctcttacctttagaatttgcagcaggtatgattccttgatcatgagtttttaattgataataacattatgttatgcggttctcttgtttgatcttttgctatgtcaagacataatccatgctttttgattcatttttgtaggaacaaagagaaactgggctgagttcggaagcaaagtagagagtaggattcttaatctgctcaaggatagtttgcgaacagtattggatgcaattgctgatgacaacttggagagttaccgtgttcgaattacagaatattctaaggtttttatttttgccacctctgttgtaataatgttgttttgatatatttgaattgtctagaattcttttctttttggtgtttcttaaaaatataatacttttttagtgactacataaattggtcgcaaccacttcatgtataccttgtttgaatgactacatattgcttttattttatcaattgttgtaaaaataggtaaattatgctttactttgtatataaaaaatcttcttataaaacctacaaaatattataggctcaataactctttttacatgcttcgtgtgaagatatccttctgttatgacaaagtgctatcctgcattatcaaaagagattctggtcctttcattgtctattgcagatcatgcacttcgttgcacttctcactgatgaagattttgttttgcagaaaatagtgctttctggttgtccacaaataactactgaaatcttgtacatatcagtgctcccccctactaatgtgggtgcctcattgaataaaaggttagaaagttcatgggcccaagttgattaccgaaatatcatcctttacaatgagctggaggaggctgttaaaagctcatcatttggaaatgtgcacatggtggatctctcaaaatgtccaaatgcacattttagcactgcaattgactggttgaagttggcatttccagaattgaggatattcagagcttccttttgtttgacatttcagttcgaagacttgttatatctgctactgacttgtccatggattaatgaaattgatttgtctattgatacgagcattatagcacaaatgcattcagttatctcttccagatttgaaggacggggcgcagtgaagccaaagctcacaagatattatgcacaggatccgctatgtgataccacaatgaactcatatatctcaaatatatcaaaattgatattggaaggcagaaatgatattactggttggaaatatgttctgttcctactattgatttctttatagttatggatttggttataagaaatcttgtaaccatgtatgtgccttttctttttgcgtgtgtgtatgcagatgtggacctgttgaagatatccattctgaagaactctctttgttatataaacattaaaaattgcaccctattgacagatgatggtatttctaaattattactcaagtgtacgaagattcattcaatggttctttcttatacttcttttggaaatcagtcgattcaaactctatgcaattccaatcctctggacagcatggatgagtgtaggcatgtaatggcatttagaatgcaagaattgcacctggatgggtgcaaaggtaaacatggcttttgtttcatgtcaaaactttctccacaactaagcagatcataacttcctaggacagcagaagtggcattcttatttctatgttctattaactttacgctccattagcctagcatgggggaatctgggtaatataaatttatctacgtgcactgtgcaggtattggttatgccgctatgtctcagctaatgagtaatgtgaatataacaaacttcctatgtttaagggagacaacacttaccgatggcgctctctgcaactttgttggctcttcacttgagtttcttgatatttccgagaccgtggtatggttttctgtttcaaattatatgcatatggtcacctttttatatatcagaatatcagatgattttcctattctttgaaccaaagtacttgtgatgctaagcaaatattcttcagttttgaactttataagaatcaaacactgcaattgactagttgaagaaatgcttagactgagacttgcagtgaatttgctcagttggagactatagataaacaatatttttacaattaacttaggtaagggtaacatgtactggactatagattgtgatttatctttctgtagctttcagcgatatgcaatattgaattatggaacaaagtctgcaatgttttgatgatcacacaaaccaagctctactcgtccaacattgaatagaagtatatgattgaaatgatctttcttattgtacatctgaaaagggggcccatcacattttctacttttgtgtctgcaaaggacagagacagactacagcagtgcagtcatggttcatgattactgtcttttatcgttatgctgccataaaagaaccattactatggtctgttttgatatatatagtcttaaaagttttgtcgcctcaaaattacaggtttccatggtatcattagcaccagttataagaagaaattctaacttgagatgtctgaaagcagctggatgccgtaacttgctatttgaacatggtgaagtagaagcgatgagtggtggtaatatatacggagattttctacaagaaataaccagtacttgctgcttagaggatgttgaaatgggatgggcattttgccctattcgagttacaacccttattccttcttttagtaaagtaagaaagatgactattggacttggcacaacattaccagagaatatattgtgtgctcttcctgatatttgtccattcctagagtctttggttcttaggtttcaggtgtgtctctggctcttctccctactatttgttcaataataaaactaattgtgcctttaattcttttaataaccggatgatgtacataccagatgatctctgacaaagttgtaagaaatctgttgaaatcctcaacgaagcttcgggtgctttgcctgtactcttgtcttggcaatttaacttcatttagcttccaaatcaaggcaccattgctaagaatcttaaggcttgagtggattactccatggatgacaaatgatgacttggcagttcttatacagaactataacttagttgaactttcactgtctggttgcaaactccttgactccagtaagttctactttcggattcagtatgtggaccactcgtgatgctgttgggttgagtttttttttgtgatcaacagactctcaagagttaatctcgtctgggtggccaaacttgacttgtttacaccttgaggtatattataactacaattttttacatggggcatttgattaaaaattatctttatctttgcagtttttatttaagccaaaatttcaaggtttcagtgctgttatatctgtagccaccctcttaaataagtaacttctaacagaactaaaggatataatgtattcatgtccatactttatgcatcagcatgtatgtactgtataatcgtagttatttcactagtagatgtttatatttcttgatatcatcacgaatatacctttttgtacattgattaggcattcaatgtattgaaaactccaatctacagctgaaattgttaacatcctccaaaccccatctcttatgtataggcttgttgatttacaggaatgtggtcagataacacttgacggggtttcttcaattttaaactgtaaagctttggaagatctgttacttcggcacacggtgagcatagaaatgccgtagccatgtagttgagataattgatagtatgatctaaaaactcataaacctaaatattttgtatgctattgtgtttgtgtaactgtaaattctacaaataaagcatttttagaactataaattaaattaaaggatgtgtagcaacttgttgctctttacacaaaggttgttaggtttatgacttgtgctgctataggaataatcccttcaccatgatgtttcaccattattaatatgc

SEQ ID NO: 6984 - DNA, 8684 bp, Oryza sativa
aaacggagggagtactacttagtgtttacagtggtacctgactgggaaagaattaccatttgtgcatataattctggcggggtagttttctacatcatacactgtgtagattcaggatggtgtaagcagtaagcacagtgctttgatctttcccctgcaaacggttaacccttgtgcatagctcagttacttgaatgaacgtttaaatgacaagaaacaagaatgaacactgccactaaatgattcaatgtgcaactatttctgctaacaagctttcgttgaagatgtttaaactgtatactggttaagtggtttatgaggcttggtcgttacagggcaaaggtattggaagaaccatcataactgatgccataacagaggtacctatcttatctattaattggttttgctgcccttgcaacattatataggtcacataggtgcaactcattttgctgtttatttcagttaccactactaagaaagctagctctggatctttgtgatgcttctgaagaaggctacgatagcccaaatgtgagtatattccaaagattttgccgagttgggcgggttaataataataataactgaataaagatgctaatatctttgcaattgttttgaagaacccggaggggaagatgatgaggaccataacgatgagcagatgcaagtcggtgaggtcttgtttcgagctccacagggaaggatcctcaaactcaaaaccagtgcacaaggagacgattgtgttggaatggagcagcagacagctaagaaccaccatagtgaaagaaaaaatacgttggagtacgccgattttcttgtaaatttgatatttcactcccctagtcccctattaccaatttttttttttaaaaaaagaaaaaacgcaaccttaccagcccaaaggcccaaagcccacaacagagaggagagtgggcgacggggggctagggcggcggcggcgcggcgaccagcgacgggcggcgcgcacctgaccggaatggcccacctcgcggcctctgccgccccgcttccaagcgctgaccccgacgccggcgaggagtcctcccactctccgccgccgccggagaaggggctgaggaaggtggtggtggtgatgggcgcgactggcgccggcaagtcgcggctggccgtcgacctcgcgagccacttcgccggcgtcgaggtggtcagcgccgactccatgcaagtctacggtgggctcgatgtcctcaccaacaaggtccccctccacgagcagaaaggtctcctcccgggattccccagttcttcttttgaccaaacctgcttcagatcgagcttaacagcgctatctttgccgtgttaccaggcgttcctcaccatctcctgagcgtgattgatccctctgtggagttcacttgccgcgatttccgcgaccatgctgtgccggtgagcctatgatgttgctgctacgacttttagtgctcctagtgtgccatgtttactgattagttgatgtttcttagtgctctgctcaccaattatataaggtatattggtttactgattaattgctgtttctgagtggtcacagattatagaaggtatattggatcgtggcggcctccctgttattgttggtggtacaaacttctacatccaggttgatacttaagcgcatgaggattcctgtatattaggctatttttcttctgaattagactatatctgatttttgtccttttaacacttattgtaggctcttgttagcccattcctctttgatgatatggcacaggatattgagggtcttactttaaatgaccacctagatgagataggtgaatgatgaaagcttagcacatgtttcttgttgttagcatgttttgatcaatggttgtgtccaattagtgtttgacttgttaaacactgcttaacacatgccaagcagggcttgataatgatgatgaagccggtctgtatgaacatttgaagaagattgatcctgttgctgcacaaaggatacacccgaacaaccatcgaaaagtaagggtgttgcacagttgtgcccttaacctgttaggtttctttggtagcaattggattttccttgtggtgttgccccatttgccttatccggttatcctgttctgcatgcttttttgttgtgttgaccagataaaacgctaccttgagttgtatgaatccacaggtgccctacctagtgatcttttccaagggcaagccacagaggtgagaaaaaaatgatttcccttttaattaatttctttattctgacttgttgctgactctatagtccatgtgaaatgtgcaaggactttatgcatattatcatgcgcacaacacattttttgccgtacgagttggacctcatgcgaactctaaatgtcctaatgaggtcatttgttgtcaggacagaagtggggtcgacctagtaactccagatttgactgttgtttcttgtggttagatgctgatcttcatgttctggatcgttatgtcaatgaaagggtcgactgcatgattgatgatggcctgctagatgaagtgtgtaacatatatgatcgagaggccacttatacccaagggctgcggcaggccattggtgttcgtgaatttgatgagtttttcagattttattttgcaaggaaggaaaccggtgagataaagatggattcctgtacaactatggcaggtctccatgatgataacctgaagggcttattggatgaagcagtctcacaactaaaagcaaacactcgcagacttgttcgacgtcaagtaatctcgacacttttttaagtaaataattgaaaattgcattttgtgtgttttatattcttgcctttcttcagagacgaaggctgcatcggttgaataaatattttgagtggaacttgcgtcatattgatgcaacagaagctttctatggtaatgatatgtgcatttcatgttttagttcaaagccaaaagatttcatgtcttacgaaatctaatgtgtttgcttaacatgtcatgcatatttctaggtgccactgctgactcatggaacatgaaagttgtgaaaccttgcgtggatattgttagagatttcttgtctgatgatacaattttggcaagcagagatggttctagtgtaactggaagccctaggatgtcttcaagagagttgtggactcaatatgtttgtgaggtaattgggaggcttttcttattcttaccaaaaagaatgttgataactgtatcgtcatttgtgcgttttgccacattttttgttagtgggacagcaatcaatctgatgaaactttcttgcctttcctgctcctattttacaggcctgtgataaccgggtacttcggggaacgcatgagtgggagcaacacaagcaaggccgatgccaccgtaaaagagtacaacgtttgaaacagaaggctagtacagtgatatcattataggcaattagcactgtttgcactctcggtgttcatgaacctttcttcattctctgcaactgtccccatgcatcctgtttgtcaaattggctgaagactacaccattcagaaggtagcaagcagcagatatatttgttaatagtaccttgctagattcttgtgccagttccaaacatccaatgcagagaatacaaactctacagattggtcagcacaagcacgtccgattgagcagcatctacactgatgaccagttggagtttctccaatctgctgatcatttctagactagttttcccattaaggacaccataaattgggtaggcggtccagcttgttagcaaagtggtgatagtgattagcaattaagcatgacattgacccatcgaatatttgcatatcttggtcttccagattgcatgatttttccttcatatgtgactggaaacagtggggccatgctaggttacataaattcctgggcgtgatacactgcgaatagtagctatcatgtttactactgtcgtgttgagactactgtacagtagctcgtatgtatttctcgtatgtttgtgcataagtgaggggtcgatgagagtgacttactagacttttctcatcctaaattcctaataactagaaaagatgaccgaaattgggaaggcgacttgtgcctcttttggaatgatcgaaatatagaggaactttcatgttgacctgattcttacgaaaatcatgtaaaactcgtgttcgttgtcaaaaggcccaacttcatctcagatgagcataagtataccatattaatgcttcaaaatggttaatgctagctcgtttttactgcacaactaatgctcgatgtccaaatatacttgggttattattatttttttgaaggatttttcatgtgagtctcgccgaggtccactaaccggtacacaggcgccgacctctggcacattattttacacgagaaatttaaggtaggcatgaaatcatcagtcgcacggatgcaaacgtgacgacatcatcagaaacaatatactgctgcgccgatttaaactacacttaaattaaataattctattagtggtacgagagtagtactactcctgtatgtagaatagatgtgcacgggcgcacgtgtttcatccctctaattctgaatccccacgtgacgatcgagcttaaagccgaacgggcggggcggggggataaagcgggtcccccagccgctgtctccagttcacacccacaacccgaagtcgatcgctcgtgttcgtgtccgcctcgacggcgaactcgacgggtcccgacccgcaaacccaacacccacacctacttatacccacctccactaatccctcctctcatcgcaccaccacgccactgagctcaagctaagctaagtgctaacctaggtgttcgaccatggacaccgaggacacgtcgtcggcttcgtcctcgtcggtgtcgccgccgtcgtcgccgggcggcgggcaccaccaccggctgccgccgaagcggcgggcggggcggaagaaattccgggagacgcggcacccggtgtaccgcggcgtgcgcgcgcgggcgggggggagcaggtgggtgtgcgaggtgcgcgagccgcaggcgcaggcgcgcatctggctcggcacctacccgacgccggagatggcggcgcgcgcgcacgacgtcgcggccatcgccctccgcggcgagcgcggcgccgagctcaacttcccggactccccctccacgctcccgcgcgcgcgcacggcgtcgcccgaggacatccgcctcgccgccgcgcaggccgccgagctgtaccgccgcccgccgccgccgctggcattgccggaggatccgcaggaaggcacgagcggcggcggcgccaccgccacctcggggcgtccggctgccgtgttcgtggacgaggacgccatcttcgacatgccggggctgatcgacgacatggcgagggggatgatgctgacgccgccggcgattgggagatctctcgacgactgggccgccatcgacgacgacgatgaccattaccacatggactacaagctatggatggactgacatgtatacacacatatcgttcgagtatatatgcttacagatatagataatactccatcagttcctactaaatacggagtatatatttttagataaaggatttatataaaacccggcttctacatcccgaagaatgtacacagccaatcctactaaatatatataagcacctcttgtttgtttagaaaaaatgagattaagggaaaatattctctttttgctgtctcacgatcaaattttgaattttgatgaattactggatcatcctaagcatattaatatattagctaaaaaatacttgcatccctgtgcattgaaattggtgtcacacgagtaataaacacaaaaccatccattttggttttacatttgttttatttgaataaaatgtttgtcgaaatgtttatattgttacaaaattaaaatcctaaaaatactttgacagtagatggatagcaaaggtatccacacatacacacataaagttcagacaagcgtcagccttagctagctagggaaaagagtaaaaaagggcaacaaaatattttctcaatagacaaacgtgtgaatcaattaatttgcagatatttggctaataactttttgaatatcttgagtggacatcctctaattatcattatataccctaaataccatataattagtttcaaatcaaaattttctccaaacatgtggcactttttatataacgtacatatatataatatctatgatcaaggggtgaactcataaatttgttgcacccgtgacatatatagtactgtacatgtacacggatcgtgcttaagagacatatatgcatgatgtcatcttctatcgagaaacaatctaacacacagtaggtcgttttgccaaaaatcttttggccaatctaacctcaaagtaacacggtcaatctgcaccttagagcaagtttaatagtatagccaaatgttaactccaaatcatctataactaatctaatagcccattcatacaatagttacctataaaaatatactccctccgtttcaaaatgtttgacaccgttgattttttagtacgtgtttcaccattcgttttattcaaaaaatttaagtaattatttattcttttcatatcatttgattcattgttaaatatagtttcatgtacacatatagttttacatatttcacaattttttttgaataagacgaacggtcaaacatgtgctaaaaagtcagtggtgtcaaacattttgaaatggagggagtactacagtattaatacccggccggtcccatctctcatatacacagaacgtcttgtagtccgtgttgcagctggctataaatctgtagtctaggggtgcaagtgggtcaaccgcgaacccacttatagatcaaaataaacgagcttgtgggttagtttagcctataaatgggttttcgcgggtagccacttgcacccttactgtagtcctctttcttttctctcctcttttcttctcaatatggttatagcggcttatagcctgctattgtaattgtacttgctcttacaatccccacaaattcttaagtctctaaactcaaagttacacacataaagctgagccaagaggaccggcacgcaactcgggcagccgcctaagctcactggtgggccacaatactatagattgatcatactatatattattttcttcaaaggagaaataaataatagtacgatcgatatgactactaagtaaatcggtcgtactattagtttctgatatgcatgaatatgattacttaaggaagaacttttaaccttacatttactttttaggcttagagacatagacatacattatcttaattatggatcgacactttgtaaccactagattaatgtgcatatttatctaaaaaatatgttatatacaaaatatgcatataactttgtaaatattttaaagttttaatatggtgcgggggccggcctcctctattgttttcagttttcaggtaaagaaacatgtttttgccatgggttcttcaaagttttcaggtccatcactggcactgcttgcacaccaggagaaaaaagagttaactagctagcatatatatatatatatatatatcagtagtaatttctcgagagattaatttgtgtgtttactaatgcacataaaatttgagagatgtttcctcaaaaacatgcagatcgatgaaattatatctgacaattgattaatttgacaacaagatcgagataacaagattgattaatttaactaaatacgggtcgatcgactgctaattgattaaactgagtagagctagctagttttgttggcatatgcgatatgatgaagtagctcgatcgatctccggcgccgcacaaattaactaccaacctgaactttatagtaaatgacctaatgacaacgacggcaagaacgcacatattatacatgtatcgcataaataataataaacaacacgtgttgaggatttacaaaagggtagcacacggtgaacactatatttacatatatatatattaatcatgtatgaaacgtacgtctgtgagacctacttgctcttttcattcctacctttaatttcttacttctcacgacgctaattaaacatcatatatagagtttatctcctaacgcagtcaaatacacacacacacacgtgtttgtgactgtgtgtgtgatatttaactacacatgtagatgtagtcacataaaacacatcaattttttttttgctgtgtacatatattttgaatgtagaggtcgggttattttaatccattttataaaaaataaacacatcattttggtcttcttatagtatgttataagtcaaattttaaattttaaacatcgatctgctttcagatatatatatttggattggaggcatgaaaaaccatatgcataaatttgtctcgagaattatcttggtaataacataattgttttcaaatataattttgtatgccctcattacaaaatataattattctagttatgtgtatatactagtggtgagaatcgtatcttgaagaccatgcaaatgtctgaaaataacatactttcgtatttgggcggagtatatatgcagcttgatgccttgatatcaatatat

SEQ ID NO: 6985 - DNA, 5652 bp, Oryza sativa
  unsure (1)..(5652): unsure at all n locations
cggccctctagggcaatgggtgcaggttatacatgatagggagtagtactatattgtatacttacggtactgaaccatttatatatatggttttgtttggcatgactgcaattacaactgaattttttttatagaaaatagattttatagactaaattaaagtgttttaatcttcttcttttttcttaaatgtacataaaatgtctcatccagatatccttaatttaccagcatatatagctcgacctttaagaatttctatagctctaaattaaattatacattaatggagctgaagttttgaccagcataaatgtcgatatagcaaaattctatatgtatcagacaatatatatgtcacatcaatcactaaccaacttgctcatactctatatagcaaagcatatatgcttaaaaagtagaagaaatcacttgattaccattattggcagcataactcacgagtagtggttaataaaatataaaacttaaggtgattttgctttttttttgtgcagattattactgacacacaggcttgtagattctccactagctagttggtcggtgtagttttcgccttttcttcttttattattttactatacagaaacttacacgcacataggcacatcaccacggactgacacaccacactactagcgggtgtcatgatcgagtgtgaaggacatgattaaggttaacttttgctattgaaacatgtcttaattaattaagcataaatcatgcaatcaagaagagtaccacactatgtgaagggagttggattttaagcacttaagagagatatgttttacatgttactcgctataagatgtcagtttcacacgtttgataacactaatacaatatttgtctactgcccccacaaaattaaagtcgtaataactaaggtccaaatttgatgggcacaaccaaaaacatactttcaacataatacgcgaaattcttatgtacacatggcggcacatgtggaaggaaagaaaccacaacacaaatattccaaaaaaggtgtagttgcactatatatttatatatgtttgtatttgtttcctttcttaatgtgtaaattgagtttacgctagcttgaaattatgtcacttgatcttttataatttttcagaaagtacattagcggtggcattggaaaagtaggatcgatggttttcccatgttatgcacatggtgcacagtagactagcatatctcattgcaaggacttgatgtacatgtaagaccaaacaccaatagtttcatcactttcaacatatatctctatcatgcattgtgttagcactgtgtggagtcagctgtttatttacatatacacacacacatttggctataaatatatatggacaacatatatgtgttggaaatgttccagaattccttttgacatgtaccatgcaaaaggagaattttggattttggtgtgccgggccgtaactagctagctagcaaacttggtctagtcgattcatcaggtagaaaaagtgatcgaatcgaacggcaaatgtgtatagacaaagagaagagaacaatcaaaagcaagcgagagcaatcaaaatgtgagggcagcgaggttgttcacccaactagctccgacaaggaaaggaatagtaccatcatatcggtcgtcgatttcactgtcgcgatggattactgtgtatcaccatcggtcgtcgtcgctgtcacacaaacgggaaaaggtgaaggcaacaaacgtgaatttttgcgatgcgttatactccatatgcctgcacgtgtggctctgcacgctttaatttcttggaccgatcgagctagctcccgccaccaattatacgtttatatatccccatcaattggatccaattgattgctttaatttctgcattttcatcggtcacttaatgcacgtttgtcacacatatgttgtatgtacacaatttaattccccgtccggtattattaaatatatgacggtgttatttttaaatatattttaaacgtttataatattaaaaagctatgtagttattatttatttcattgtaacctgattaaacatatcttatatttttgtgcttgcaaacaaaaaactaacaatgaatggcaaacaaatgtcaaaaaatgaacggtgtgtagcatatattaaagacatgagggaatatactgggttttaaaaaaaacatattaatttatttttataatttttaagttaatatttaattaatcatatgttaatgatatctttcgttttctatgtcggaatgattcctaaccaaccgtaccgaacataacctactacattgttatatatgattggccagaaaattttctcgtggacgattattcgtagggattcgatttggacagccccacacagcaggcgacattactacaggtcaggtcaatggacgccaccgaccaaaatagtgacatccatgcagcaaagtcggttgcttcaaggactagaacattttatgaccatcactgtcgtttagctggtttgcccgagtggttaagggggaagacttaagatcttctgcacagaagtgcgcgtgggttcgaaccccacagccagcactatttttgattttttaaatgatttttgattttttttaatgatttgcaattcagattaattgatttctttttactttttgatttttaaaatgatttgcaattcagattatttgattttttttaaatgatttgcaattcagattatttgccttttcaaatttttcttcataacataatttttattacttcttttttcaaaatgatttgcaattcagattatttgctttttcaaatttttcttcaaaacttcatattcaagtcaatgctcgtgatattgtacagtttttattttttattttttaaatgatttgcaattcagattatttgctttttcaaaattttcttcaaaacttcatattcgagtaaatgctcgtgatgttctataaagatttggacaaacacaaaggttttgctcaacatttgcaattcagattatttggtttttcaaaattttcttcaaaacttcatattcaagtaaatgctcatgatgctgtacagttattattattattttttggaatgatttacaattcagattatttgctttttcaaaattttcttcaaaactttatattcaagtaaatgctcgtgatgttgtacagttttttcaagtactgctcctaatgttctataaagatttggacaaaacacaaaggtttagctcaaaatgtccaaacttaacgagtattagccttgggagcaaaaatcataaatattaatcttaggacaataagttttgttatttctgcccatcgtcgtataatttcactagttatagcataacaccaaaattaatgagtactatccttttgaaaaaaaaacatatgaatatgtctggccaaatatttcattactgttatccttggacccgttaaaaaaatccataaaccttaaccctatagtaaaaaaaaattcatggtttacccttcggcatttaatttcattaggtatagtctttgatcaaaattcatgagtattaacctttgcaaacaaacgcaaggatatttttctttagctcaaaatttcaatgagtattagtcttaaggactgttgtgtacaaaatcgtgaatattaacctcacaaaaaaaaaactattcatgatttttagccatctacctatagttagtgatttatagctttcggccaattttttttttaaaaaaagtgtggttatgtttctctggtccaaaatttcatgagtactcgccttaggcgtattaggccaaaaaaaaagacttgaatattaacctttagctgaaagaagatatccaaatcaacatgatagggtaaagtaaagctcataatgatttgctttttcaaaattttatttacaattattagccaccacttcatttttatttttcagtttttttcttcaaaaaatttcaaatgattttttttcttcaaaaaattcaaatgatttgcagtttacaagagtaatgcttgtagtaatttgatttttcgaaatttccttcaacaatattcaaagatttccagtttatacacaagtaatgctcgtaatgttctatagttttttaagtactgcccgtaatgttctataaagatttggacgaaaacaccaaaggttttcctcgacatatcgtgggctggaccagtcgctcttggttgcaccacaaatataagtaggccggccctgaattgtttccaagtaggcaaaacatgcaatgttatgctttatcagtgaacacaacggaaggcaatcaaacttgcagttggatcatggatggtagtattaaaagaggtcttttacttttactacaagcctttcacttaaagatattgcaagttctaacatgacagcaaggaaaaggaagtcacttgcgcatgatgggcaaatacagaatccaaacacaaggcaacaatgacggggaagaaaaactctaatcagatggacatagattagagaggtgcaccatcatcgcacaacatctttatcttcttaggatttaaagcagagactaaagctttctggagcaaactaagaagacccgttcggggatcggccatcaggcgaatcatctctttccttgctttctttccacttaacccaggcccatcttaacacaataaacgctccaagagcataaacctacagaagtagcaaggcaaatcgtcttttcagaaatatgtgaagtatgttgagatagcacaatgagtgaacacaagagcatatatattgcagcacaattcaaaatgaaaaacggatgctgaaccacatatggttctctgaaagtctgaatgaatatgttgatttctctgaaatttggagtcattgattagcagatactaacagtaatattttctgcattaactaaaaaagtgtgagtatcttgttagcaagaataatagggtcccgaattcaagacaggctcgtttccttgattgcatcatctgaacaagataactgtacccaccttgctgaatctcagctcctgattttagtaaatccaacatcaagtggtgattaacttgcagaatattcgcatgcacattttgctcccacggacacaggattgaggtgtttggcaatattctatttgatttttcggaatcgtgcatagcaaccacaattcactacatgggactttgaggtagacagtcatttggtctataactggatacacacaatttgggtaaagcacacgataaattacagtttcgatggagacaattggaaggagaaacagtactaaattcttagaaagtttgaaagacaaaacaacaggtgctaattctcagagtaggtgtgaaatttaaaatacccaattgggaacattctacacagcagcctggtgtggtaatccacttgtaattatgcatagtactgggaatgagtatattgccttcaagtttgtgcattctatcctggactaccaacttaccaagtgctcgcggattagatcacaggaaatgagccattgaaagttaaaaggttgcttatctaagacaattgttttggactacnnnnnnnnnnnnnnnnnnnnnnnnnnnnnnnnnnnnnnnnnnnnnnnnnnnnnnnnnnnnnnnnnnnnnnnnnnn

SEQ ID NO: 6986 - DNA, 14998 bp, Oryza sativa
gccggttcttggccggctccagatgctgcagcggctcgacatcaagaactccggccttgtctcaactctgccgtcgcagctgggaaatctgaagaatctcattttcttcgagctgtccttgaaccggctctccggtggcttgccgccggagttcgccgggatgcgggcaatgcggtacttcggcatttccacgaacaacctcaccggtgagatcccgccggcgttgttcacgagctggccggagctcatagtgttccaagtgcagaacaactcgttgaccggcaaaattccatcggagctcagcaaggcaaggaaactggaattcctttacctattcagcaacaaccttagcggttccatcccggtagagctcggcgagctggagaacctggtagagctagatttgtcggagaactcgctcaccggaccgatccccagctcgctcggcaagctcaagcaactcactaagttggcgttgttcttcaacaacctcaccggtacgatcccacctgagattggcaacatgacagcgttgcaaagcttcgacgtgaacaccaaccgtctgcaaggtgagctccctgccaccatctcgtccctcaggaaccttcagtacctctccgtgttcaacaactacatgagcggcaccattccgccggacctcggcaagggcatagccttgcagcacgtgagcttcaccaacaacagcttctccggcgagctgccgcgccacatctgcgacggcttcgcgctggaccaactcacggcgaactacaacaacttcaccggcacgctgccgttgtgcctgaagaattgcacggcgctataccgggtccggctggaagagaaccacttcaccggcgacatctcggaggccttcggcgtccaccgcatcctgcaatatttggacgtctccgggaacaagcttaccggtgagctgtcctctgactggggacagtgcaccaacctcacctatctgtctatcaatggtaacagcatatccggcaaccttgattcgaccttttgtaaattgtcatctcttcagtttttggatctatcgaataaccgattcaatggtgagctcccaagttgttggtgggagttgcaagctttactgtttatggacatctccggcaacgacttttatggtgaattgccagcaacagaaagccttgaacttcctctacaatcgatgcatctcgctaacaatagtttctctggagttttcccaaatattgttcgcaaatgtggagcgcttgttaccctagatatggggaacaacaagttctttggccatattccctcttggattggaattagtcttcctctcctaagaattcttatccttcgatcaaataatttcagtggagagattcctacagaattatcccaactttctgagcttcaacttcttgacttggccagcaacgtgttaactggattcatcccaacaagttttggcaacttatcatccatgacacaagcaaaaaccttgccagcgacagaatattttaacgcggaaagcagtccttttcagccagaagtaccccaggttcccaagcctcaccgcagaagagaacccaaaaatcagtcccctcttgatcagtctagagacagagttagcatacaatggaagggacatgaagaaacttttcaaagaacagctatgttaatgacaggcattgatttatcaggcaattcactttacggtgaaatcccaaaagagctaacataccttcggggcctccggtttttgaacttgtcatggaacgatctatcaggcagtattccagaaagaattggcaatttgaatatcttggagtcccttgacttgtcatggaatgagctttcaggtgttatccccgcaagcatttcaaatctgtcatgcctcagtgtgttaaatctctcaaacaaccacttatggggaagcatacccacaggaagacaacttcagacatttgtggatccctcaatttatagcaacaatttgggcctttgtggcttccctttgataatagcctgccaggcatctagattggatgagaaaaatgaagatcataaagaacttgatatatgtttattttactctttaattcttggcattgttttcgggttttggctttggtttggagttctaattttacttaagccattaagagtttttgtttttcattctgttgaccacatagaaagaagctatgcaaattgcagaagatgtatgcactaagtattcttcagatgcaaatcagcaaccaaataatatgcccctgttgcttttcctcgacagaattatatgtcaatgtcatgattttcatttatcttctctgtcttgcatttacaagtttgcttagccaatgggaaaaataataatattacacagggatagaagcaagtagcaacgaggaatacaaagttgatgaaggacagaacttttgtgattgatagtcttcagaataatttcagtacatgtatcaccagtaatagagtactatcctaagcttgcccctggcgttaatctaacaatgcatcttagctgtgaaattccaaccgttcccgacggcgcaacgggtgacctggagtcgctccagcgagccatggcgatcttgccagtaaaagagagggtaaaggagattcatcgcgtgtagaaggacgatggtcacctcaatttcggacgaaggaactcgggtgcgggagaattttcgggatttggtggagccggtgaaagctagggttttcgccgcgtttgcgtccggcgacggcgatggaggaggcgaagccctgggcggctctcgggcggaggtagacggggcggaggcggtctcttttgccgttggcggcatagctcgagcgcatggaatggaggtcgagcttgtcgtcggcttggtttgttggcgcggcaaagcttgggatgaagcagaggcagagctactattgcgtggctcggcaaggcgatggagagcggccgagcagagctgcagaggagacagcgaatttggatcagaattcagtagagagagagagagagagagagagagagagagagagagagagcgagaggaccaggccaggaggagatcacatcaaggtgtagttagtatattttaattttgaagttagagcatcttttttattttaccccaaaataaattttaagtgattagtgataaataagtgatcacatcagtggatatgctagatgcaaatcagcaaccaagtaatataccactgtcagtttatagggatgtttgttttggtcatttttgcaacaaataactccgattctatctatccaaataaaaacttggtatgttagatgcatctttactaaaagataaatatcagggtgtttagatccagtggtgtaaagttttagcgggtcacaacatatatacggacactaatttaaaatattaaatatagactaataaaaaaactaattacataataagcctataaactgtgaaacgaatttattaagcccaatttatccatcattagcaaatatttaatgtagcaccacattgtcaaatcatggagtaattaggcttaaaagattcgtctcgcaatttacacgcatactgtgtaattagtttttttttctatatttaatacttcatgcatgtgcctaaacgttcgatgtgacagggtgaaaaaatttgtcagtggatctaaacagggccatcatctttatggagaacataaacatttatcaactctgtgctaccgcgtcgcccacgcgcgggtggctcaggggaaaacctagcaccgccgccaccgcccctctctcctcctctccctcccctcaccgccaccgaagcgcgccgctagagaaccgagcagctagccaggatggcggccgccgtaagatggtcacgctggacaggctagtacgggggagaggggatccattcttctctctcattctctccctttccaacccaaccacgtggatggattgaagcgcgatgaaggatgagactcttctttgatggccagccaacagcgagacgtcggcgcggtggctgcacgtcgaaggggattagctggtggttctgttgaatctggcatgcactctttagcgcgggagagtagaacaaggagcgaaggcctagccttcgggccggcaacggcgacgcctacaggcaccgttttcaccttgggacgttgttgcgttttctatcgtttcccaagaggttcttcaagtgaaaaccacatcctggttctctaggatgggcggcggtggtgcttttggcgtcattttcctccttggagccatcgtttagaagacttattccttaggggtattgtgtgtttgttcagtatttagcagtaggatcagacgcagatgcgtggtgtggttatatattttctttttttttactatagtctctcaggactatagacttatattttattccttctttatcaatagaaatgtcgcactagcgggttgttttaaaaaaagaacagctacgttctaccatgatgtacttgatgcctatctggttgtggttgtctgatgtctgcagaccgcaacctttctattttgaagggattttttcatgcatcatataatttattttcttttgaaaaaaaaagtccattttactctcctaaactaattcaatggatatcttaacccctgaactattttttctcgttttatcccctaaactactagaaatgtcgttttactccttaataacatttcttttttttactctttatacacgttatattttaagctgaaatttattagagccatagatgatacaattactaaagttcaaaaatattttgaaatttttcatgacgtttgcttgaactttaaaattctgatgtttaaatcagtttgaagtgctttcaacctatgtaaacagtgagaaaaaaaatcaaagaagaatgttgagacttaagttatggatgcatctatattctaccaaaatttcaatgcaaaatatgacttatatagtgagaactaaagaagataaatagtgttaggggatgaagtggactgttttaaatagttcgggggtgtaaaatgagttaaaaatagtttaggagattaagtactcccgtgaaatagttcaagggagtaaaatggaactttttcttttcgtttttgtatcaaagtgcaggagcactgcccgttcatttacagtatcacacacatttatctgtcgtccgttctgatttctcagaatatgcttagttacattcatagaagaagaaagaggactgctggaatatatatacagtttatttctaaggccatttacaatacaataaggtgtcattcagcctcaactagccaactcagatattccccttcacctcagcacttttggatggttcaccaagaacggggagccaaaacgtgctactcattcctcatcaaaaccacagttctgggcccacacaatttcgtgtgccatgccgtgcccatccgggaagagagaaggaccgaaggaggagagcatccacaccaccggccgtcgacggcgacggcgatgcagccaccgcgggcgaggaccggaccggtgacggcgacgcagccaccgtggacgaggaccgggccggcgccgcggacgagaatcggagggatgaagaagggggaggggggaggggagctcgaggttgatccgcgccgccgcttgggccacgccgccgccaccgtcgttgggggtggaggagagggtgccggcgacggcgatgcagctagccaccgcggacgaggaccggaagggatgaagcggggacggaagctcgaggtcgatccaggccgccgccaccgttgttggggatggaggatagggcgccgccgctgctccgctcgaccgctgccggacgctcggcgctgctcccgaccacgaccgccgcggccgtgctgcttgcgaccacgaccgccgccgccccgccgctcggcgcctctcgcaactgttgagattatgggcagcatataatgatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgctgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcacatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcatcggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccctgccaggcgaggcgagcgagcgagcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacagcaactacgaccgccgccgctccgctcgacgctgctcccgaccacaactgctgccgccgccgccgccgccgcttgagaccatgaccaccgccgccgcgcagctcgtcgccgtcgccggttcgtttcttctgccgatgagggatgaagagaggagagagacgaacgggaagatgaaaaggggaggagagaaaggtgggacccacaatactgtgatatgtgacctgcactgtggagtatgtggctaatagggttcctagtctacgtggcacatgaggatcggcattttccgtagacgcactgctattgccctaagaagtattgaggatcggcattttccgtagacgcactgctattgccctaagaagtattgcttttctacgagggaattatatggcgattacatttacaagtttattatttagcctatgaaaaaaataaaaatactccacagggatagtaacgacaaggaatacaatgttggatgaacgatagatttttgtgattcagtttacagaataatttcattatatatttattatcaccagttatactatcctaagattgcccttggaattaacttgacaatgcatcttacaaatcactagctgtgaacggttcagaaaaggtaggcttgaacggggactgctggaaggaggccagcggcgtgtggccgcgggcggcggctaaaaccgagcaaagagggggtgcggtggccgggagtcgctccggcgagcgagctacggcggcgatctagccaggaaaaatagaggctaaaagggagattcgtcgcgtgtaggggatgaggagcgatgcgcaggcgctgcggcgcgtgactcggcaaaggcgacggagagcagccgatcgatcaacaaggcagagcgggccagcagcccagtaggcagcaaagcaagagcaaaggctgcagcctgcagggggcagggaatttcggccggattggctctgggccagactgggccagaaaaaagaagaaataagttcaccatccctccctcaactttacatcgagtttatgacatccctaatccctaataccagaaatcttcacccctaaactttacaaaaccgtgcaatctagagtcgataacagtatggatctctgagagtttcgctgacgcggtatcctagtcagcacaaataaaaattaaaaaattatggggcccacatataagtgagaagaaaaaatgtgaggtccacatcttttctttcttctcttgtcttttttcttttctctctactgttttcttctcttctcttctcttcacgggaggccagtggcggtagatggggtagaggcggccggtgagaccggctgagctctgccaccgcacctaacgacgctcacgcgcaccaccgtcaccgtagccacttcccgcacctgacaaccttggcacgaccggcgaggtcgaggcatggcgtggggaggcgggcatcgaggacagtgcgatgagcatggtcgagggggagggggaggcggccggcaagcctgggcggcgccgggatccgaacgacggtgttggcaatgaaccaggcagcacagatggagccagcagccgcgcgctcatccttcagatcaggcggcggggtcgacaggccggtgaggggccgcttgatccgccgcaccagcgtgaagtccgggtcgggggttcctcgacagcggcgcccccgcaccagcaccgacaggccctcaaatatgcggcgagtagccctgtgagggtgctccggcgatgacagcgctggcgccgaacgggcatcgacggtacgggtgcggccggtggcgccttggcttgcttctccaacaccgtagctttcttctccgagcccttatccttctccttcttttccgcgccgctcccttcccatgctccgggtcaccggagcagccgcaagtggcggtgttgcggcgatctcattaggcttcttcgccgcggcgaccggcggtgacaaccactcgtgtagcgtcatgtaatgccacgacacactgacatgtggggcccgacatatgccacgtcagcaaaactaggggaatttttggcctatagagtcttgggattaactttaaacggttttgaatagtttaaggataaagatttctggtattggggattgaggacctgatacaaactcgatataaagtcgagggacgtcaggtgaacttattcaaaaaaagaacttgaaagaacaacgtccaatataggtcccttaaatattattatgttattgtgtagtttagtgtacaatattctgattttttttagttgtgttaaacaatactactttgtaactttgaatacccatgctagaaatcctgcatcagccaccgtttacaagtgcatgaattttagcgaatcctaatgaatatatgtgcacgccgaaaagcgtacaaattaatacatacatgcaccaaaattacacccggccattcaccccaagaatctatcttttttaaatagcaaaactggatcagtgggggtaatgagtaaggcactgacgacgagcacccaaagcaacgactgcacaccactggtggcagcgacactagtccactagcagtgcgccagtgcgagtatgcgactgccggagacgacggcgacgcggggtcgttacgtcgtgcggtgccgctggtggcctgaataaaaaaaactcgaatattagagaagaatctaatatcaaataattagaaggggtgagcctttaaatccagatcctctagcccaccaccttgtgaagctagccagaaaacttctgggcatttctcgctggtggcttgaatagttggcctccaccgcacgggctacgttttagccactcccgctctgcgaattaagcagaagtcaaataggggattctggtgatattgttaggggttgtttggttgagtgacccaactaacttgaggttattatatattttaagttattcatctaatagcatcaccaacagcttttttattctattccctatctttagattctatccttagatttaggaaatttttataggacaagcctatcagactttcttcatttatgggcttcagatagattgggctggttgagccgttgaggaactgtcggaattttgacggaaattaccatacaaatacggttaccgatgaaacggtcggaaaaacatccatcccatttccgctaccatttccgaaagatataaccgtttccatttctatcaccgttggttaccgataccgactgaaacagacagtgcaaattggaaacggcagctgaaaagctcggaaatcttcgtaccgttttcacccctaatagtagcattgcgattctaaatattttttcttcgtgaatagaaaaaattcattgtatcgttagatcaggtttgctatagaaaaattcggaacaaaacgtctaccgcgttgaagcctactccctgtgaaccgatataggtacacggtacacccgatcaaaaatgggttgatcgtgaccattctattggatcatcggaagttaattagaatcgttaccaacaacgaccaaataaaggctagttaagttggttaaggttcctgtggtggaacacccagttcaaatctcagatctttagtgttaaaatttgttcccatatgcgcctatgctataggcattacgtgcggtatgtgtgcgcgcattccggtggatcactggatctagttctagtgtgtaatcatcagtaggataatcacaccaaaaaatatttacgaactaataaatcactcttataaacttgaataaatatgtttacaaatagaattgaataaacgtgttctccttattttggctatatttcctctgcttttgtttggtctgttctttttaatttaaactacactctttctttgagtgctactttgtaataattggttgtagctcgttctgagtagagaccggaatgttatattccattatctaaaaaaaaataaatcacttatatttatatatagttagctattggcaccatcatatattcatatttgaaagagggacccgaaaaggcatagccggagacgacggcaatgcaggatcactgcgttggtgttttactccgcatggcccccgtcgtccaccctttcttcctcctccccctcctcgtggcgatcgcttccatcccaggatcagtcaatgccgcagcatcgtcccagcagaccgacgcgctactggcatggaagtcgagcctcgctgacccggtcgcgctgtccggctggacgcgggcttcgccggtctgcacctggcgcggcgtgggctgcgacgccgccggcggcggccgcgtcacgaagctgcgcctccggggactgggactcggcggcggcctccacacgctcgagctcgacttcgccgcgttcccggcgctcaccgagctcgacctcaacgggaacagcttcgccggcgacatcccggccggcatctcgcaactgcgctcccttgcctcgctcgacctcggcgacaacgggttcaacggctccatcccgccgcagatcggccacctctccggcctcgtcgacctctgcctctacaacaacaacctcgttggcgccatcccgcaccagctcagccgactccccaagattgcccacttcgacctgggagcaaactacctgaccgaccaggacttcgccaagttctcgccgatgcccaccgtgacattcatgtcgctctacgacaactccatcaatggtagcttcccggacttcatcctcaagagcggcaacatcacctacctcgacttgtcgcagaatactctgttcgggctgatgccggacacactgccggagaagctcccgaatctgatgtacctgaacttgtccaacaatgaattctctggccggattccggcgtcgctcaggaggttaacgaagctccaggacctgctgattgccgccaacaatctcaccggcggcgtcccagagttccttgggtcgatgtcacagttgaggattctcgaacttggtgacaaccagctcggcggggcgatcccgccggttcttggccagctccagatgctgcagcggctcaagataaagaacgctgggcttgtttcaactctgccgccggagctgggaaatcttaagaatctcacttttctagagatatccgtgaaccacctctccggtggcttgcccccggcattcgccgggatgtgcgcaatgcgggagttcggacttgaaatgaacgggctcaccggtgagatcccttcggtgttgttcacgagctggcccgagctcatatcgttccaagtacagtacaacttcttcactggcaggattccaaaagaggtcggcatggcgaggaaactgaaaatcctttacctgttcagcaacaacctttgcggatccatcccggcagaactcggcgatttggagaatctggaagagctggatttgtcaaacaacttgctgaccggaccgatccctagatcaatcggcaacctcaagcagcttacggctttggcgttgttcttcaacgatctcaccggtgtaatcccacctgagattggcaacatgacagcgttgcaaaggttggacgtcaacaccaaccgtctgcaaggcgagctccctgccaccatctcgtccctcaggaaccttcagtacctctccgtgttcaacaactacatgagtggcaccatcccgccggacctcggcaagggcatagccttgcagcacgtgagcttcaccaacaacagcttctccggtgagctgccgcgccacatctgcgacggcttcgcgctggagcgcttcacggcgaaccacaacaacttcagcggcacgctaccgccatgtctgaagaactgcacaagcctataccgggtgcggctggacgggaaccacttcaccggcgacatctcagatgccttcggcatacaccccagcttggaatacttggacatatccgggagcaagctcaccggtcggctatcgtctgactggggacagtgcaccaacctcacatatctgtcaatcaacggtaacagcatatccggcaaccttgattcgaccttttgtacattgtcatctcttcagtttttggatctatcaaataaccgattcaatggtgagctcccaaggtgttggtgggagttgcaagctttgctgtttatggacgtctctggcaacggcttctcgggtgaattgccagcatcaagaagccctgaacttcctctccaatctctgcatcttgctaacaatagtttctctgtagttttcccagccaccattcgcaactgcagagcacttgttacgcttgatatgtggagcaacaagttctttggcaagattccctcttggataggaactagtcttcctgtcctaagaattcttctcctccgatcaaataatttcagtggagagattcccacagaattatcccaactttctcagcttcaacttcttgatttggccagcaatgggttaactggattcatcccaacaacttttgccaacttatcatccatgaaacaagcaaaaaccttccccacaatagggacttttaattggaaaagtgccccttcaagaggatacgattatccgttccctcttgatcagtctagagacagatttaacatattatggaagggacatgaagaaacttttcaaggaacagctatgttaatgacaggaattgatttatcaagcaattcactttacggtgaaatcccaaaagagctaacataccttcagggcctccggtatctaaacttgtcaaggaatgatctttcaggcagtattccagaaagaattggcaatttgaatatcttggaatcccttgacttatcatggaatgagctttcaggtgttatccctacaaccattgcaaatataccatgcctcagtgtgttaaatctctcaaataaccgcttatggggaagcatacccaccggaagacaacttcagacatttgtggatccctcaatatatagcaacaatttgggcctttgtggcttccctttgagaatagcctgccgggcatctagattggatcagagaattgaagatcataaagaacttgataagttcttattttactctttagttgttggcattgttttcggattttggctttggtttggagctctaattttacttaagccattaagagattttgtttttcattttgttgaccacatagaaagaagctatgcaaattgcagaagatgtacgcactaagtactcttcagatgcaaaccagcaaccaaataatatacccctgttgcttttccttgacagaattatatatcattgtcataattttcatttctcttctctgtcttgcatttacaagtttattgcttagccaatgggaaaaataataatactccctccgttccaaaatgtttgacgccgttgacttttttaatcatgtttgaccgttcgtcttatttaaaaaatttaagtattttttaattcttttcctatcatttaattcattgttaaatatacttttatttatacatatagttttatatatttcataaaaaattttgaataagacgaatggtcaaaaatatttaaaaaaattaacagcgtcaaacattttgagatggagggagtattagacagggacagaagcaagtagcaacgaggaatacaaagttgatgaaggatataacttttgtgattgacagtcttcagaataatttcagtacatgcatcaccagttaaagtaatagagtactatcctaagctttgcccctggagttaatctatctaacaatgcatttatgcatcttaactgtgaaattccaaccgttcccttcccggcggcgggggaacgggtgggcgggagtcgctccggcgagctacggtgatgttgccaggaaaagagagggtaaaggagactcatcgcgtgtagaagatgctggtcacctcaatttcggacgaaggccgggtctcaggtgcggcgagttctcgcgaattggcggaggcggtgaggttagggtttcgcctggtttgcggatggcgacggcggtggaggaggcgaagtgttgtgcggctcttgggcggaggtagaggggggcggaggcggtctcttttgctgttggtggcggcttgatcagtgattcggtgaaagatgatg

SEQ ID NO: 6987 - DNA, 4255 bp, Oryza sativa
tgggtggccgcggctgcccccaacctctagtcaagatatcccggttcccatgtcaccgacacaacgttatctctaaactcaccgagaacggtcacatgagctcgataacagttactctaatgtctgcgcgcggttgagaatatgaattcattcatttgcatcgaagttgggggctactgtcagggttatggataccacatacctaatagtagttgactaaatctccgcaggatccaccacataccatgtcttatacggaaactgacttcagatatggagggagttctggataaggaaagacaaccagagttctacatggaaacgacaaggactactcggattgtatccatattggtttccctagttctacttggacaagaggaaacctgtgggtataaatacaagcccccctaggaggacagggggacacccatgatatgagacgatcaacatgatcaacaaccaccatgggggacaagacaatcaacacccaacgggattaacacctgacaggatcaacacccaacgcaatcaacacagaagcctacatacgccaagacacgccgccggatatcgacttcagggataagcacggctagtaccctacggtgtcttcggatactgtcaggagagacgaaagcgctatctttgttctcgccgggcacggattcgaggtggaaggctaccctgttgtcgactacgagtcagatcgttagaccgccatgtcgacaacagttagataggctaccccaaacattgtactggtgtgattatcatgaataagagcaataccggcttcggccaacagaatgtagggttattacctgaccgctcaggggcccgaacctgtataaaaatcctcatctccatctcttttacctcagtctcgcgtataccctagcaccgacgatccccatactatgcaaataccagaattgcgacatcaaacgtcgacactggcgcgccaggtagggggattttggtgcttcaggatttcgacgagatgggtttaagagatgaactctccgacaaccagctgagatccaacctaaccagatcggaaccatcatcgtcatcgacaacttggtctatcgagatcatccaagcctcaatatacgcgacgtaccaaaagatgtcagatcatatgatgtccaacgagtacgcaataagataattggtagattggtttttcaaattgatctactaatttcgtaaatacatccggcatgtatctacaaaggtacgcaatattttatctgcaatttatcgtacctattcagatcatacatcattgtcagatccatgatttattatgtttacctagagcatgttctttatacaataatatctgttgcgcgagtgtccccgatgttaaatcgactacggtctaacgtagggggctcgctctattttcttctgtataaatcatgcttgtttacggtttacataatgcctgacatttacatctgctcattatatcctgataatactagaagatccatgcagtttttgagtacatactcgatatcccatgctatatatcttgtcttctagaaaatatttttcaggaacaattgagcactcgagtatattgtggtcgagtacaccgcattatcgagaacgatctcgacaaatgcagagtcgtcgcgcccaacctaccaaagaagtccgacgacctatctcatagcgctagccatcgctggactactcgagaaaaggttgttaacggataactcctcacgaacaccgtcggcttgatcacccgacatgattgcgagcggacatccggatatgctataagttgggtatgtgagtcatgctggccacatgatatgcacatgtaataaaccaactttagcgcccctataggtgattaagagactcctactcctggttctcgaaccagcaaaatgtagtgatctctctcgcctcactttaagtggtcgagttacgactactgcctggtcctcgactagcgatgtagcgtttctcccactacttctactttcagtggtcgagttacgactactgcctggtcctcaaccatcgatgtagcgtttctcccactacttctactttcagtggtcgagttacgactactgtctggtcctcgaccagcgacgtttgtttctcccactacccctgcttcaacaaagttgataccaggtgcacaagatcgccaagggttttacccagagatcccttacccagatgacacctaacgttgaaacctatcctaatgtccctttacgccgtcttgacaaggcctccgatgaacctgagggaacttcggctagggacgcctagagccgataaggccttgttggatccttcagagacgaaagaccatgtaagacctggtcgtgtaagagttctcgccgtgcgtattaaccaagccgtgtaattggaaattgagttttccaacttcatggctggggactaggatcagtgcttgttcaaccgaggcaggtcaaaggtccaagagccttgacatccgagaacgattctccgacgacaaggctgggggctaaggagagtgtatgactctacaaactgactgatcggagtcggtaagagagaagacgctcatatacaaaacactagtctgtacattcaattcactagtctgtcatattataacatgtcaccctttgagaattcgctcgggggctatttctatctaatattcttttctgagtattgattttaggaaaattctattcgacattatcgaggactccatgtctctatggttctaaaccaagattgactaaggcgagtgcgacaaatgtcgacaaagttctatcgcagactctacgccttctcgatcgctcgagaacggttgctagatctcgacaaggaatacggaatgaagaaatggtgtacccgccgagataaaatttcttgacttcaatccaaattctcgattacagcaagacgtgagacttagtcgtacgctctatattttctcggtcgacatcaaagattgacttagacaaaccctttcggtgcccgcacgaggctgacaaaggaagtccaacgtgacgaagcgtggggctcctcaccgggagaccgcgcgggcccccctttgccggttcggccgggggcgctgggtgaggttctaagcccttgatctgtggaatggttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagagaccctctcactcctcttttctccagtccccctcttggtaggcatggtcctccttttatatctcaaggggataccacatacaccatttctacctacccttcttttgggtggggacccatcctactttgaccaaaacttggctcgtaccttcgcctgacaccgggataaccctgtcctccctcattaatgggcggagatttgcaatggctgctgtccgaatgaccctccgatgggatgggtcataccaacctccactccgccggaagcaggtgcaacgtggaagcacggttgtttgctgatgacgtgaccggcgtcagaccagtcacaaaccggtcattcttgtctaccacgtgtcagtttagcatgccacacgtcagcccttcttcataaaatgacttccttgtaatggttgcgatgaagcctggtatgaatctagccgggaccgacgtgctaactccaggagttcccacgccggctccgtctagggacgagtgcctagaggctctcatcatttcgacgggacggggcgaggcgtgcgaaaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaaccctcagggggtcggggcgccccagccctcggggacgaaacgggagcggcccaacccctcggggagatagagggaggggcggcctcatcaccctcgggcccgacccccccgagggggtcaggccacgtgggtgaccgcggctgccccaaacctctagtcaagatatccccggtcccatgtcaccgacacaacgttatctctaaactcaccgagaacggtcacatgagctcgataaca

SEQ ID NO: 6988 - DNA, 3303 bp, Oryza sativa
atcgtttctgttcggttggttttttttctttggttttttctttctatttggttttttctccggttttttcgttcggtttgtttttttctggtttctcttctgtttggtttttttcttttttaatgtataaatacaaaatttgtattcgtatgtataccaagtttgtattcgtacgtatagaactttctatacgcgcgtacaaacttttcatacgcgtatacaaactttctatacacgtatacaaagtttgtatacacatatacaaagtttatatgtgcgtatacaaactttctatatgtgatgtttttttttatttttttattttttagtgcgtatacaaactttgtgtctgtgtgaatatatttttatgcattgaaatatattcataaaaatatatatgtgtgttagggttatggataccacatacctaatagtagttgactaaatcttggcaggatccaccacataccatatctaatacggaaactgacttcagatatggagggagttctggataaggaaagacaaccagagttctacatggaaacgacaaggactactcggattgtatccatactagtttccctagttctacttggacaaggggacacctgtgggtataaatacaagcccccctaggaggacagggggacacccatgatatgagacgatcaacatgatcaacaaccaccatgggggacaagacaatcaacacccaacgggattaacacctgacaggatcaacacccaacgcaatcaacacagaagcctacatacgccaagacacgccgccggatatcgacttcaaggataagcacggctagtaccctacggtgtcttcggatattgtcaggagagacgaaagtgctatctttgatctcgccgagcacgaattcgaggtggaaggctatcctgttgtcgactacgagtcagatcgtcagaccgccatgtcgacaacagttagataggttaccccaaacattgtactggtgtgattatcatgaataagagcaataccggcttcggccaacaggatgtagggttattacctgaccgctcagggacccaaacctgtataaaaatcctcgtctccatctcttttacctcagtctcgcgtataccctagtaccgacgatccccatactatgcaaataccagaattgcgacatcaaacgtagataatatgtatgtatattatgtatatatgcacacgtatatacatatgatgcatatagtatatatgagagactagagggggggcgattgaccgcgcgcctcctcgcgcgcgcagctgatcgcgtatcagcaccccggggggaggggggacaagtcgacttgttcgcagctaacttttcgttaaagtgattgatatcacttattctcaacaccatatatcttttcactcctaaattataaaaaaaccatgtaacttagggtgagttcgagaagaggattgagaagattgggaagatacgcaaaacgaggtgagtcattaacgcatgattaattgagtattaactattttaaatttcaaaattggattaataagattttttaaagcaactttcctataaaatttttttgcaaaaaaacacaccatttagtagttcgggaagcgtacacgcggaaaacgaaacaaacaaactctaaatcacctcaccacgaatgcagccttagatccgattaattacagtaaaaacctcatttttccttgttttttattacatcgtagatgtctgggcccacttgtcaaccaaccaagctacgaccaccatatcaccgagagaaaaaaaattggcgctcgtcatcgctccgctactccgcctcccgatctctcctacttccccaccacaaccgatgccggcggtagccccctcccccccccccccctctctctcctagcgtgtaactccatctccttggcgccctccccctcttagcaatagcgtctgccttcgtcctcagtgcagcaggcaaccgcgccttgccgttgcgaaacggcttcgaccgctggtggacgaggaagctgttgctcatgtatttgtagacaaggagaccattggcaagcctgacgtgtcatcgcaccatcctctggttcagccaatgcagtcgctgtgtttcaacgagggctcacaacacgataaatgttaggggacggtggttgccactgtcgccgacgccgcgatgttcgactcgaaagcgcggcttgaggtgtacaatggctgtaagcggtgactgtcgcattcgacgagaagctcccgatttagagattgtggccatcggcagctagtcggatgggaagagctccctccttaaggccctcctcgacttccacttcaatgtccgggaggtcaagatggggacctaccgtccctttgtcctctagatggtccacagcttcaccgtcctcgatccatggtgcctcttccctgtgcgtgttccgcttcttcccctaggcggcaccctttggacgtcaaggtctccttctcttttgaggatgacaaatgggcctgaacatctgtcatgtaagagaaaacaagggaaattgggatctatactactacgagacccaagttcggttttgtataatttaggtgtatagatttttggtattgagattaaggcatgccaagcaaattaaactcgaaataaagatgagggatggtaagtgaacttttctgagcaaaaaacaggtcaacaatgagaagcaaaaggaaataaaaatctattttgactctcttaactagtagatgaatctaattcgtaatcctccaccataaaatcagatatgaatgccctctcaactatcaatatctgatcaatgtacgtcctttgatggttcttagagtggtttcgtactatgtgacgtgtttgtgacgtgttgactagtcaatccatgttgagtcatgagatataagtatataacaacatgacattgacgtggtggtacagccagaaaaaaaagaaaataaagaaaaatcagaagctcattatcccctccttcctccggtctcagaatgacagacatgaaggacaatactccatagctccatggctacggtgaggagcagcagcttgcagcagaggaagcagcgggcttggtagagtcctcggcggcatgcagtgactccgagctacggtggtggcttggcgggtcttgtcaagccgaaggtggagtagggaagccgaaggtggagtagggtggcactaggggcctgtttagcacagctccacctccacctccacctccacctccatctcttttggagctggagcttgagctcagctaaacagtttcagctt

SEQ ID NO: 6989 - DNA, 9301 bp, Oryza sativa
  unsure (1)..(9301): unsure at all n locations
actctactccaaacccaactcttaggagttagagctgtatcaaacagacctctataattgaagttgctgggtcaacaagctcggtccaagctttcatctgccacccgaccgcccaccacagttaccgccacagtctcacccaccagtgtgaggacatctcgctacaacgacgcccccgctggccagcctccactcacctctgcccgctgccggtcaataaaagaaccattggtacacttcactctattagaatgtactccctccgtttctaaatatttaacgtcattgacttttttaaacatgtttgtttattcgtcttatttaaaaaaattaagtaaatattaactatttttttatcattngaatgatagttaaaaatacggtcaatgatacatatagcgggacatacttcacaatttttttaataagacgaatagttaaatatttgctaaaaagtcaatggtgtcaaaaatttaaaatttaaaaacggagggagtaccataagcaatcaacaactaatatgagactcatctaataaacagtgacaaaaaatacattatactatatatcaggagaagtatatgcgtatatctaaacggtgataatttagtgttcaattatccaccgaatgatcacttaatcacatgatgactagtgatactgaacacagttcctctccttggcattcactgatctggctatctagaccattaattagttttgacgaaccaatgtagttagtcacatgcatgcaaagagattaattatttcagagacagatcgatgttcttttgagggtgagacagatcggtgttgaaccatccatttgtcaccttctagcttttgcagcagtagttaagtacaggagataactatatactatttgagtcttgagagactgattattgactaattgttacatgtgtgacagctcaggcatttctcccgttctgctagacacatgcctgagctgaagaaaaaagaaagaaataattggaccttctcctgatagttagtagtaccatgcatgcatttaagcgctagctaatccgagtacaactcactgcatatatttataagtataacaaccaatattagtcattgccacacataggatgtttaatactctctccgtactttaacgtatgacgtcgttgactttttttatcaacgtttgaccattcgttttatttaaaatttttgtaaaaatataaaaatatttatgtcatgcttaaagaacatttgatgatgaatcaagtcacaataaaataaatgataattacataaattttttgaataagacgaatagtcaaacgttggacgaaaagtctacggcgtcatacattaaaatatgaaggtagtagttagattaagctaagtctttttaaaacaaagaatattttaatgagtagtaaaccaaataattggctgaatcgatcgctaagatatgaccaagttgtaggatcgcacagcaagaatcgagcccaaacagacatgggataacggttgtagtaacaaaaaaaccaaaacttttagcaaaattaaaagttatccttgtagctgatggagatcggtctgaccggagtatatacaccaatctgaccaatcgaagacctccggcctaactggtgttgaagctctagtctgatcgcctaccgcgccgccaacacctgtcatcgccgccggtccaatcgccatggtgtcactggtcttatcgccggtatgatcgtcaaacctgagcaaacacaaattgaagatctctcaaaagtaaattgaactttattacgtctattcgtgtttctaaagtgcaacaacatcactcctcccacaaaatttaattaaactcgaaacattaacttttctctaaactcaactatgtcaaaatcaatatcgggaggcctcaaccccctctctatttataaccaacttgtacaagaaattctaatccactatgaaaccttcacatgcaggacacaaactttacaaactccaattatattaaatttggactccttccaaattcgactccttatcccatacacacacaatctccctatcatatgccacaaataatttttatcaaccacgtacattgttctttagcctaagcatcctgcataatatcataatcgtccggacgtcattttcttccaagttgattcccgatccatcaccagcaacactctcctgaagcattaagactcagctgcacatgaatcaacaagaaactatattcgagcacaagttctctccaacttgactcaacattagtacacaatagtattatatacatataataaacatttagaagtcataaatataaattaatcatgaatatcaaataaataatccgaaactgaaaccgacacaaatttagccgatcagaccgtccgctcgcataactccggtctgaccggctccactcagccgaaaacttgttcatcaacaatcactattcacaatatttgtctaaccgatacacaaaacccgggttgatcgaaccacttttctaaataataaaatcaattatctcaaatactaattgttcgtcatgaaataataatgaaaagacactttgttcacacaagttggctgttaaacaaacagcatcatttgctcatcagtcatccccgtgaactagtaggtacaccggacggaagatgagtcagccattctattatcagatctgtcctcggaagtcggaatctttacttacaaaatattgaccgaccaggaccagcatctttggagacgacaccaacgcgagatcgccacgtcgtgccgatcagctcgatcgtgtgttttcctccgtccggctcgcatggccggcgtcgtcttcctcgtcctcttcgtggcggccgccgccatgccagcatcggtcaccgcagcgacatcacagaccgatgcgctgctggcgtggaaggccagcctgctgctgggcgacgcggccgcgctgtccggctggacgcgggccgcgccggtctgcacctggcgcggcgtggcctgcgacgccgccggccgcgtcacttcgctccggctccgggacgccggtctcagcggcggcctcgacacgctcgacttcgcggcgctcccggcgctgaccgagcttgacctcaacaggaacaacttcaccggtcccatcccggccagcatctcgcggctgcgctccctttctttgctcgatctcggcagcaactggttggatggctctataccgccgcagctcggcgacctctccggcctcgtcgagcttcgcctctacaacaacaacctcgtcggcgccatcccccaccagttaagccgtctccccaacattgtccatttcgatctgggagcaaactacctgaccgaccatgacttccgcaagttctcgccgatgcccaccgtcacgttcatgtcgctctacctcaactccttcaatggaagcttcccggagttcgtcctcaggagcggcagcatcacctacctcgacctgtcgcagaatgctctgttcgggccaataccggacatgctcccgaatctgaggttcctcaacctgtccttcaatgcgttctccggcccgattccggcgtcgcttgggaggttgacgaagctccaggacctgcgaatggccggcaacaatctcaccggcggcgtcccggagttcctcgggtcgatggcacagttgaggattcttgagctcggggacaaccagctcggcggtccaatcccgtcggttcttggccagctccagatgcttcagaggctcgacatcaagaacgctagccttgtttcaactttgccgcctcaactaggcaatcttaataatctcgcttatctggacctgtccttgaaccagttctccggtgggttgccgccgacgtttgcagggatgcgggcaatgcaggagttcggcctttccacgaccaatgtcactggtgagatcccaccggcgttgttcacgagctggcccgagctcatatccttcgaagtgcagaacaactcgttcaccggcaagattccatcggagctcggcaaggcgaggaaactggaaatcctttacctattcctgaacaaccttaacggttccatcccggcagagcttggcgagttggagaacctggtagagctggatttgtcggtgaactcgctcaccggaccgatccccagctcgctcggcaacctcaagcagctcataaagttggcgctattcttcaacaatctcaccggcgtaatcccgccggagattggcaacatgacggcgttgcaaagcttcgacgtcaacaccaacattctgcacggggagctgccagccaccatcacggccctcaagaacctccaatacctcgccgtgttcgacaacttcatgagcggcaccatcccgccggacctcggcaagggcatagccttgcagcacgtgagcttcagcaacaacagtttctctggcgagctgccacggaacctctgcgacggcttcgcgctggagcacttcacggtgaactacaacaacttcaccggcacgctgccaccgtgcctgaagaactgcacggggctgttcagggttcggctagaggagaaccacttcaccggcgacatctcggaggccttcggcgtgcaccccagcctggagtacctggacatctccggcaacaagcttactggtgagctgtcctccgactggggacagtgtaccaacctcacgctcctgagcatggacggcaatcgcatatccggccgcattcctgaagcatttgggagcatgacaagattgcagattctcagcttggctggaaacaatctgacaggaggtattccacttgatttgggtcatctcaaccttttgttcaatctcaacctgagccataattccttttccgggcctatcccgacaagtttgggcaacaattctaagctacagaaaatagatatgtcaggaaacatgcttaatggcacgataccagttgctcttggcaagcttggtgctctgacatttcttgatttgagcaagaacaggttgtcagggaagataccaagggaacttggtaatctggttcagctgcagaccctacttgatttgagcagcaattttttatcgggttggatcccccaggcagccttctgcaaactgctctctcttcagattctgatcctgtcgaacaaccagctgactggaaaactgcccgactgcctatggtacttgcaaaatctgcagttcttggacctttccaacaatgcattctcaggtgaaatccctgcagcaaaggcaagctacagttgttcccttatatcgattcatctttccagcaatgacttcactggagtttttccatcagcgttagagggatgcaagaagttgatcaatttagatattgggaataacaatttttttggtgatattcctatttggattgggaaaggccttccatcattgaagattcttagccttaaatcaaacaacttcagtggtgaaattccatcagagttgtcacagctttctcaacttcaactgctagacatgaccaacaatggtttgacagggttgattcccagatcttttggtaaacttacttccatgaagaatccaaagcttatatctagtcgggaattattacaatggtcttttaatcatgatagaatcaatacaatctggaaggggaaggagcaaatatttgaaataaagacttatgcaatagatattcaattagtgacgggtatcagtttgtcaggtaactcattatcacaatgcatccctgatgaattaatgaacctccaaggccttcaatttctgaacttgtcaagaaactatctgtcacgcagcatacctgagaacattggtagtttgaaaaatcttgagtctcttgacctatcatcaaacgaactttcaggagccattcctccaagccttgccggtatatctacccttagcagtctgaatctctcgaataatcatctatcaggcaagatatccaccgggaatcaacttcaaaccctcactgacccatcaatctacagcaacaattctgggctatgtggccttccgttgaacatctcatgcacaaattatgcacttgcatcagacgagagatattgtagaacatgcgaggaccagtatctatcgtactttgtgatggctggagtggtttttgggtcttggctatggtttggaatgttattttcaattgggaacttaaggtatgccgttttctgctttgttgatgacattcagcgtaaggttatgcagaaggtgtcctgtattaatcaacttctttcaagagggaatactgcccaatatctgtagctgtgtttccttaaccttctgatgatgaagtatgtgcttcctttgtattaagagtaagaaaaatgtaattggaagggacctgaagaaacagagaacagctggtttaatgacaggtattgatttacaaagcatttcactttacattgaaaccccaaaatagctgacataccttcagggcctctggtttttaaacttgtcagggaataatctatcacgcatgtgttccagaaagaattggcaattactatatcttgggagtcccttgacttaattatgcattgagctttcaggtggcttctctttgagaacagcctgccatggacctacattggatgagaaatgaagaccatcaggaacttgataagttcttattttactctctgagttttggcattgttttcggattttggctttggtttggagctctacttctacttgagccattgacagtcttcagaataatttcagtacatgcatcaccagttaaagtaatagagtactatcctaagctttgcccctggagttaatctatctaacaatgcatttatgcatcttaactgtgaaattccaaccgttcccttcccggcggcgggggaacgggtgggcgggagtcgctccggcgagctacggtgatcttgccagtaaaaagagagggtaaaggagatttatcgcgggtagaagacgatggtcacctcaatttcggaccaaggaactcgggtgcgggcgaattctcgggatttggtggagccggtgaaagctagggtattcgccgcgtttgcgcccgggcgacggcggtggaggaggcgaagtgttgtgcggctcttgggcggaggcggccgtctcttttgctgttggcggcggcttgatcagttattcggtgagagagattgaggtggatgcggcagagctcctcgctcctcggcttggcttgctgccgctgcgaagctttggaggggggtctcatgcagcacaagctgctgctcacggtccagactgagctggcagggccacaagcgaggaagaaaagaggaagataaaggctgtgttttgattcaaaattttctcatcaaacttctaacttttccatcatattaaatatttgtacatatgtattaaacattaaatgtggatgaaaaaagaaccaattgcacagtttacatgtaaattgcgagacgaattttttaagcataattacaccatgatttgacaatgtgatgctacagtaaatatttgctaatgatggattaattaggcttaatagattcatctcgcagtttataggtggaatctataatttgttttattattagtctacgtttaatacttcaaatgtgcatccgtatataaaaaaaaaatttggcacacgaataaaagtcaattttggccttcctcgttctctctctcggtctttgatcgaatcgtctccctcaaccgcaaaatcgggtctaactgtttacgctcaaatttaacacgtaggttcaaattaaggaaatttgccaagatttaggaaagtcgccggtttcctctacagggccggtcaaattgcggcttgaaagccggtctaaccggcggtatgtggccggtcagaccggcagagtctaagcccgagtctattttcatcaggtctcgagtttccttactcaaaaatatatgtttcgagtttccattggtttctatcccaagttgacgtggaggaggatttgtagtaggcaagaccaacccctatttaaggggcaaggtcgattcgattaagaaaatctctctcccccaacaatctctacaattgaatcgttttcttttaccttttacttttcagctatgttttctactttaccctagtttagtctatctttatcggtttgcgccataaatcgtccgccgtcgctgcaagagtgcgattacccctttgtaggtttgtcccgcaaaccttttgttcgcccacgagacgggtagttatcatcgtatcgatcaaaatcggctccgctagccggtttagcttttctttctacaaaacccattttgaactagtttttgcttgattgaggtggttagcgactccatatcaccgcaatacttttaggtgtcccaatcatgtttttcttcttgccaaaaaaagtttccaacaataatgtctctctatcttcaaaatccggtgtaaatcaactccttcggtggtttaaaaagtagtttatgttgatgtggcaatttaggctggtcagcggatggaacatgagaggacgccgtctgcgccggtgaggaaggtctgagaatagattaagtaaggtggctcccgccgctggaagggtgagagggaagagggaaggagagaaagaagggagaggtgaagaagaggatgagatgagcaggaagtcatttacatatggttctcgcttgctgatttagttagttaaccatggttaaactgtcatttcagcataaaccacttctaaaacctcaaaaggaggttatttcgaagttaggaaagattttatacccggttttacgatgatggagccaaaatagacttatattctgcaaaagaattaaggggcgaacccgtcttgggagcattgtcctcatacctctggtctagtgtgacatggggtgtggtggtgtgatgtgattagttttggcgtgtcacatcaggtattatatatggtgtcgtatagggtgttcgagcactaataaaaaaactaattacagaatccgtctgtaaaccacgagacaaatttattaatcctaattaatccatcattagcaaatatttactgtagcacaacattggcaaatcatggagcaattaggcttaaaagattcatctcgtaaattagtcacaatatatgtaattagttattttttagcctatatttaatacttcatgcatgttttcaaatgtttgatgtgacaggatgaaaaattttagggtgggatctaaacagggtcgtagccatttttgaaagaaaaaaaacaaatactccctccgtttcgaaatgtttgacgccgttgactttttagcacatgttt

SEQ ID NO: 6990 - DNA, 15889 bp, Oryza sativa
ataaaataattaaaggaattaagttttgatttgattaataaaattaaatagatataagggagaagtgtaaacttataaaataaatatggtagaaccaaagcatctagaataaagttcatgaaagatattcctaattacttaattaaatcaactttgaaattaccattttaccctcctatttttttcctttttcctttccccgtttcttttaggcaaaatttgatacaggacaatcaaaaatcgtgtaattggctgagagacaccaaaaaatgtgacactgccgatggacactacaaaagttgtgtaattagttataggacaccgaagggattattttataattttcgggctaaaagaggggagagaaatttcgaattgacgggaatgtcccctctactccttcctcatggccgccatcaagcgctcccaggccaccttccacttctaccactaggccaccaccgcccagactcccgccgccgtcaaggtcgtcagccgcgtctttgccgaggccggattccgtagcggggacatcaagctcaccatcctccgcccggctccatccatgccgctcctcggccgcctccccacgcgcacccgcccacagcctcgccgacgagtatgcctccttggcacccttcaccgccacctacggcaccacatcaccgccgccggcgtcgtccttcttcactgtctgaaagccctgcacggcgccgccgacgttcagcatgttggcgaggccgatgggcacgaagctgatccgccgctccaacaagagctcgtaggtgaacggctcgagggtgagctcgaaggactcgttgcggcggagcagctgaagcttctgtgcctccacgaagtagacggtgaagcagtcgacaccgtcgccgttgccgccaccgcttccgtgcctccacgaagtaggcggtgaagcagtcgacgccgtcgcctttgccgccgccgccatgcctccactcggacttgtgcctgtatagctcgttaattcatcttctcctctctccttcacatttgtttctaggtagcttacttgctctaagcgatgataaattagtaatattcaattatccaccaaatgagcaattaattaccacatgactactgatatacaaacacagtccatctccttggtattcactattacataaaagcacttatgtgccgcttgggaaccgatcataggtaccggatatcccaaccggcactcagcaagtggcacagatgactttagtttggccatttgttgcattaattttgacaaacccatctagtagtcacatgcatgcaaagagattaattattacctccatatcaaagtacatgtcactcttaagtatgatttatcccatcacatttcatttaaatttctctctattctacccccccccccctaccactacactctaaccattacttccttcggccactcactaaggcgcacacatattttaaattgtaactctttaatatttgatctgcaagactttattataaattaaatttatttgatgaaaattatattattggattgtcatctatatttacttttatatgatatgattttgctgttacaaacattataatatatgagaaatttaaagtcaacgattttttttttttagtgcatcaggtctgaccgggtcttagtgagtgggagagaacgagtatcatttaaggatagtataaccgtctcttaaactttaatctatgctaaactgctaagttattcagaatgacggatgaattatctgagagacagatcgatgttgaaccatcctgtcaccttctgctagcttttgcaacagtagttaattactactccctccatcctataatataataagttttaaagttagacacggttactaggtagaagtgaatggtggagggttgtaattggattagtagtaaaggtaggtgggaaaaatgaacgatggagagttgtgattggttgagaagagaatattggtagagaagttgttatattttaggataaattctgagagctaaaagttgttatattttggaacggatggactacttcattatagcccatagttagactgatgattgactaattgttagagcaaggtttatagtatagccagctaaaagctataaaaataaccacatcagcaaattatagttagtgctaatagctagtgcatacaatagagatctactatcttctattgctacacagttcccatcaaccatgaacaaatgcattcggtagaatgaggtgaccccacccagcttcttgcgttgccatagcgtgcagccaacagcacttaaatgctttgccttggatagagtgagcagctagcgactaattagtcgcctgtttaatctctctcaccacctttttcacctccagctaagcatcaacgctgacatggtcatcctatcgccagcatctaccgtcttactgtacctgctctaagtacatgtgtgacagctcaggcatgtctcccgttctgctggacacgcatgattcagctgaagaaaaaaattgatataattggagcttttcctgctatcataccacgcttgcagttatgagctcgctaatccgagtacaactcgcagcatattctacacacgcaatatatctatctattatattattaaagaaatagaaaaagaagcttccacgttcactctcatggcttagaaattctcacattaatcggagaaaaaaaaaagcagagtccatatagaaatacaatttagaaaatagctgaaattcgaaattaaaaaaataaggaatattagaacataatagagtctatacaggaatttaaaactaactaaaatttggaataaacataataaaattaaaagtagagtttagagtccgtataaaaatacaatttacaaataactaaaattcaaaattaataaaaacatgggaagaagagtttaaagtcaatataggaatacaatttaaaagtaactcaaattcgaaattaaaaattaaagaatattgaaagatgagtttagagtccacatagaaatacaattagaaataataaaaattcataaataaaaataaataatattggaagaagagcgtagagtctatatagaaatataatttataaaaaattcggaattaaaaaatattaaaatacgagtctagagtccatatagaaatatatataatttacaaataactaaaatttgatattaaaaataattaataactaacacgtatataaaatacaatatgaatattactacacattagtagttttgtaaagttattgcaaaatttaaaattatgttgtcattttaatatatttgaataatataatgagaaaacatatatgctattatatgagagaaaatataatgatgctaaccgcgcaatctgtgtaggccaccatgctagtttataagtataacaacaacaataatagtccttgcacccacatgatggtgactagttagattaagcaaagtcttcttaaaacaaagaatgagtagtgataaaccaaataaatcgatcaataagacataaatgaccaagttggctgttaattaaacaaacatcatcacgtacgtactccccgtgaactcgtagtaggtataccggacggaacatgagtcagccattctattagatctgtcctcggaagatggaatccatgcaaaaaaaaaaaattcaccgacctgcacagccggagacgatcagctcgatatatcgatcgtgtcttcctccgtgtgtctgctcgctacgtacgcctctgccatgaaagaaccgactgcccgcatggccggcgtcgtccaccgtttcctcctcctcctcctcttcgtggcggccgccgtcatgccagcatcaaccaatgccgcagcgtcgtcgcagaccgacgcgctgctggcatggaaggccagcctgaccgacgtggccgcgctgtccgcctggacgcgcgccgcgccggtctgcggctggcgtggcgtggcctgcgacgccgccggcctcgtcgcgaggctgcggctcccgagcttgggcctccgcggcggcctcgatgagctcgacttcgcggcgctcccggcgctcaccgaactcgacctcaacgggaataacttcaccggcgccatcccggccagcatctcgcggttggtatccctcgcgtcgcttgacctcggcaacaacgggttcgtcggctccatcccgtcgcagatcggcgacctctccggcctcgtcgagctccgcctctacaacaacaacttcgtcggcaacatcccgcaccagctcagctggctccccaagattacccacttcgacctagggaataattggctgaccaacccggattatcgcaagttctcgacgatgcccaccgtcaagttcctgtcgctctttgccaactccctcaacggcagcttcccggagttcttcctcaggagcagcagcatcacctacctcgacctgtcgctgaacaatttctctgggtcaataccagacttgctgccagagaagctcccgaatctgacgcacctcaacttgtccatcaatgcgttctccggccgaattccggactcgctcaggaggttgacgaagctctagcatctgcgaattgagtacaacaatcccaccggtggcatccccaagttcctcgggtcgatggggcagttgagagttcttgtacttggcaacaacccgctcggcggtccgatcccgccggttcttggccagctccagatgctggaggagctccaagtaatggccgccgagcttgtttcaactctgccattgcagttggccgatcttatgaatctctctgtcctgaaccttgcctataacaagctctccggtaacttgccgctggcattcgcccggctgcaggcaatgagggtgttcagaatctcatccaacaatctcacgggtgatatcccgagctcgaattcttcggtgtggacagcaacatgttcactggaaatatcccaccagagcttggtaaggcaaggaaactgaatatgctgtccatgtacgacaatagattatccggcagcattcctccggcattggggagcttgacaagcttgaagtatcttgatctgtcagcgaataatctgacaggaggcattccatatgagttgggtcatctcagcaatttgcaattcctcaatcttagccataactccatttcggggccaattatgggaaatttgggaaacaatttcaagctgcagggagttggttcatcagggaattcctccaattgcagctctggctcagcattctgcaggctgctctccctcgagaatctagacctttcaaacaacaagctcactggtaagctgcccgactgctggtggaacctgcagaatctgcagttcatggacctctcccacaacgacttctcaggtgaaatctctgcactcgggacaagctacaattgttctcttcattcggtatatcttgctggcaacggtttcactggagtttttccatcaactttagagggatgtaagacactggtctccttagattttgggaataacaagttcttcggtaatattcctccttggattgggaaaggatttccttcgatgaggattcttatccttaaatcaaacaacttcactggtgaaattccttcggagttgtcgcagctttctcaacttcaactactagacatgagcaacaatggtctgacaggatcgattcccagatcttttagtaacctcacttccatgaagaataaaaaacttaatatctcctcaggaattattacaatggcttagttccgatgaaagaattgatacaatctggaaggggcaggagcaaatttttgaaataaaaatttctggattaaatttttttcaactacttacgggtatcgatttgtcaagtaactcattatcacaatgcatccctgatgagttaacgaacctccaaggccttcaatttttgaacttgtcaagaaaccatctgtcatgcagcatacctggaaacattggtagtttgaaaaatctcgagtcccttgacctctcgtcaaatgaactttcaggagctattcctccaagccttgccggtatatctacccttagcattttgaatctctcgaataataatctatcgggcaagataccctttgggaatcaacttcaaacccttactgacccatcgatatacaacaaaaatcctaggctatgtggttttccgttgaacatttcgtgcacaaattcttcacttgcatctgaagagagatattgtagaacatgcgaggaccaatatctatcctactttgtgatgtctggagtggtttccgggctttgtctgtggtttggaatgttcttttccatcgagaccttaaggtatgtcattatctgctttgttgatgccatacagtgtaaggttacgcagaaggtgtcctatattaatcaatttctttctagaggaaatacggcttagcatctgtgcagctgtgtttccgtaatgttaccttatgatgaagaagtatatttagctttctgttgttctgtaattggcatgtttcctttgtatattaagactaagaggaatttaaaatgctactttatcttatccaaaatcttatggctttattctggaaatactctatccggcagtattccagaaaagataggcagtttgaaacccttgtggtgttattcctccgagcatttcaaattcgttatgctttggtatgttaagtatctgaaatagggtgaggtaaccactgtaagtcaacttcagtcaattgtggatccatcagtctatagcaacaatctgcttctttgtggcttccctccatgcacctacactggataaaaaaatgaagaccataaagaaatctatgcgccattactttattctgtaatattattggcctttttttttgtgtgttttggctttagtttggagctctggttttacttaagccactgagttttcatttttcactttaccagatagaaagaagttgtgcataagcagtagacattaatgcactcttcagttgcaaatcagcaaccaaagaatcatacagttttcagtttatattggccatttttgaaatagttaattcccattcaaaaattaagtatattagatgcatttttatggcatgcatgtgttcacctgaatgaacagctgtgttctagctactctagtgtactatactcattcctactactattcttgttgtggttgtccgatgtctgcagccagcaacctcaccaattcgaattgaacttttcatgcatcatgttttctggaatacgcaaaaaattgtgcatttttgtattaaaactttgaaaaaagtgaagtattacaatattataattctgaaatgctatactcagggaaaaaaaaagaaatacactacgtcatgtcccacaccaccaccacaccctaagaaaacacagccacgaccaagaacctccaaaaggatgcctctaaaaaggttaagacattaaaaacaccaccatcgcccatcccaaaagatatggttttcgcctaaaagatcttattaaagaggggaagagaggcacctcgacaacaccttcaagagggttccggcgcctaaaggcgttgccgctgtcagcttaagattgggctggctttcgcctggcggaaccaaggtatccgatctggaaggtgcggctggatcacctccttttcagggagagctaatgcttatgcttattgggtattttggtttgacactgcttcacgcccaaaaagaaggcagctacgtctgagctaaacttggatatggaagtcttctttcgtttagggtgaagtaagaccaacctcatgagcttattatcctatgtcggaacaaattagttaaacttgcacctttcttgttgctacctcaccaatcaccaatcttgctgacacgtgactgcaatagcaccaacgccgcttcgccggctgtcctccatacggttgtcatgctgccgacacgaccacaaccataaccatgaccaatcttgcgaccaaccactgttgcactatggcgaccaattattagccttcttcccatgccatcacctccatcagctcaccaagaaagggaggaggtgtgaccgccaccaaccgctacatgttggcagcctcgaccttcctttcctgtcgccatcttcaccgtcttgccatatgggactccccatgaccaggtaaacctatcaagaaggtgaggagctccatggagatgtgaaggcaccatagatagagagcgacccaccatcatcgctgcccgtgatggcggtgctatgtggccaaatccgggctcggggccccagatccagcttctgctccacccaacaccagctacgccgccacacgggttggcaaacagcaaacctccgtcgttgccatgcacgctggtgctccggtcgagtcgtcctcaaggcgtgttaaccctccgcctggcaacccctgtgcatctccatgcgcccaaggagaggccccatcgtcgccaccactggccagccgagcggccgttcgcgaggagaggcaagggccgccaccgtcacctgcgtaggcttccaccatcgtcgcccgtgccgacctcctcgacaccagctgtcgcggcatcccactgtcgctagccatcatggccttccacgcaggaacccgcgtgggactcccgccgttgatgctccatcgtgccagcaactccaaccagatctggttcagaggcggcggatccacctgacggaagactagatccggctacggcagcattgaatctgtggcctacacgctgcgtcatcttcccagcgatccatgcgccaagccaccttcgtcacgctgaaggcgaggcgccgccagggttcggccccgctgccgccatcccgacttgccgcacggttctctgacagcggcgaggagagggagaggggagagcggcggcggcgggtggtaggattcgccacccaggcgtggacgacacggagggtgctgcttggatttgagttttttttttttcatacatcatgttgaacgaaagagcagaagcattgccactcatttacagcatcacatacatttccgtcatccactgaatattcttctaattcacattcatagaaggaaaagggactgctgcagtgaacagttctttctaagatatgttgattttctctcagagaattatatggcaaagtcataaatttctccatttctcttctctgtcttacatttacaagtttattgtttagcctatgggggaaaataataatattaccacagggatagtaacaacgagcaatacaattgtacaaagttgatgaaagacaggttttgtgattcagtgtacagaataatttctatatatttatcagcagttaatgtaatatactatcctaagcttacccttggcattaatataatctgaggatgcatcttacaaatcactaactgcgaagttcccttcctcccctcctggtgctttacatctctgcacagatatatattcacttctggtagtctgttagcttgctaattgtgatcagtttgaatggttcagagaggtaggcttgagtatgcgcagaaatctcctgcgctacagatctcatggaaggcctggattcagggttcacccttgtgcaaccaagcgcgattctcacgatgaacacgacctcttctgcgagctgccctgttggagcatccagccgctggtctagtatgtccttgagcagtagatcatcttcttctgatgatgagatggctggcagggatgttaagaggtcacctgggtgctttcccatcatgacctctagcgcaaccacgccaaagctatacacatcgcacttctccgtcaccctcatcgtgtatgcgaattctgcaagaaataatcgaagtcggtaagtgttaatggtgcggtgccgtacttgtcggaatttgagcagttccttttcccaatgacaatctttcaaagttctgcaaatcttcaggacaggagtatgtggcaatctattcaataatgaccactctacttacagtaatgacttcagtactttcatgaatcacaataatgtgcaaaacaatcttaaatagatcggatctgagtttctttctctcattttttccttttttaaacaacagacaattcgacaactatatttcataactactgctcttcatttggtagttacttgcacaaaatgttcttttatggtcagaaatgtttgacagtttatcatacactacattactacctgggagtatcgaactaaatttagccatctggtttttcgttaattatgactgaaacatcccaaatgctatttggtgctaccataaggatctcactgaagcactttgaagtataactaggatttgatattataagctacatttcaaaaattgtatgcataagaaacatgtgacattttaaggaaaaaaatgttcaaatttaagaaaagtacctggagccatgtatccatatgatcctgccacagaagtccagttcgtcgatgcacccccaagcaacttcgccgtgccaaaatcacacaagcgcggctcaaagtctgactcaagcaggatattattaacagtaatatcacgatgaacgatggctggattgcagtcatgatgcaagtaagccagggcatgagccagcccctgcaccaccttcaccctcatgccccaatccatcttcttcttcccttcctccccatacaatgtcttccccaagctgcccctttccaagtactcatacaccaggtacatgtagtcaccactggtgcagaagccatggagcttgacaatgttgcggtggcggacctccgtcagcgccttgatctcgttctcgaagctcttcttgttcacatccggtatgtcacccgtgtcggcgacatggaagcgtttgacggccacaacctgcccactggagagctcagcccggtagacacttccgaaccctcctttgccgatgcagaaggtttcattgaagttgtccgtggcgttcacgatgtcgaagaatgtgaacttgccttccttttcccagattgtggactcatatgaataattggtgttagattccacctctttcttctctctaggcctcctcctgcataacagtatgatgcaagtaacaacggctagtagtaacaccactccaactactgacacaactgttgcaatgactactctcttgtgatgcccagaagatgatccggtagaactgatgtcacaaggagttagaccttgcacatcaccacagagccccgaattcccaacatatgcagaagctgaagcattctggaaaacattccctgacggtatactcccggtgagtcgattataagagaaatcaactgattcgaggcttgacatgcgagaaaaccctgccgggatcgaaccactgagctcattgtgtgataagttcagtctctgcagagttatcagcttctcaagatttggagggatcgcgcctgatagagaattgctgctcaaatcaagcaggatctgcagctgagccagattaccaagctcacttggtatctcccctgacaacctgttcttgctcaaatcaagcaatatcagagcatcaagcttgctaatggcaactggtatcgtcccatcaagcatgttccctgagaaatcgactttctgaagcttggaattgttgctcaagctcgccggaatcggcccggaaaaggagttatggctcaggttgagattgaagaccctgatatttcccaacacaggtggaatccctcctgtcagattatttccagccaaattgagatccttcaagcttgtcatgctcccaaatgccgccggaatgccgccggatatgcgattgccgtcgagatgcaggagtgtgaggttgatgcactgtccccaggcagacgacagctcgccggtgagcttgttcccggagacgtccaggtacaccagcttggggtgcacgccgaaggcctccgagatgtcgccggtgaagtggttctcctccagccggacacggaccagcgccgtgcagttcttcaggcacggcggcagcgcgccggtgaagttgttgtagttcgccgtgaggtggtccagcgcgaagccgtcgcagatgtggcgcggcagctcgccggagaagctgttgttggtgaagctcacgtgctgcaaggccaggcccttgccgaggtccgccgggatggtgccgctcatgtggttgtcgaacacggcgaggtactggaggctcctcagggccgtgatggtggctggcagctcgccgtgcagactgttggtgttgacgtcgaggctttgcaacgccgtcatgttgccaatctccggcgggattacgccggtgagattgttgaagaatagcgccaactttgtgagctgcttgaggttgccgaacgagctggggatcggtccggtgagcgagttcaccgacaaatccagctctgtcaggttctccagctcgccgagctctgccggaatggagcccgtaaacttgttggtgaataggtagaggatgttcagtttgctcgccttgccgagctccggcggaatcttgcctgtcaacgagttgttctgcacttggaaggatatgagctccggccagctcgtgaacaacaccggcgggatctcaccggtgaggttgttcgtggaaatgccgaagtaccgcattgcccgcatcccggcgaactccggcggcaagccaccggagagctggttcaaggacagctcgaagaaaatgagattcttcagatttcccagctgcgacggcagagttgaagagagccccgagttcttgatgtcgagccgctgcagcatctggagctggccaagaaccggcgggatcggcccgccgagctggttgtcgccgagttcaagaatcctcaactgcggcatcgacccgaggaactccgggacgccgccggtgagattgttggcggccatccgcaggtcctgcagcttcgtcaacttcccaagcgacgccggaatcgggccggagaacgcattgatggacaggttgaggtacctcagattcgggagcttctccggcagcgtgtccggtatcttcccgaacagagtgttctgcgacaggtcgaggtaggtgatgttgccgcttttgaggatgaactccgggaagctgccattgaaggagttgaggtagagcgacatgaacgtgacggtgggcatcggcgagaacttggcgaagtcctcgtcggtgaggtagtttgctcccaggtcgaagtgggcaaccttggggaggcggctgagctggtgcgggatggcgccgacgaggttgttgttgtagaggcggaggtcgacgaggccggagaggtcgccgagctgcggcgggatggagtcgctgaagccattgttgccgaggtcgagcgaggccagcgagcggagccgcgagatgctcgccgggatggcgccggtgaagttgttcccgttgaggtcgagctcggccagcgccgggagcgccgcgaagtcgagcgcgtcgaggccgccgccaaggccggcgcccctgagccggagcgaagtgacgcgggcgccgccggcggcggcgtcgtaggccacgccgcgccacgcgcacaccggcgcggcgcggctccacccggacagcgcggccgcgccgtcctgcaggccggccttacacgccagcagcgcctccgcttccgtcggcgtcgccgcattggccagcgcagggatggcatcagccgccacccctaggatgatcagcagagggaggacgaggcgtgccatgtgggattgtgggcagtcgacgccttcattggcgaactgttgtgatacgacgagtggctaaaacaccagcaaatgggttcgtcgcacctccaaagccacgtgcgcgtgaattcatacgagcgtcgccgtcgcttcccgccatattggactctggctaggtcaatcgttcaaaatgggaggatttcttccacacctgcgtagctatctctcttacagcaatgtgaaaatcgcaagaatcactctgtaaatgtcatttgagtttgagattttttttatataaactaatttattacaaatatccccttctaatttaccttggttattttgagattcttcctcagttgttgtcgctcgcaccttttttttctctctcctcaaactcaaggtaacatttaggatggttttttaataattttccaatatatctttaccaattcataagtaaaactcgatgcaggaaataaaaacaacatgtatttgttgttaaaaattcaaaatgtctctgcagtttttagtgtttaacacctttaaatattagacatatatttgatcatttatcttattaaaaaaaataaaaaataagtcatgctaaaagtatatttaataataaattaaatcacaacaaaaataaataataaatacatatatttttaaataagataaatgattaaacatacgtgacataaacattaaaaactagagggaatatcttttattggcttctatctagttttagagcacattgtggctatgttaggagatttattctaaaaaataaaaaccaaaatatatttaaccggaacttcctttttaaataaaaaataactagcacggtggcccgcgcagattgcgcggctaacatcattatattttctctcatataatagcatatatgttttctcaatgtatcattcaaatatattaaaataacaacataattttaaattttgtactaactttacgaaactactaatgtttaatatccatattgtattttatatatgtgttagttattaattatgtttaatatcaaacattagttattggtaaattatattcctataaaaactctagactcgtctttgaatatttcttttttaagtaaaatacactagcggttcttaaacttgtcacgaggtttcacttaggtccacgaacttgtaaagcgcacatcgagatccctaaacttggtttaatgtatcatcccggcccaaagcgttgtttgaccgtggtcttgcctacgtggatgatggcatggtggctcttttttcttctccactttactttttcctcctattcttttatcttcttcctccactagagctacctcgagctcccccttgtcgaagaggtcgaagaagagagaaatgaacgaggaagaagggagaaaaaaaataataatgtgccatgtcgtcgtctacatgtcatgccacgtaggcaagactatggtcaaacgacgctttggaccggggtgatacaataaaccaagtttagggacctcaatacacactttgcaaattcgtggacctagatgaaacctgcttacaagtttaaggaccgccagagcaatttactctaattttattatgtgtattccgaattttagttagttttacactcctatatggactctatactctacttctaatattccttattattaattccgaatttctattatttcttaattggatttctatatggaatctatactctacttctaatgttccttatttttaattttcaaagatctactatttcttaattggtatttctatatggactctatactcttcttctaatattctttatttttaaatctgaatttcagttatttataaattgtatttctatatgggctctagtctccttttccaatattccttattttttaattcgaatttaactatttgataaatttggtatttctatatggactctgttttttctttttttccgattaatatgagaatttctagaccgtgagaacgaatatggaggtttctttttctattcttttaataagttaatagattggacaatcaaatttgtctagtcatccatctgggtgagggaacaactataagggttttgttataaaaaaaacaggttttattgaacgcttctagcacagttcaaacgcttaggagccgggtgcatgtaagtaatttttca

SEQ ID NO: 6991 - DNA, 17708 bp, Oryza sativa
gtacgtttgtgttgacgtggaatgattatagccgtgcgatgtacggccagcccagtgtcaatttgtggtggccagatggcgtgggtcggtcgaaagtccaaaacccaaaccggagtgtgtcgtgtggtacgtggggtgggatgccatattcgcccccaaatataataatttttttttgtcatatcctttattttattggtgaaataagccaaacgatatatttgtaaattaaataaattttttatatatgtgtttttagcaatctagaagtaaaggctgaaaaataaactttgattgaaaaaacctcaaaatcaactttaaattttttatgttaaaaatttaaattttggtagataagtataagcataagcgaaaagatgagtcccttagtatcggataacattctagtactggatgtgacatattctagtataatgaatctagacagatgtatgtccagactcgtaatattaggatatgtcacatctagtattagattgttttttatgggatggagagattatgtgattctaaatttttatattttgagatgggcagtaatcataatcatggtcctatgtgtcctaggaatttaggaaccacgggcgtactggatgtgtgtgaacatttgtatgtttgactttggtgatgttaatattatctaaaatttggatccaaacttcagtcctttttcatcacatcaacctgtcatacacacacaacttttcagtcacattatcttcaatttcaaccaaaatccaaactttccctcaactaaacacagccattgtctctgatcctacagccccatttccactatcagaaacatattacgtcaatcattaatatagaggtatccacattaaaaaaaaggaaatcaaaggtgctcaactgtctaattgtcagtgtcagtaaaactagatccacaaattcccaatgtcgtctcatcacaggaagatgctcatctagagttgaaaatgagccgatcttggtacggtgctattggagtgggaacgtgggataaacttgctttctctcaaacattagaaaacacgctccacttggaacttgattgttttgattgtttgatctactactgataaagccgtagaaaaacaaactcaagcaatagaaaatgattattaatgaaaatttaaaatatttgtccttagcgttttaaaaaccactgctaaaaaataaaattaagaaaaaaaactcaatatcagcccttaaactaatttataaaatttgagtcctagttgcggttgataagacaagaataattgacgaactcagaaaaatgactgactggccgatcttacaacgaatcgcagtacagacatatgttcatcgtcgacaagtaagaagcttttagctttgtgcgccaaaaaaaataataaaaaaaagaacaaaggagaagcttaccaatggctttcgctagcggttaattgtcggtgtcagctgactcggacggatacactgtacatcatccacgaggatcacggccaaagccggtagtcattccgttctagattataaattgttttgactttgtcaaaattaaattgctttaagtttgattaagtttgtaaaaaaatagtaacattttcaatataagataaatatattaaaaatattttttcggggaaattataaaaatattgactttaatcattgactatattttcctataaacttagttaaatttaaagtaatttaactttgatcaaagttaaaataacttatactacgaaatgagggagtatgtactcagcacaattggcaacatcattccccgcacgatctcctacccccaatgcaaacgactgatcgaactgaacaacattttctcccctcctgaaactgtggatggcgatggccatattcagcagtaccccagttttattcatcgctatagaaaccgtgtgtgtgcatctcattctccaattagacacatgggcaaagagctcaactttgaccattcacttctcattgtgccggcctgtttctagagtgccggtgagccgtgcacgggactccgaaagaggcagattccatatccatcgatctaggggtgaacagaaatctcgaagctcatcgctcgaatcggtttgtaacgagcttgattcagatcgactcaaactcatagttttaataagtcaagccaagctagaattttaactcgtgaatttaatgagctactcgtttagctggttagtacagaagatcacctatctttatatgcttagcccttcttagctaatgatgtttagttccttaactacatccaaccaacctacttgagtttagtgaattttttattagtcagtgtttattattatttatatggaataaaatgataaatttagaattatagaggtgaaataaatatgttaacgagtttatttcaattttataattctaaattttattagctcgttatccacccctcatcgcggccgttttgtcgttcgtgaccacttgaatcatatacggctttagacagatcagtagtgctctgcgagagcttcctgtcgatcgtgtgtttctttttctaatttttattagtgcagagttaggcgaactttgcaaatgcgtagatagctaccataacacacgccgatgactcgtcggagatgaccgggcatgcagtgttttacttttcgtgttcaaaatgctaatgctaccatgcattgttctgccaaaccgtgtgattagcttaattaccgcatgctcctttgttttacattataaattgttttaatttttcctaaatatttttttaagtttgattaaatctatgaaaaaaatacagtaacatcattagcacaaaacaaacatattatcaaactataataaatgttagtttttaacggaactaattttgtgttatatatgttattaaatttttttataaatatagacaaaataaaaaaatatttgactagaagaaagaaattcaaagcgacgaacggagggagcaggaggttatgacgagtttgacaatcactagctcgagtcgtgccgttttgctcaccagtcacacatcgcacaatcgtcgactcctcgtcatccgagaaaggaggcgtgtgcagctgcgaccgcgggccgtcaacatatatccgttcacagtcgaaagtcggagcacgagaaaaaaaattaaacgcacaagcccggcggccagtcgaccggggctcatcctgggcgactaggggtgaaatgatgacgaaaaattcccaatcgaccgaacgttttcaacctttaccctttttagctatatataaaaattattctttctaatttttcaacatcgtattgatgttgatattgagtagtttaaataataaatatggttaattatcggctgtctggggtgggtttaaccctctctagaaaaactagagtcgagaccagttgctatctattcttttatgtcgtgaaagcattgttttagaagaatgctcccaattctaatcgttactgactgttttcacccatactcgcaatgacgtcgacaagaatttactgtttgccatccttataggttcaaatgtcactctttgaaattttcatttccatttgtcatccagtctaactctctcgtgtgtcactattcctacttttctagttcacttggtgttacatttgtattttttttcctttctatccgatgtgtcgaatgatgccaaaagactgaaatgcccttgggtccatatgtaagaggcttctcccgccctacccaagctgaaccaaaagagaggagggggagacagagccgctattgggaagatggagcccagcgccgatgctgatacatcctccccgaccgcgaacaccacaaaccatgccccctccccaacgtgtagaaccacccagcctcaacgtggtcctagcaggggcggatctatagttataggaccggtgtcaggcgacaacgacgacttttggcaaaacctatagctaaactgtttattcatatgctataacaccatgatctaagtataattagcatattatgacatcgatagacgcgttctgacaccaacaaatcgattttctggatccgccactgggtcctagcacactcctcctatctatcctcacctcctgcgatgccggcgaagaggagaatagggggagacgaggcagagaatcagcccacgacttgcctcaatttttaaattttgaaaactatcaacttaaagtttaaagtttgaaagctttcaactcattatttcaacttttaactcggattagaaaacttttaagtcaaaattttagaaccttcaactcaatatttatttaagttttaaattttgagttaaaagttttttaaaatttgatttgagagtttcaaattttgagatgtaagttttgtagtttaagttcaaattttaaattgaaagttttaaatagaatgttttgaaatttaagataaaagatctaaattataaaatacattaaaaataaaaaaagtacgctaaagattaaaaaatcgtgaaaaaaaggaaaacgtgtcaggaagtgggggaaagcgtaaaaaatggaaaaaaaaatcgtgcgggagcgtcagctgacatatacgcgtcagatagcaatccccgagatggggccatgggatgggaagaaattccaaagtccaaacctgtgtgtacgtgtggggtagtcatcatggtcctctgtgtttcctgggaatttagaaaccacggacgtgttggatgtatgtgagtcaagtggtctctttgaacatacatttgcgtgttcgctgccaggactttctgctcctatatcctcgttccattatcagaaactgattacgtgacagtgtagaatcatggatataaaggtgttcaactgtgggttaaattagaaaccacaatgcttacaaattccctatatcgtctcaccataagtagcagctcgtctagagttaaaaatgacccatttgttacctttttttttttcaggagacactctcaatcataaaatatggcaatctaatattggattgcatataaacatatactacgaatatagataatgccatatcttgggatggagtgagtagaacttgactgactgctatgaatgtttgatctacagtacaataatgaattaagcaatccaaataatttataaatacaagttttatatgtgtgttttttacggtttaaattatcttggaagataaaatataatgtaaaagtaaaatttgctataggacatctaaagtttataattcttggtgttgaacacctaaaaatgtgacatggttgtagaaaaaaaactggtaattcactaagagacactatagtcattattttatcattttcaggaaaatgaggaaagaaacttttagagaagatgagtttgccccctaggccaattgcttgtaatggcctctgtcatgggccctgtctttcaccgcctccaatcttaaggtcttggagaggggattggtagaggaaatgtggcttggatctggttccagatatgttaaatgataaaataataacagcagtctcccctaataaatcatcggttttttatgtcctaaaattgagtttatgttttttagtgtccaagagtaaaaaatcataaattttgaatatcccatagcatacttttaccaatgaaagaaaaaccttagtgttaacttaaaagtaagttttgaaatttaaattttgattgcagcatataataaaaaaaggagaatgatggttcatggatagacctatgatatgctaatctcactcgacgattatctttgacacaagaagtttagtaatatatttggcttgttggtatcagccgcaatcaaaattcaaattaattttagagcacatatgtgacataaccggtaacgccatccgatccacgagaaaggagatcgtgtggtttcatcgtccccgcacaatctcctccctcaggatctccactccaataaaaacgacctccatttggccattctctatctccacaagcaccaccatttttctccccacctgtggaaaccatggacggtgatggccatattcagcaattccctcccagcttcttctttgtgaaaaccgtgtctgtgcatctcctcctccgattacacattgacaaagaaatcaactttgacccttcactcctcttttccactaaagaaggatccaatatatacccatgaggacatgatagtgtcacacactcacacactactcttcgtacgggcgcacatccagcttctagattgcccggtgagccacacgtgactccgaagaaattaaaatggattccatccatcgatcatgtgtccgcttcgttcgtcgtacgtgacggcgtcatcacctgattacgtacgcctttagacacagattagtgctatgagtatcgtgtgcctgttgtatattgcatgagttaggcgaggatgcatattgttggcaatttttttttatatatattgtagagacagattcgggattggactctgctggtcataccagccacacaacgctggtatgaccggtctactggcggtggtctaaccggtcgacacacgacgatcagatcgaccctctcagagaaaaatcggtagaacgtccaaactttggtaatttttctattttaatcttagatgttaaatttgggtataaacacatatgctcctagatctctctctatagctttacaaatggtgtagatagcatgcataacacaatatgaaatgagtataggtatgatccacgttcgattcaaccaatgcataaacacatctattatttttctaagcccacataaacagcggcagaggcagtgactaaaacctgtggggttaaagctgtaaaattatttttagttttctattattgtgacacaaatatcaatagtttttttttggctgtttcgcgaaaacaagtggggtcagctgatcccatagattactgtagctccaccactgcacatggagagaaatagagcacaagaatcagtgaatgagacgtagtcggatgctaaccatataatatggtatgtaaagcaagattctaacacaattaacgatgaccagtagatctgccactgaccgagtgaccggccccggcccgtgcatgtgttttaagcttgatccagttcaggtgcagtgggtagtgtgaaacagtcacacgagcaccatcggatctaaaacgggcgtgatctagatgtatctaaacacagtagcaaaacactgcagcgatttattgtggcacagtaaagtttcgatttaccgtggcaattaggggtgggtgttcggtctgaccaaaaaattcggtctcggtcttcggtctttcggttatttcggtctttgaaaagtgaggaccgaatttcttcccaaaaaactcaagaccgacaaattcagtttcggtttttttggtttcggtctcggtctgaccgaactttcacagagggctagctggagacggaggcggtgtgatggcggcattgaggcagaggtggagggcggaccggcggagggcggaggcgggcgacgaaggcggcgccggcgcgatggaggtcgaggacgaccggcggagggcggaggcagcgcctgcgcggtcgaggtcgacgacgaccggcggaggtggaggcggagggcaaaggcggtgccggcacggtggaggtcaacgacgaccggcaaaggcggcgcgcggagggcggagagcggaggcggcgccggcgcgatgaggcggaaggcggagacggcgccggcgtgatggagatggagggtggaggcggatgcagcgtgaccgcacggcgcgagcgcctagcgcgaggggattggtggcagcccttcctgaggctggtgggagaggagggagtgtcagtggttccctttagggtttagtagtttattgggcttatcgtgcctcctagatctattaggccacaattcggttttctcggttaattcggttaaccgagaccaataaccgaattgcccaaataaatttcggtctttcaacggccaagaccgaattactaaccgaatttctcggtcttggtcgtttcggtctcggtcttttcagtctcggtatcggtcttttcagttcggttcttcggcccggtcttattttgctcacccctagtggcaattgatttggaccattggatcaaaaaattgagaactcagattatgtgcaatctatctattatattattaaaggaatagaaaaaggagcctccacgttcgctctcatggcctagacattctcacattaatcggagaaaaagaaaaagcagagtccatatagaaatacaatttagaaatagctgaaattcggaattaaaaaataaggaatattataataggagactagagtccatatagaaatacaatttagaaataattgaaattcggaattaaaaaataaggaatattcgaagaggagactagagtccatatagaaatacaattagaaaataactgaaattcggaattaaaaataaggaatattagaagtagagtatagagtccatatagaaatacaattagaaaataatagaaacttggaattaaaaataaggaatattagaagtagagtatatattctatatagaaatacaattaagaaaacaatagaaattcggaattaaaaaaataaggaatattagaagtagagtgtagagtccatataggaatttaaaactaactaaaatttggaataagcataataaaattaaaagtaaagtttagagtccgtataaaaatataatttacaaataactaaaatttaaaattaagaaaaacatgggaagaaaagtttaaagtcaatatagggatacaatttagaagtaactaaaattcattaataattaaagaatattgaaagatgagtttagagtctatatagaaatacaattagaaataataaaaattcagaaataaaaataaataatagtggaagaagagcatagagtttatatagaaatacaatttacaaaaaattcagaataaaaaaatatattaaaagacgagtctagagtccatataaaaatatatataatttataaataactaaaatttgatattacggccttatgaccagtcacatggcgcaatcgagccaatcgtcgaaaggaggcagctgcgaccacgcgcggagccgtcggctactcttggttcacagccggaagtcggaacacgagaagagaaagaaacgcagaatgccgacggccaatcgatcaaccggccgggctctggtcaggcgaacataaaagaaaaattatagggattcaatacatagcactccctctatcctaaaatataagtatttttagactctgatatggttttcgtgatgctattttgatcaataatatttataaaagtgagatgttttaaataaaattacgataaattgtttaatgataaatatattaatatcaattttacatgattgatattttttatttttttgctattaataattaaagttaaaaatgtttgatttatcactatgctaaaaatacttatattttagatggatggagtaataattatctaattattagttggtgtattaattaaaatgagacattttagctaggattggataactaacccaaggtcctctgatcctggattattgaacgtgggagtgcaactgtcgggctcaccgtcgcgccctgcagtggtgggaaaatttttcacgcatattgctaatctaatgaaaacattaattttttttttgaaattagatagcagcatttattatcccatgtctgtttccgctcacgccgaacattctttatcaccatgaattatctgcttcacgtcttttaaaatatgtgtgtttatttaatgttttaaactaattattaagcttatttatcaagacatttgacttgtatgtatagtcatataaataattgttagaataggtgtcgaatatactattcctatttggttatttggttacagttggacttagagttgtaataggtgttagggggtggagttagagtcggactctgtaacccggcaactctcttaaatagagagggggacaccacaatataaccatggcgactacaatgtagcatacacacgcagggagaggatggcggcgtggccatggactcgtagcggctaggaactatattggttggggagaagcgcccataattagagccccggggatgtaggcttcggctgaacctcgttaacaaatatcgtgtgttcctgtgtcgtcatctggcatgtcttgagtaatcaatgactgaagcgatcgggagggttagtcgtctttccgctatattgactaacttttataacaagtggtatcagagcagaaggtttcagcattggatcaagaagacatgtggagaaggaaacacgaggtgggatcgcgcatcgataggagatcgtcagtcgtggcgatgagatcgatggcgacaacgaggacgttgcggaggcgacgacctcactcgcgatcagactgacgatggcggagcgtgaccggaagacgaggccgggcgtggccgaaggcgttcggagagatcggaggggtagcgccatggacggcgcgcccgacgcacgtggcgaacgcggatccgcggcggcagggaggccactgacggaagggcgaagctgccgagcatggcgcggcgcggcgtacgtgcagggccgatgacgacggggtcgtggacggtgaatacgagggctgcgactgcggtgcgtgcaggggcatggacgtcgtgtatggaggcatgacttgtgcacatctacacatgcataggtgtggtttccaagagcagaaccaagacggatacggtgcggagacgtcgacttaagcagggagaggtggcagtgggctccatcgtggaggagtagctatggactctagcgaagaagtttctctaatccgagcggtggaagtttcggcttcggtgtctgatgcaggcggcggcgacgactcagaggaggcataggctgcggcttgtagcaggaggaagcggataccgagattgagtcggggtttggtttttggctcgtaggaaggcaggcacactacaaggaatctgttaatgcatgatgaaaaatttccgtcacggatcatcaaaaaaccgtcactatgcagcacctgtgatggtttcagagatggtcacggattgagcgtcatggattaacctctgtgacggtttaccaaaaaccatcacggattaatggaatcgctgacggttttaaaccatcacgatagagcccgaggcctagttagcccagcccaagttcatttcctatgacgaaaaataaccgtcacggattgaatgccacatcatcatggatgcttacatggttgcttacgtggatgatgacgtagacactacctcaacctatttattaacaggccaaaatcaaagatgggccaatttttagcccaattccatccattttcgcagctccttttcagccattttggcagcccattttcaatagctttacaacccatttcagcagctttgcagcccaattttgtcaccattttttggtgcccttttcagcccactactacatcgcttacagcccatatatacagcttaatttcataactaaagcccatatacacagcccatgcaactaatagttgcagcagcaaatcaaatagaaatatcatttttccattcaatatcatatcacatgatttttcatccaacatcagattacaacattcagggctcctttgattcaaaggattggcataggacttttgtaggatttacaatcctatggattttttccatagtatgtctttgattcataggaaatgaaaggaaacgttccttaggattgcattcctttagttcattttcacaggaaaataagaaagaggtctgacctctttggaaactttcctggcgcgaaagaagggcgcgcccacgcgtgcgcacgtcgtcgttggcgccacttttgtgtgtttggcggtaaaccgtggcccttcgcgcttcttccagaaaaaaagagagagagagagaaagatgggaacgagaacaccgaggaccacatattagcagccaagaaagccaactgtgatagagatagacagcagcttgagccggccgctgggggtgcaaggcggaggcgaggctcgccggctcagtcgtgtatgcggcttccgctggggacgccggcccaacaactagcagcacgcagcaaccaagcacagcatccatctggcgcgcaggttgggctccgctaggcggaggcgtgcggcaggtccgccatcgagggcagcagccagggccatcgatttggtatttgtctgcacttttgagctttcatacttgacttattattgacttattagtgcttctgtactttggatctatggattagtgaatttttaagctgactacttggaactagtttgtttcattggcactgtaggtgtaaatccctctctgataaggattgtgtatttcttttttctttcttttttttggggggttaggaaagcaatgccatcgaaaggctcttctcagatgaccatgacaaatcaacgcaatttgtccgatcgacgagcccagcaacctctatcacaggtttatgttgatgttgacagtgagcatgggactgcagagcgtcaagaaataggtaatatttgcaaattcagtttcacttgttgtttgcatcaaaccttttttgtttcatattgctgctgaaactgaaattgttaaatgtttgtcaaatttagggacggcaaagagagccagatggagtcaccagatgaagatgttccttattgagctcctaacagatcatgacgtgccaggttttcgaacacaaaatgcttggagtaaggaagcatggacaaatattgtttgccgcctgaatacaaaattcggtacatcatttacgaccaaccaagtcaagcaaaaggagcaggatttgaagaaagattatcgcagtgttaaagatttgttggatcaaagtggttttgggtgggatagtgacagaatgatggtgagtgcaccacaaagtgtttgggacacttttgctgatcgcaagaacaaagatgcaattcatgggcgagataagtcgttcccatattttgatgattaagctccactttatgatggtgagctttatattttttttatcagtggtttgtttgttttgttgaaatgttttaggcaagttatgctgatcgtgaggagaatataattgtgcaggtcgttatgctgaagggagaactcgccatggtatggaccattatgcaaggaagacaaagaatgcaccagctcattcaacacaagaagcaaatgcggttgatacatatcagtcaccatcccctaattcaaatgctccaggtgaatcaggtttgcaatttccttttggtgaagaggttgagacagccaatttggacttttcacagcattcacctacccctgtccatctcacaaaagtcccacctagctcggcacaaacaccttcagaggttcctgaatctcgacctgggaagaaacaaaagatcaaatctgttagtcctgatgatggatttcatgagagatacctaaaacttaaaaaagaagacatagatcgatttgctgcaattgaggagaagaaattggaggatccttacagcatcaacaagtgtatcacagtgcttgaaggtttacatggtctacaaataggagatatattggtggcagctgatatcttcaaaggtaaggataatagggaagttttcttgtccttttcaagtgatgcattacgcctggcttggattagaaaggaaatcgcagcattagagtgagtacttttgtgaaacatatggcatgcaagtagtaggatagtacttttgtgaaatagatggcatgcaaatagaaggatagtacttttgtgaaacaaagggggtacttttgtgaagcagatagtagtaggatatacttttgcttagagggagtgcatgcaagtagttacttcattaagtagaatgtgacaaacttggagtacaagactagtaattgaccttgaatgccatggtggtcaaatgcaatatattatttccttcgtgctacgtaatggttccacatccgttgtgccatgtcatctcgttttctattcccagcttctctagagttgttaaattcttgtacatcaccattatagttctcgtctccatttggcacatcaacaatatgatctggatcaatctccaaacgacaattacttggccacaccatatctccattatgcaggcgtatgaagttgtgtagaacacaacaggcaaccgaaatatcaacttgtttacgagctgggtggtgtgagccggtctttagtataggaaatctcatttttaatacaccaattgctctctctatatggtttttgagttgtgcatgccgaagattgaataactccttataattttgtggcttttgattagctctgccctgttcctttaaatgatatcttgtcccacgatacggtgctagaaactgtgttgtatttgcataaccagcatctacaagaaaaaatttaccaggaggtacttcaaaaccatggtttagtgcatcttgaagaactcttgcgtctgaagctgatccctcccagccggcatgtacatgtacaaatttcagatcgaagtcgcaagctaccataacattctgagaaattgtttgctttctattccggtatggttcttgctggtctagtggaagtatcattggtacatgtgtcccgtcaatagagccaacacaattctatacaaatacaaatataaccttgattaagtctttttatgtacaatgattggtttaactcaaagtaaaaaaaaaatcaaaacatgaatctgttcatacctcaaaaaaggggtgaaattttggtcttctcaagatatgatgggggtgtaggaaaggtggccgtatatatacacatgtaagttgtgtaactgcatcaagcacaaccccaaaatacttgcttattgtttgcccgctgtgttgaaactgatcttgcaaggtctcattacttgcattttttgctagtgcatacaagaatatagcaacttgttcttctactgagacatctcttgcatcagcaagtagttgtttctcacgcaacttatcgactaaagctcgaaaaacattaacttccatgcgaaaattccttttgcttaggctctgatgacctgttaagatttcattaacacgacaagcccctgaaagttttgatgtgtgcatcggtttcctactagatgatggttgtgacgaatctccttcgatggtagggagaacaaaaagcatgaactcatcttcattctgtgaccgtcgtcgataacttggatccatgacaatcacaggggaaatcaacaacaaataataaatctgatggtttggtctaccaatatatataggagagcagaagcaagcaaataagttgctaatccttacatacataccaaaaagaaaaaaaattcatttatgacttaccaaatgaattgccacgtttgagctcttgtcatgcttggccgatacaatcgaaggtgaggtgagctagttttgttgatgtccagttgcagctacagcaatatatataaggacatgcaacggctagtacttgctttgaacgccaacggctatctgttcaaattcaaaccggaagagaaatcctgtatttttcctatagcactatcaaagggcacctttcattttttcctatgtttttgattcctgcgggattgaagaatcatactacttcaattcctgtgtttttcctattcctgtgtttttcctatcctgcgaatcaaaggggccctcaaagtgcatacaaccttgcagtttaccatggctcaagccaacaacaaatagagattccaagcaatgcatacaagtctaggagcttaatgaatgctgcggcagcaaaatgcaagcatgtatagcttagcttagtcaaaaattgacttgacacaagttagcaatagcagcaaaatgcatgtagtagcaaaagatatagcatcatgcatgaattaacttgatcgaacttgactgagcaaaagattaagtttccgcttccatctcagattgagtcctcttcatcgaacttgtagacagcttgttttccatttgagtctagcaagcaaggagcaaacattgttgttgatgagagaattaaaaataagcattacaaagagcaaagtttgaaacttatcttacaatagcctattgtacagcagtggtgtagcatttttttttcttgctgtagtggaactccttgaacaaatcaaatgcattaggttcttcttcattgtatttgtcacgctgaaaacaacatatatgcattatgtccagcaaatgtgtacagtgttgaacttaaaaaaaaaggatgaatctagatagcatcaaatcaccgttgagctgatcaaatcaagcatgatccatggtatcccccaagtaagctgttttctgcacctctttttctttttgttggcaaatggattaaaacattattcagttttgaagatatctgaaaatatagcaactgtggatttctgaaaataaacacattctttttttatctaaaacactttcttttttttatctagtttctatgaaactttcacgaatattctttcttatttatgactgcacttgcatttgcagaaacaaggaattcagttttttgtcagagatcatattgttacagcatgaattgacttgcttaactaaattagaggtttctgcattcatcagattcaggaactttgataagcaactagcatcagcggatagagagagattggttacagttgggatgcggtcgctcgcagtcgaagttggggcgcttcaccaatcaccagtccctctcacagtagcagatcccgcctccgccctcctgcacatgggtgaggcacatgcgtcaaaactcgccaagaaaactaatgcaagaaacaaagatagaaagactggcgcctctcctcttctttttcatccgtgtcaaaccgtcctcgcccaccatgatcgcctgccgtgctccctatgctcacgcgtgcagcagtgcgtcgtcctcctcgagcagcctctcgatggacggagctcgcgagatgtaggaagcaggcgcgctactgggaggggatctgcgccctgacctgctgccggagaaggaggaggaggaggactcgtcggagctctccctcgccggtgcttcttccacctcgattcacgtcaccggtggctgccccggatgctgcgctgcacgccccctccgggcccgagaggcgccggcggcagcggatccaccgctcccgcgcctggcagcggtggagacggatgccggcacggcaagcggcgaagggggaggaagccggcgcggtgagcggcgcccggcggcggcggagacgaaggccggcgcccagcagcggcggagacagaggccggcggtctcatctgcagtagcgcctcgcgtgtggtggcggcttatctgatttggatcggctagggttgaggaaccaatgcgattttactaaaatacccatggtgcatccgaagttaccactaaaatatctggacaaaatggtcatttcacgttgaaattttgatcaacatcccgccacactgaaagtttggcgcccgctgctccttcgggccgccggcccagcgtctgtttttcctccctcctctcaattaatttcaaaatattaaaacttcaaatcgaattttatcatactaaataaatttatgtgaaaaagatg

SEQ ID NO: 6992 - DNA, 13212 bp, Oryza sativa
  unsure (1)..(13212): unsure at all n locations
aatttcaaattatgacaatttcaaacaacattttcaaatacttaatgatttcatctaaaaaagtcatcaataacaaagtggtataactcatcaatatctataacttttatttgggtcatttcttcatccgttaaagcgaattgtaacattattcacaaaatgtacatatctcttatacagtttataaactatgagagagatatgtaaattttataaataatgttattattactttgtcggatgaagaaatgaccaaaataaaagttatagatattgatgatttatacaactttgttattgattactttttcagttgaaatcatttagtatttgaaactgctgtttgaagttgtcataatttgaaattcaaattcaaattattgaaatgaagtcgtatagcaaaatgaccaaaacaaaagttgtagatcttgataagtcatacaactttgttgttgacatttttttttcatttcaaattatttactaccagaaaaattatttgatttttcttatatttaaaattcaaattttatataggtcaatcaaagtcagatggagaaataaccaaaataaaattgatagatctaattaagttatacaactttgtttttgataactttttcacataagtttatttagtatgataaaatttgactcggattttttatattttgaaattaattgagaagagggaggcaaaatggacttctcggcgaggggggagcaaatgggctaggctggcagcccgaagaagaaggaggggaatgggaagccggcccaggacggagagaaaggctgcgggctgagggagggagagagtaacacttgggccaaaaaaggcccaaggacagagagatattttaatttattttccatttattttaataggttaaatgaactttgtggtattaaaactatttattgagctccgaaaattcacggaaaattttagagaataatttagaccacttagaattttacaaaaatatttccggccatgatttttaaaggaaaaatttagtttcctcattaattcacttgattaaattgctttaacttttaatatatttcctgtagtgaaaagtataagtgagtgcatacataatcaactaaaagaagtagctatgaatgttgctggataactataggtgttaggttaaattcctacaagctccaaatattttttgttcgcacactatatatatgcaaatattttcagttttaccatatgcaacatatacaagtaacaaattagtaacaaaataatttagttcaaaaaaaatttgtcttttgggtttgatttgttttgcaatcatttactgcttcaaaatgttgtttgaagttgccactttttgaaatttaaatcttcaattgataaaacaaagtcacatgaaagtatgacaaaaataatagttgtaatagcacaataaatggatagatcatgagtttagaaaattttataaaaaagaataattaaagttgaagttagtatgagggagataaactaatttaaatttttatacacgcattaaaagtaaaaatctgcagctattctcgtgaattttatgatgaacaccacgagcaggtggcaggtccattacctgctacagtttgatatataaaatacagtgcacgtcgtttggcaaaacgcttcagtggctcagtggggtttcctcatgaatactgtgcgtgttgtcgtaggttcgagtcccctagagggctacatttttttgtttcttgtttttttacaaggcgcagggtggcctgcggctagcctgtcttggctgcccatgtggaaaatgggccgctggcccagctgaaggggcagagcgcgagagggaggctggcccgagcccaagaggagagagtgagccagaaatggtccaagagagagtgtagcttttcatttttttaaattcatttgaacctcaaattcaaatccttttcaagcaaaacaagttttgaaatgccttttgattatcgtcacaccgtgatgattttaaaatcacacactgtgacgatctggataaaaccgtcacgagttaacgggccaagaatatccactagtgcacgtccatgacggaaaacaaattatcgtcacggattgcctctgtcagtgacggtttatgaatccgtcaccaagaatccgttatggattaacaagtttcttgtagtggcatgtgtaaaaagtgcatggaccggtgttaacctccacaaagtcaggcggtggaccaagaaaaaaggagagagtagtagtcttttgctggtcacgttaattatgatagggttacatgtgtatgcaagcatatgttggctgccatagtacgtgcatgcattatactactgtgcaacattggtttacgtatggcagggagccaggaagaccaataagctagctgtgtggtggtgctaattaaacgtggagatcaaagcgtgcaaggctaccaggagtctaggacgcattggttggcataattaaggtggtggtgattcagtagagagatgcacaggcgcaggggcaattggtgtggtgctgccatgataactaagacggaacttgtatggtctacggtgacttaggagatggtacatcatgtggcattcggtccagagaggatcgaggctggttaaactgggccggcagggtggttagaccgacggactggttagactgcggagcttggacggttagaccgggttcaacggaccggtggttcgttgcagaaacttgtgagcggattcagaagaagggcaaaaaggttctacggtctggatagtttgcaagtgacaatggcgaatagactggcggcgacaggtcggtcaggtcgcatatggaattatctggcagacatgatatatatgggactcgacgaggagttgagatatatggagttagaccagaactgaagggaaaaaaaagatcccgggcaacagcgggtcaaatatcgttgatggggtcaacgaaactgtttggcaatacaggatatatccaggatatgcaggtcggcatgatgggggatatatggaaatctgcgtcactgaagaggaaaagcaagcgctatggtgttaatttcttcaagggattcaaggcaacagtgaattttctcaaagtatcataggttcagtctacggatgcgggaaagcgaggatgttggatttattagctcggttcataagacaacaaggaagaaatggttctcttcaagtctggtgagtttgatttatctatttggtgatgacataggttatctggccatggattagatcaattcaaatttaagatggaagatggaggtgaacatggtcttcggggagtctatgatgtgacagctaggaagaaatccaatttcgcttggcaagacgactgagatgataggtaagaaggtggagcactgttgcaggtggattcaagaggaagaaattgcagggatagcggagtctcttcaaggcggcgggtctggcgcaggctcgtcaggcggctcgtggtgaagctgcaaaaggaaacaacccaagtctggaggacagatggattggcatggtgattctactacttctgggtggcgtatattcgccaaggtagagtttgttagaataggtgtcgaatatactagtcctatttggttacagttggacttggagttgtaataggtgttaggggtggagttagagtcggactctataacccggcaactctcttaaatagagagggggacaccacaatgtaaccatggcgactacagtgtagcatagacacgcagggagaggatggcggcttggccatggactcgtagcggctaagagatatattggttggggaggagcgcccataatcagagccctgggaatgtaggcttcggctgaacctcgttaacaaatatcgtgtgttcctgtgtcgtcatctggcatgtcttgggtgatcaatgactgaaacgatcgggagggttagtcgtcattccgctatatcgactaactttgataacaatactctctttttttagagctagggcatcactgcccccatttctattaccagaaacgggaataagtgtcttacagagcaagagaggagagggagaatagcagaaaaagaaaaaaactagaagcagaaacctcaaagggaggattacagttttcctttgccccagaggagcgaacacagagaacatagcagtaacaatgatactgctatgttctctgattaatactacgtactccacaatgatactgtcagtcaagtgtcaataatccgttttgaactcaggtactggggcttccgctagttgaccgatcagcttgcattatgcggcgcactagttgtttgtttacgcgttggaattcttgagcgaaagcgactgcatgtagccttacgccctcgttaatccgtttagtgcttaaaaacaggcaagaaatcgatgccaattttccttttttggtccttattagtcagcaaacccagtctgttttgccgtcttagaccaaactatttgctggttgctagtactagttattaaccatggacgtttcttcgacagtaaccgtggagtttgttttcagaaattgattatcaatccacagctcttatcttcaaactgaaaaaggtcgcaagataggatcacatgagctcaccatcagcataacgagatggcagacagcgacagggctagcgtatgcatcaactccggacaaaataatatactataaatatgtaaaaaaatagaaagaaaccatagattctttgatcctactcctcgatcctcggttcctgtagcagaagatcatgcatcaaaataaaatatttcctctattctcgaataattcacactcgtaatattcacgcttatttttgaaaaaaatatagatactcgaaaatatgttgtattatcgaaattataacattataaatataaccctataagttatcattcatcattagtaatttatggtcaaagtacaacacccatggtcaaaagtgacacattagagaacagaggaacaaacaagaaatggagtcgcttgagccagtcacactcggaagtcagaacagagaggatctcaaattcaaagtcaaagggacatggcactttcattagccacctgatacagctagcttcatgaactgctgtacagtaatacaatctttgaatcacactcacatggaaccagaaggtatttcaatcagtatatagcgcggaagaagggggcaaggcacatggaatggggataggagagcgcgctcaagtcaaaatgggtttagttctatgcaactaaaactacaattctatgtttgtatattgaaaatatttattttggaatcgagagagtagtactatggattggctgctctctacagtaaggtgccatcaatttcccaataatcgtacaatctaacccgtgttggttaaacattctcggattctcaagttataagttgataaaaatgggtttcagtagctgggcttgacatcgtcattggctctgtcactaagctcaaccgcgacaacattttagtaattggtatatatgttgcattcagtatgcaacatttcaaggaaaagggcatataacttagcggttgcagtgatctaagtagcactcgaaggttttgatttcaaatctccataggagtgaattttagattgagctattttgagaggttaagttcccaatttaaaaggctgcatatatccaattagatatggaggccggaaaaaaattactcttctaaaaaaaagtactcaagaaagcactattaatccatatttgaagcttcaaatagaatgaagaagaaaatatgcaacatttctttttctaaattgcttcaagagaatataattaatattggtagggaaacatgaagagaaatacaaacagaggcttgattgaaatctgatatcggtattcgccagccaagtctggtctgaaacggggaagtttgcaagagttgggttcaatcccacgaaattcctccaaaatctcccgttcgaaaggaggtctaaaagttaaattcctttcgtggaagaaaaattcttgcgcttcaaattaaaaaagaaaaactggtccatgtgactatgtctcacgaaaattgccgattgtgtactttacacacagtactgccgtactgggcttgtaattgtagatgaacaatttggttcaggtgatcaggtccgggctttcttaaaattgggcaaatcaacgaaaatgacagaaacaggccagatgtcaagaacgccatggcccgtctgtgaacttggcagaacagcccatgtgtaaactcaaagctttgaggtttcaagttttttttttctctttcaaattatatactgtacacgtactattgtcttcttctatccagtatccatggcgcaagcccagtacggataatattttacaattgggacttgggagagtatattttaccacttcaaataatattttcacagtcctgaaaagtatttacaatcatgagataatgcatctggtaggaacgggcacttaccgtagaaaaataatcttacaggtgtcagccaaggaggcacttacccagaattttgtaaaatttactcattaattaactatttcttccgttccataatataagtatttttaatgtttaaattttttccctcgatatagcaactaatcaacctattttcaagtcaaattactttcttgtcttaaccaatcacaatctatcagttaatttgtttatatattttttttctgcttgaaccaatcataaccattctgctctacaatttgcttatattttgcaatgacacaagtatattatatggcacgacaacagtacactagccctgattacccaaattctgccacgatcagatagaaaattgtgtcttccagagaagaggaagagagattctacacttacccatcaaactccctggttatcaccattccatgggctaaaagaaacactagctagtaaccacatgcgcacaccctaatagtgactttgcgtaagttggtttcacaagtcatctttttctgatcttttttaagggtgatcgcgtgcacaaatcctagtaccatcaaaaggttggcacatagaaatttcagtgacaatatgtaaacatgttaggtcacagtcacattggaatgttatgtgcgtgtgtgataatctgattcctttctgaagaataataaacagtgtaattcctctttgcttatgtacattaatcagtgtcagtcttttcatcatcagaattaccggataggagtagggtattacttcttgaataagaaggcctgaacctgtataaaattccttgtcttcaaacccatccattttcctagcttgatagccacccccttttattattgccaaaatcttgtttcgatagttactgtggagattatggttaccccatatctacatggcggttatattccagctggatatacagtaccaaatatagatagaatatttttatgaggactcgggttagattctaaacttgtatgtcaagaaaatacctggtatcctagtcggttacgattgtgttttatctgtaatcccatattccgttaggatatgggttgtactttgtattacggatcccttcccctatataaggagggtccgtgtgcctcttggggcacgattcttttttcccaattatacaatcaataacacactcggcggaatcatctccggacaggagtagggtattacttcttgaataagaaggcctgaacctgtataaaattccttgtcttcaaacccatccactttcctaacttgatagccacccccttttattattgccgaaatcttgtttcgacagttggcgcgccaggtaggggtagcgtcaagttctcgcctactaagtgcgatgggtttcgtttctggcatcgacgacttcgccttccctcccgggcaggcgttccggttcggcagcctcgacttcatcaccaacaacttcggcaagatttctctccttgactcggattcagaccagtcggggagagaccaggtccccgtgccattcggtattctgaactcggccaaggcctactccaagataatctctctcgagtcggcttcaaaccactcggacgagatccaatctactcttccgcgaccagatcaagacgacgggtcctacccctcaatcttgatgaaacttcctgatgacttggccgccgttttcacagccaaaacatctcccactcggagatctaggcgagctccggcatcggccccgatccagtctagatccaggaaggtcggcgttatactccaacctcttgggacagtctcgacggaagaattggatggctccctctgctcccccggcgtcagttctcgaccaaccgagatcctcgactacgacgacttcggctaccactacgaccacggcgacctcgacaacttcgacgacagctatgaggataactacatgcccctcttcttcggcgtattcatggctgacaacgaaacggaagaacagcgccgagcccgagaagcggaccaagatcgcgcacggcaaggagctgaacgtcgctgactggaggaagtgcgacagcgacaggagcgagaacgactacagcgtgagcaacaagatcgcgaacggattgcaaaggaggctgaagatcgacggcaacgcgccttggaatctgggcgccgagcgagagagctcattgggcaacaagacgtcgacgggacatcggtcttccgcaccgcccagcagaacgcggttgcagcaatcactctcctcgacaccctcctcaaggaagacgcactcaaccaagccgatcatgttgtcaacatcttgaaccagacgaagaccatgatcgctgcctcggttccagccaactccgtaagcatccgcaccccgactggtagccgagcccctcacctctgatctcatgatcatcatcagccaagcctcagcatcaccggcacaggatccagtcgcaggagcaggggtcacgacgaacgatctgttcactcgcctcctgaacgtcacagggagcgccgagtcgaacggcctcgctctccacctcatcagcgccccgtcgatcttcgcgacatgatcaaccagcaccgtgcagcacgaggtcaccgccattcaccaaatcgctacgacgacgacgtggatagagtggctaccttcactaatgacctacgtcgagtggattggccagtcggctttaagccgactggaatcgagaagtataacggcaccactaatccggagtcttggctcaccgtctacggaatcgcgatccgtgcagcaggaggagacagcaaggccatggcaaactatctacctgtggccctagcggactccgcccgatcctggctccacggactaccccgtcgcacgatcggatcatgggcggaacttcgcgatcacttcatcgccaacttccagggcacctttgagcgccccggcacacaatttgacctctacaacatcgttcagaagtctggagaatcccttcgagattacatccgacgcttctctgaacaacgcaacaagatctccgacatcaccgacgacgtcatcatcgccgccttcactaaaggcattcgccacgaggacctagtcggcaagttcggacgtaaacctcccaggacggttaagcagatgttcgaaaaagccaacgagtatgccaaagccgaagatgcaatcaccgcgtccaaacagtcgggcaccacttggaagccaaagaaggacgcaccgactgcaggggggagtggaagtaacaaccacaaagatcgcaagcataagcccgaagaacttgtggcgaccacctctccatcttaccgacaacgtccccgcgtcaacaccttcgacaagataatgaactcccaatgtccgcatcatcccaactccaaccacgtggccaaagattgcttcgtctacaaatagttcacagaacaatacgtcaagaacgcacgtaaaccttcagacggagatcaaggcacatcaaagaagagatgatgaagacgatgccccgactggttttcaagatcatcgcaaagaacttaatcacatcttcggcggacccctggcttatgagtccaagagaaaacagaagctaatggaacgggagatcaatgcggttcagcctaacacgccccaatatcttcagtggtcagaaacagcaattaagttcgaccgctcggatcatcccgaccgagtggtccacccggggtggtaccccctggtactagacccagtggttcgcaatgtcaagctccgacggactctcatcgatggcggcagcgcactcaacatccttttcgctaaaaccctggacgatatgcagattcctcgcacggaattaaagccgagtaatgcacccttccatggcgttatcccaggattgtcagctacaccactcggccagatcactcttccagttaccttcggcactcgggagaattttcgcacagaaaatgtttgtttcgaagtcgctgatttcgagatagcatatcatgctatactcagacgaccggctctagccaagttcatggctgtcccgcactacacctacatgatgatgaagatgtctggtcctcgaggggtcatatcactacggagcgacatcaagcaagccgtcacatgtgacaaagaaagttgcgagatggctcaaacccacgagaccactctcgcccgcgaagagatccgactggctgcgaccacggcaagcgagggagaagtgcctgcaaccaagctgacgaagaccgaagaaagtgatgccaagacgaaaaagattcccttagatccctccgatcctgacaagactgctgtaataggcgctgagttagattgtaaataggaaagcgcgctcatcacctttcttcagaataataaagatatttttgcgtggaaaccatccgatatgcctggtatccccagagaagtgattgagcactctttacatgttaaggaagacgccaaacccatcaagcaacgactccgccgttttgcacaggacaggaaggatgcgatcaaggaggaattaaccaagctgttagcagcaggcttcattaaggaagtccttcatcccgactggctggctaacccagtcctggttcggaaaaagacggggcaatggcgcatgtgtgtcgactatatcgacctcaataaatcttgtcccaaagacccttttgggttacctcgcattgaccaggtggttgattcaacggccggctgcgagttactcagcttcttggactgttactcgggatatcatcagatccgactaaaagaatccgactgcttgaagacctcgtttattacgccctttggggcctactgctacatcaccatgccctttggattgaagaacgcaggagcaacctatcaacgcatgattcaaaagtgtttttcaactcagatcggtcgcaatgttgaagcctatgttgatgatgtagtcgtcaagaccaagcagaaggatgacctgattgcggatttagaagaaacttttacaagcattcgtgctttcaagatgaaactaaacccggaaaagtgcatcttcggagtaccgtcagggaagttgctcggatttatggtatctcaaagaggcatacaggccaacccagagaaaatcaatgccatcctcaacatgaaaccgccaagctcccaaaaagacgtccaaaagctgactggttgcatggcggcgctcagccggttcgtctcacgactcggtgagcgggggatgccttttttcaagctgctgaagaagactgacgatttctagtggggacccgaagcacagaaagcctttgaagacttcaagaaactcctcactactccaccagttttggcctcgccacatccgcaagagccgctactgttatatgtgtcagcgacctcccaggttgtgagtacggtcctggttgtcgagcgtgaagaggaaggccatattcaaaaagtccaacaaccgatctattttgtcagcgaggttttagccgactccaagacaaggtatcctcaggttcaaaagttattatatggtgtcttaattaccgttaggaaattatctcactactttcaaagtcactcgatcacggtggtcacatcgtttccactcggggatatacttcataatcgcgaagcaaatggacggattgcgaagtgggccttagaattgatgtctttggacatatctttcaaaccacgaacttcgatcaagtcacaagctttagctgatttccttgctgagtggaccgagtgccaagaagacatgccagaggaaaagatggaatattggactatgcatttttgatgggtcgaagaggcttacaggcactggagctggggtcgtcttaatttccccgactggagaaagattgagcgacgtattgtggatacatttttctgcgtcccataacgtggcggaatacgaggcgctactccatggattaaggattgcaatctctttaggcatccgccgattaatcgtccgtggagactctcagttggttgtcaatcaagtcatgaaagagtggtcttgtctagatgataatatgaccgcttatcgacaagaggtacgcaagttggaagacaaattcgatggacttgagctcacccatgtcctccgacataacaatgaggcagccgacagactggccaattttggttcaaaacgggaagcagctccttcagatgtgttcgtcgaacatctttacgaaccgaccgtgcccagaaaagagacaactgaagccatggatactcaaggcgtaagcatgattgaagccgactggagagaacctctcataaaatttttgaccaaacaagaactccctcaagacaaaaatgaagccgagcggatttccaggcgcagcaggctttacattattcacgaagctgaactgtacaagaaaagtccatcaggaatactgcagcgttgtgtatctttggaggaagggagacaattgctgaaggatatacattctggtatttgtggtaatcatgctgttgcacggaccatcgtcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6993 - DNA, 27016 bp, Oryza sativa
tggatttggtctttttcttgaagatatggtaatttagtgtccattatgatatttcttagttgctttttgccttttactgtgtttatcagattttaattcaaagattaaaaatctgtatgatacgattataaaattttttcgaaagatacataggtactcccgtttattttagtgaagtaagcaagcactgaaatcctacgtcagccataccctgttgaccatagaatctcctatgctggtagtagataaatacattcacatacattttttcagtgatatttcgtacaaaaacaaatgttcttaacacaaaaatcaaacaaatggccctcaacaatagacaaaatgtgaaaataatttgtacaatattaggtgtgtaatcatcaatacagaagttacaataaaattttccttccaaaaacacaagaaggtaaccgggcattcacacggccttttttttttctcctttgtactttatactaagaaagtgagaattttacattattgacagtttaaaaaaaatatagtaattaataactatgtacacccacactaatacttcttccatgcttttaatatctcaatttattatttaaaaaatagaaataatagagttatatctgtgtttgagtctcaatttagcatattcatgatttgataatttcgaattttggaattaacaaaaaccgagctgtcctatgcttggtctgtcaatcatattttctataatttaggtcctatttggcagatctcacatgcacgctggagtagtagtttaaaattttgtatttcatctaaaactaaagcaaaatgattcatccaaatgtaatgaatatagtaattcgatttcagatgtaatgaatatccaagcatagcagcatttgttggtagtatataagatggacatgttccatataattttggatggatgcagtaacttcttacatcttagtcttgatacaaaggaagtttgttgggggtcctatgactcctgccaattacagaacactgacaaaactaaccatgctacatcttcagatggtacagaaagaaaacacacagctacaaatactgatcagtatttcctcttgaaagaaatttatcaacagaggagactttctgcataactttacattgcatgccatcaacaaaaccgaaaatggcatacctccaggttccgatggaaaggagcattccaaaccatagccaaaaaccgaaaaccactccagccattacacagtagtagaaatactggtcctcgcatgttctacagtctctctcatctgacgcaactgaagcatttgtgcatgaaatgttcaacggagggccacagagccctgaattatggctgtatattgatgggtcagtgaaggtttgaagttgattcccggtgggtatcttgcctgatagatgattatacgagagattaagagtgctaagggtagatataccagcaaggcttggaggaatggctcctgaaatttcatttgacgagaggtcaagggactcaagatttttcaaactacctatgttttcaggtatcccacacgatagattgttccttgacaagttcagaaatcgaaggccttggaggtttgttaactcatcggggatgcattcagacaatgagttacctgacaaatcaatacccgtcattaattgaagtgttttttggaaaattatctcctgccccttccagattatatcgattctatcctgataggtagacccatctaatgatcccgcactggatacaatttttggattcttcatggatgttaagttgccaaaagatgtgggaatcgaccctgtcaaactgttgttggtcatatctagcagttggagttgagaaagatgtgataactcagaaggaatttcaccggtgaagttgtttgatctaaggctaagaatcttcaaagatgaaaggcctttcccaatccaaggaggaatgccaccaaagaaattgttgttcccaatatctaaagtgaccagcgtctggcatccctttagcgctgatggaaaaacaccggtgaagccgttgccggcaagatgaaccgattcaagagaacaattgtagcttgtattgactgcagggatttcacctgagaagcggttgtgggagaggtccatgaactgcaggctctgcagattccaccagcagtcaggcagcttaccggtgagcttgttgtttgacaggtccaggatctggagagaaagcaacctgcaaaaggccgagccggagctgctgttggaggagttgccgttcaggacgttgtacttctccggcatgactgcgccgccgtcgtatagcctccgagccggcctgctggagaagtctacttcatcattgcggtagtagttttcgtcgtcgtcgccgtcgtatattctccgtaccggcctgccggagaagacgtcgtcgtcgtcatcatggtagtagttgtcatcgtcttcgtccccatcgtaatggtagtagtgatcgtccacatcggcatcgaggctcaagctcgtcacccgttgaggagatgataacagcaagagggagagggagatgcagaggaagagacagaggcgcagcacgagaggggccttggctgccatggctggatttggtagagtgcaaaggagcttgtggaactgaagtattgaactccacttgtaaagctgcaggagtatttctttctctctttcttggtatggctatggacagggggcgaggttgaccgtgaccatgggggtcgtcgggtgggggtgctgcggattaggaatttggagcgctcgccgtgtcgcggtcggcgcatgtttcacacggcacagcgacagcgatggaccagccggctccaccatgtgagatgacttggactgatgacccgagaaaggcacaatggcacagtatccagccagagtcaaggatggagccaatggcgagcagtgcgttttgcagtcaaaatttcagaacacacggtggagttgtcagagacgaatggtaccttgatcatgagaggctcgcccgatgatggcgctcccgcgcgagcgacgtcgcccgccgcgctcctgtcccctcctcgccgtcttcctcccgccccgagtccctcctcctcctcccaggcatttcctcgagcacatcatgcgcgcagcacgccggcgagaccgagacattcctcaaagcgccgccgcctgggcaaaacccaggctaggtgggggaccgagctctggccgccgcggatgctgcagcgcttctattggagccacgacggcggcggcggcgcgcgacggccgggaccctcgctccgccgcgtcggagacagaagccgacgccgacgcgagcgcaaagtagctcgttctgacgcggtttcgtcctcgattcgcgagcccggcccaaacaaaacgaaacgaagtccgcttccgtcatctatacggcccattattacatactccacacggtgcttttgttcatgggcttgatccatttagtacggcccagcacagtcctcgtctcgatggcccatcacctgtaatgggccgtacttctccacggtgctactagagatggcaatggggacccaaaacctgtgacccgacgggtttttactctattaggagctaattgtgttctaactcttatacccatgggtctactaatgggcaaaactcttacccattaggtacgtgggtatgggtccgttctttacccacccatacccaccaacccgtgggtgaaaaaacctattgattaagcctaaaactataagcaatataagtctcaacgactactaaatcataatatgaaactcctttcacatcttaagcattgttctattctagttatatgaaattattatttgatttcttgattatgtatgtggttgtataattttttttactcgcctttgtatgctaatgttaatatattattgctagagaaaatattgatggtttacaactctaatatgactaattatagtacaaaactataaatgctacaagtcaactatatgggtatgggtacccgttggatacccgttacccgcacgggtgtgggtatggggaagattttgtacccgcgatgggtgtgggtatttaagtgggaaaatttagacgttgcgggtgtgggtatgggataaggaaacctgatgggtatgcacccgttgccatctactgctacacgcgcgcctactaacgagcggagtcgtcaggatgatgaccagctgacgtcacgttggcttctacttactctctccgtcccataatataagggattttaagtttttgtttgcactttttatcactcgtcttattaaaaaaaatttggaattattatttattttttgtgtgacttgctttattatccaaagtactttaagcacaacttttcgttttttataattacacaactttttaataagacgagtgatcaaacagtgcaaacaaaaactcaaaatcctttatattatgggatggagggagtaacattttctgaacttcatcgggaaaagcaaaaaggtttattccgtaattccgtatgaaacaagtgaatagcgatattagacgaaggcagcgacataaaattgtactaggctcatagcaaggaattcatatcaagttcagttatacttgtaagaggaggtgcactaacatactgttagccagctataaacatatttgtcaaggagtaatcctctctagcgggagatcgtgagatcccctttttgtgagttcggccgagggaaaaggctcgcttggggagatcgcgtattcgccttgaacgctgctatatcatgtgtgagccccaagattatacaagttcgggccgctatcgagcgtaacaccctactcttgtgtgtgggattatggctgagtgttagaagggttcctaaactccggagagcgctcccgcttctcttctcctagagttcaggtttactgagagtcgtccccttttctcggtgggcaaggtcctccttttatagttcaaggggataccacatacaccgcctctacctactctttcatgggaggggcacccactctatcttgaccgggccacgatccgtgccttcgcccggaagctaagcagcagtccgtccttgagcgggacccagtgctgccccccgcctgacacgggggacagccctttcattccctcataaatgggtgaagacttgcggtggtcctcctccacggagggaactccaaatgacgcttcgatgggacaggacatacctatctccactccgccggagacagaaacgacgtgggggcacggccgcccgtcaatcggacgtgaccggcaacaggccggtcacagattggtcacgtccgactgacgtgggtcagtcaggcggcaccgcacgtctgcccttaccgcattaaacgcggtgagggatagttggggcgccgcgcattgatggctgttcagcccgggtcctctccccactcactccccccgccacatggcagctgggcgagagccttgaggtgaggcagcgcgaaggcccgaggggcacgacatggcaccccgaggcccctcggctgcttttgcgactcgcgaggtgcgggagtagggccaggctgtagagccacgcggcaggataggaaggtaacttcccctcactttgcatacccccgggcccatatctccgacagtagcccccagcaccacgtcggacattggtccctcgaggacagtctgacgtggcgcctcacgacttctcgtgccgtggttgtgggcccgacgggaaatccagacggttgccggcgagcggccaggttggcacattagccaaaatggcgatttgaccgccgttaaccgcgctgatgatgggggcgcctagggcgcgaaaatcagggggtcggctagaccacgcctagaatcgtcacccacgccgcctcgactccctcgccctttgtgagttcggcggggggcagcgggtgagatttgagggcttggtgggcaaagctgtgtgatcttgagggggttcaatcccccaaagacgatgagacaaaagggatttatacaggttcgggccgctaagaagcgtaataccctactcctgtgcttgattgattgagtgtagaacacaagtgcttggggttgcaagacccaagtgccagttcgctcggaagtcccccctccccccttctctcactaggactggacctccttttatacctcaaggggttaccacataggcccaacaacctaacttcctcgagaagtattacaatctttgcattaaatgcatgtcttgttccttaacttggaagccgcatacacgtcgcctcggtcgtagggcctaccaaaccatgccgcctgacacggggggcgcccatgtcattcaccatttaatgggtgaagacttctgggctcctttacaccgggaaaacgggagcctagctttaaccagagcgggaggaccgactctggctgggataagaggatgagaacctctcattatcattatttgatgggacatgtcaggctgcacgccgcctgacacacgagcagcgcacaggcgtactagccagtcccatcggtcattcgaccggtcacagaccggttgagtacactgacgccgcattaaatgcggcgtggcgcgaccgctcgagtcgccataaatgcgggtaggtgggcacctgtaggcggacacctaacccaccgtacgtggtgacctagagagggggtcgggggagcccaacccctagtcatgggagggggcggtcgccgcctgacctcgggcccgatcccccctcgggggagggccacgtggcgcctggggcagccttctctctctagtctcggccagggagtggccgccgccctacctcgggcccgaccctcctcgggagagggccacgtggtattggggggcagcctcctccgtccaatctctgggagggagtggccgccgccctaccttgggcccgatcccccctcgggggagggccacgtggcgcctagggcagccttctccctctagtctcggccagggagtggccgcagccctacctcgggcccgaccccccttgggggagggccacgtggcattggggggcagccttctccgtccaatctctgggagggagtggccgccgccctacctcgggccggactcccctcggggagggccacgtggcattggggggcagcctcctccgactagtctttgggaaggagtggccgccaccccacctcgggcctgactccccttgggggagggccacgtggcattggggggcagccttctccgtccaatctctgggagggagtggccgccgccctaccttgggccggactcccctcggggagggccacgtggcattggggggcagcctcctccgactagtctttgggaaggagtggccgccaccccacctcgggcctgactccccttgggggagggccacgtggcattggggggcagccttctccgtccaatctctgggagggagtggccgccgccctaccttgggccggactcccctcggggagggccacgtggcattgggggagggccacgtggcattggggggcagcctcctccctctaaacatgatacccccgggcctatatcaccgacaatattttaatgagataaaatatgagagagaagagcagcgggctacagatctgtagccagctgcagcacggatttcaagacgtagtgtgtgtatgataggtaggacaatatattaatagtatagtaagtaactactgtataaattggctattgtattggctatatgtgaattagagctagtagtgggctattctcctgaatttgctctaactgcaacgcacacgtggacccacaatccagagtcacacggatcgagcctacataaattctctgtatttattgtagaggataacatgtcataagtaaaataagagtgtgtttaattcacgttaaattggaatgatgtgatagaaaaatttaaagtttgtgtatacaaaaattttaatgtgatggaaaagttgaaaatctgaaggaaaagtttgaaactaaactcggcctaaatctcaatgccatagtgaattgccgtaaattgttgtatcgtcattagtgctagttacgacggcaacataagtaagtactcctaaatttgttgctgttgctggcttgctgccgcggcagctatacccagctggtgcaccatatatagacagtttttttctttactgttgcgattcgacgtactagtattatttgatccggagagtccacacaactgaacaaaatggctaaaattgatcctaattctgcccccatgttctttcttttctacgtttattagtacttcagaaaaaactaaccaacttcaaatattaaaagatggagggagtatatatcaacctgttgtattgagctttacattagctattaccgcaaattatcctctttttttcttaaacaacaagtacaatatagtatgacgtttctatcgatattaccggagattatcctcattatgcagaagcacgtgtctagcattagtatgacttttacgcgaacattcgtgtattagacgtaccctcgactcctaccgaaatgtggtgggaatgtgagatgatcaaagcagtagcttgacagtcttttttgctagccccctcaattatttcactccttcagcaaacttggacacaatacgtcaatatcttgttatgtttttatttcttttgatttttttttaaaaaaaactactcctgcatagttatcgtgttatgcatggtggtgatcgttcggttcaaagtttcaaacacacttgttcacattaatggaacccaccgcagttaatagcgctggagagggccatactcctgtgtgaggcagtacagtttgttgcgtgtcgtgtagccgtacgagctaccagtctaccacagctatctatctcgcggagtaataatgacttggacttagagcaggtacattagcaggctataactgcaaacatattttaagaatataaatgaggagagagagaggagcggtgggctacagatttatagccatgtgtagcacatactccaagacacagtgtgtgtatgataggtgggactagatactaatagtgtattatataactattgtatgaatgaactattatattggctatagataaattggagctagcagttggctatactattaaacttgctcttaggaatgtactactagtattattttctgttcctaaatatatacatcttgattgtttaacaaaaatggtactactacattggttgacaaatcaaaatattttttattacctcattggttagattttaaattgtttgtactcttctgattgatccatttaaaattgctagagatcggaatcaatatctcataaataattatataaggagaaccaactagctaggttcattatggtgtaaccagcctaccctcgttcaagttttaaattttagacaggtgttcgtatttacagctaattattgtttcactgataaatgatgtacttattagtaatgaggtgcatggtagggtgtacagacgaccgtggtgaattcatcaagtttatagcatagttattaagaccggaccggtgaatgaaccggttgagctctcggttcactggtttagcggtcgagccagtggttttaccggtccaaccacggtctgattactattatagaatgaatgtttatgtgatggcacaagcagcaggatggtggcatggctagcgcgtgaacctgtcaatcccgtgaccagaggtcgaatcctcgtctccaccaatttttctcgggattttgcgcgcgcatgcacgggaggcaactagttgggccccccattagccggtctttcccggtttgaccagccaggttaatctccggtttatataaaaaccgcccgagttaaccggttttctccggtccgattatacgtgtatcttgaacgtctatgtttatacatttgtttttttataaaaaatttgaataattctatagatgtttacatactggagtactatttggacatctatctgtggctttgtttagttccaaactttttctttaaacttctaacttttccatcacatcaaactttcttacacatataaacttttaacttttccatcacatcgttccaatttcaatcaaactttcaattttagcgtgaaacgccaccctatctctcggggagtaataaatggctggacttgaagagtgtcgcagtactgtagcagggtcgacagcgaccgtcctgccaatagggaatcaatgcggcccccgtcttaagttcgcttctgccctgtcaggtttgcccagccactccccgcgcagcagctcagccgtcgctaccaccacctcaagctcccgcctcgcgtgcagctagctgagagcgagcgctcgccatggagaacggcgccggcgccggggacgacgagtacacgcgcgacggctccgtcgacctccgcggcaaccccgtcctccgctccaagcgcggcggctggaaggcctgctccttcatcgtcggtacgtgtaacgtgttcgtgtgtatagtcgtcgtcgccggcgagcttggtggtgatgtttgtgtggtggtggtggtggtggcagtgtacaagctgttcgagaggatggcgtactacgggatcgcgtcgaacctggtgatctacctgacggagaagctgcaccagggcaccgtggaggcggccaacaacgtcaccaactggtccggcaccgttttcatcacgccgctcatcggcgccgtcgtcgccgacgcctggctcggccgctactggaccttcgtcgccggctccgccgtctacctcatggtcacatctctctctctctctctctctctctctctattcagctacataccctgttctcttctgcctctgtctctcctctctattcaacggaaaacaatattaaactctcgacaactcaaacaccacggttatggaaaaatctgaaaaaagtttcttaggaattttgaaacagttttactcctgcatgaacggagaaaaaaaaaattctgaagcatggtttgcaatttcggcgtatgcaaattatagctcagtaccgaaatttctgacgaaagagtaatttttttacacattttaaaatttagaattcgggtcttttaaaactgtttaagcttgattcttttgttttcgtgtaatctcatctgcatatatatatgtatgcagtggttaattattgacttctcatccaaatatgataatatatataattggaagaccctatcttgttttactcaactaatttctcaaatgtttgaaaggcatctaatatctccttatcataaatgatgttatattatattcaatataatttgtcgatatatgattagaagaggtaatgattaaagacctctcgtcagctaatagtaaaccggtcccttgtccctatccaaatttgcatagtagaccgtatcttcatgctacttcacccctgttaattaagaagctactactctctccgttttatattataagttattttgggtttgtattaactcgggtctcttcaagttttaccaagtttataaaacggtcaaattaggtttataaatgcatcattgaatatatttttataggatattgattttgggttgcaaatatcgtgaagtgaaatttactcttatatttttctgtaaagatttacttatgacagactcgaagttacgaagccgggtagtggtaatgaagcaatcggcaaaagaaaaccattctcccttttttttttaatcaagaaaaccagtcttgattggacaaaagaaatgtcataatactcacttcacttcatttgtcctgtttgcacccataatggggttcacttcacttcacaatgtcccttttaaaaaaggttttacaatgtcgacagtaaccgctttgttatcgtaaaccgtgttgcactcaccacacaatgttcataaaatttacctgtatacattattgatggtgtcaatatcattaacaatggggagagcaatatttcgacggaatcttcattttgaaggaaatgcctggatttggagataccttctgtacaatgaaagtgcaagaatgaatgccatgtgtgtgtggcatcccagtaggccggccgtacgtcattttgtatctttgcatttgtatcttcgaagacaataatctgtgtctttccaaactaaatccgacaaaaatgaaaccatcaggaaataataggtcaactaccatgaccccatgtgagatctggtcctgaaaaataggacaatggggtgtaagattgacaccaggttttgcttttgatataagcaagtaggggggtaatcctttccaaaatgtccaaaattagtacagaggattgatgtgttcatgttgtgacttcaagtccatttccactaaaaaattggagatttgggtaaacgtcacagctaattacgagagcatgctggaaaatgcatcttttgttttagcacactttgtactgttaataaaggttaagttctactccctccgtttcaggttaaaagacgttttgactttaattaaagtcaaattgctttaagtttgactaattttatagacaagtatagtaatatttataatactaaattagtttcatcaaatcaataattgaatatattttcataataaatttatcttgggttaaaaatgttactatttttttctacaaacttggtcatcaaaaatcaataattgaatatatttttataataaatttttcttgggttgaaaatattactattttttttacaaacttagtcaaatttaaaacagtttgactttaaccaaaatcaaaacttcttataacctaaaacggagggagtagttagtactaatatgcttttctaaagtagaatatcaacttcaccaatttttggtttggtgggaactcaggcttctaatttgggctttactggtgcaaactgcaaacccacacatgcttgacaggttaacctaacacaaaccttgttcatcacagtccaagtagaacttctagaaaccaaacccaagttcaatttcaagctgaacacatgagtttgaacattatttattcgttcaaattaaattcacctgaaatttggaaacacatggaagaattcctctctttcaaatttcttctgaatctgaaccatccaaattaacaaacgcagggcatgctgctgctcacactggccgtctccgtgccagcactgaagccgccgccgtgcgacggcggcggcggcgccgcctgcccgcgcgcgtcggcgctgcagctgggcgtctacttcggcgggctgtacaccatcgcgctcggccacggcggcacgaagccgaacatctccaccatcggcgccgaccagttcgacgacttccacccgccggagaagctgcataagctctccttcttcaactggtggatgttcaccatcttcctcggcatcctcttctccaccaccgtcctcgtctacctccaggacaacgtcagctggaccgtcggctacggcatccccaccctgggcctcatggtctccgtcgccgtcttcctctccggtacgccgctgtaccgccacaaggtgccccagggtagccccctcgccacgatggggagggtcgtcgccgccgccgtgtggaagtggcgcgtcccgctccccgccgactccaaggagctccacgagctcgagctcgagcactacaccacccgccgcgggttccgcatggacgcgacggtgtccatggcgttcctgaacaaggcggcggtgaagccgggcgaaggaggaggaggatcggtggcgcggctgcccgggtggacgctgtgcacggtgacgcaggtggaggagacgaagcagatcgtgaagctggtgccgctgctcgccacaatggtggtgccgtgcacgctggtggcgcaggcgggcacgctgttcgtcaagcagggcgtgacgctggaccgccgcatcgggaagttccacgtgccgccggcgagcctcggcgcgttcgtgacggcgacgatgctcatctgcatcgtgctctacgaccggttcctcgtccccgccgtgcgccggcggaccaagaacccgagggggatcacgctgctgcagcggatcagcctggggatgctgctccagatcgtgacgatggtggtgacgtcggtggtggagagccagagcctggggtacgcgaggaggcacgggctggtcgccaccggcgggcagctgccggtgacgatcttcatcctgctgccgcagttcgtgctgctgggcgtcgccgacgcgttcctggtggtggggcagatcgagttcttctacgaccaggcgccggagagcatgaagagcctcgggacggcgatgtcgctgacggcgtacggcgccgggaacctgctgagcagcgccatcctcgcggccgtcgagcgggtcaccggcgccggcaaggggagaacgccgtgggtgaccaacaacttcaacgcctcgcgcctcgactactactacgcgttcctcgccaccctcgccgccgcgaacctgctggcgttcgtcgtgctcagctgcaagtactcgtaccgcgtcgagtccacggagaccatcgacgtcgacgtcgccatggacaacgtcgcgcagggcggcggcgtggtgacggtcaaatcagaggcagccccaatggcatgacagcacttccggaattgtatcctgtctattcccgtctggattctgaagttgcaatgtaatgaagaaacggtgatgatacatattagcactttaaaaatgttaaatgaaaattttatttactcgttctgtaaaggaacggtaatacggacaatattcacagcttcacacaatcgcactagtagcaccatcgtttctcttatgcctatacttaagctaaaatgtgaattttaaagcttcactttagagttgattttgtgttttttttaaatatagtttattttacagtatttgctttcgaatcgataaggacacgtcgcataaattattttttaatttgttaataaacgattcgcatgaacgtaagtataagtaaaaggatggaaccataaatatctaggagtaatttggtgacaacgatggagatgcactattacagtcatgacgctagaggcaactaactccatccatcctaaaatatagcaatatagtacatgatgggacatgtatgtccatattcatagtactatgatatatcacatctcatattagattgttatattttgcgacggatgaagtatttgagagatactagctccgttttttaatagataacgccgttgactttttctcacatgtttgaccattcgtcttatttaaaaaatttacgtaattataatttattttgttatgagttgttttatcactcatagtattttaagtgtgatttatatcctatatatttgtataaaatttttgaataagacgaatagtcaaacatgcgagaaaaagtcaacggcgtcatctattaaaaaaacggagggagtatatcatatcggccgatgatgtaagctagtagctgatcctttcaaattatttatctttctaggtttggacttaagtcaagtatttccatctttttaccatcagatatatgttttaacaacatggaaattatgtaccaccagaaaacaaggcacgcttatatataacgtgttcatatgactaggtaacactctaactcaactggattgaccgtagtcagctcgccacctgagctgaaagcaggcacaatattgtcgatctcggatacttcgctactgtaaattgacgaacatgacatcaagacgagaaatctaaggaataagtccagtttgactcccttaactagtgaccgaatttgatctgtatccctaaaccacaataccggatatcttcgacccccaaactattgaaatcggtgcaatttgactcccttggcggttttggagggcagtttcacttatgtagggcccgctcacatatgggacccatatacgatcctccctttccttcccttattcctccttcctttctctctctcccccttaccttcccttcttcctcctccctttctctcccttaccgttggtgcaccagtagttcagcagcggtgccgggaccgggccgtcgtttgttgtttgttgggaggacgccaagtagggcgacgtcgaggagcgagacggtggcctctccccggaggtcctagtggcgtgggcgccgagccagccgcggaaggagacgcggatctaggtgttagagacggcggcgcggagaggaggagggcagaagggggaaggtggggccgggacttccgcgagcggggcaatccccggtcacgtcgctcctctcgaccttcgttgcatgggatgctaccatcggttgaccactcatccgcgccaagctagatgccatgggggccacatctaccaccagcggggcccaatgaggcacgcgggggcaaggacatgagggcgcgccacgttggggtgctcgtcaagatgtgctggtgtggacgtggatccctgacgcgcttgtttggatttctgcaggaagtcgaagctgtcccgccggcgccactccagcacctgcccgccaccactccaaaacatgctcctcgcacacgactgaagaaggggtagagagagggagagaggagggagacagagggaagagtaagaagggaaggagagagaggatgacatttgggtcccacatgtttgtgggtccacaatttttttttgaataacaagtgggtccacaatatatatatatatatatatatatatatatatatatatatatatatatataagttctaatgacatgtaagcgccacgtcaacgccacgttgtacgaacactaggtcaatactaccacgtaggcgctacgtcagcgaagctgccctccaaaaccgcaaatggagtcaaattgcgcccgttttaataggtgaggatcaatatatccggtattgtagttcaatgataggaatcagattcggtcactaattaagtgagtcaaagtgggcttattccgaaatctaaagtaagcttatttcataacaaaattcagctcagttactcttgggtcaataagctagcctaataaaccgggaagaaaagtcagaaaacaatctcgctagcttccacctctcatgctgcagcatgcttataaagcaaagacaaatctagggttgatttagccttcatactcaatggagttattcctatatgctccgctgagatatgttgtttgtttcactttcaatcggttaaacgttgactgaacagtcgtcatcatcacgatgtaatttctacctttcaatcggttaaacgttgactgaacagtcgtcatcatcacgatgtaatttctacctggaaaggaggcgtcgaaggagcttaatgaaacatatcaaatacaatgcaattagacaatatgagtgaactcttcatccaaataaatccttatccatgacccaaaaatcattctcttccattatctgaagaagattagctcaccaagttagtagaagtgttcatcatctatcctcgactagttcaaaagcagcaagaccaccttcccacggtgtgtaaatgaaccccaaaacagaaaaaaaactcccaaataacacgccacaaaaggtatggtaggtgtggcttgacaatattacattcactggttgttaggttaagcattaaacaatcacatgtctcagcatctgccactataaaagttcatttttaaggacagtcatatagaaactttaattttctgagtctaattattggtcttgataatgtatccaaacatttacaatcgttatttttcatgatccacacatactgactatgacctatatgaataatgagacgaccaatcaagaaaactgtagtaaagaataattaggcaatttgttttgttggtttgttgtgggatatgttatatgttaatcaagttagtccttcttattggagttgaagagatgacataaaaaatgtttctatgtgaacaaagtagcgttgacaagataacccgttaaactctttttttcttatagtaaagcgttcaactttgtgttgcgactccaaagctttattatggcacaaaaactttacacaaggctctaattattcttttactataaatcttaatttgttatgatgatgatttttaaaactaacttttaacttttaatttgttgagttggacgacaagttcagttatgtaaagctccaaggtcactgatagaagtgagcaactgttagtattttcatatttacttttcaatgatttatatcctaaatggcaattgcggagttcattacatatatatcaatagctaaacttgttatatgtattacaggattgatcagttgcttaagcatcatctcttatcgcccttataggaaactatggctcaaaaataaaaacatttaaaggatattatttttttctaaataatatggttcattgcatgttgagttttttgttacaactatataagatatatagttcttattgatgcggcttaatacatgttgatttttatagtaatgactatattaagtgcgctataaatgcaaatgacatataaatgattatgattaaaacataagaaagattgaactattattattttctatattatggctcactgcatattgagcttttgattatatctactattataaaaattgaatatatttttgccgtcattcgtattttggtatgtcatccgtatttgagtcattttttaagttcgttcgcttttgaaaatgtagatccgtgtttgagtcagattttaagttcgtttgcttttaaaaatacaaaagaagtcatacaagaaatttctttaaaagaacttgcatgctaacttgggattaaagtcggactcctaactgcagctcatgtttttttaaaaaaaatatccaagcgaattcctgaatttcattctatctaaaccgtataacaataataagattaaaataacattcacccattgcaacgcacgggcatttttctagtaactatataaatatgatatatcaataatactctagcacatcatatcttcaaagcaggttgcggaggacggtcctatttatatttctataaaagtgtacggatgtttgacaagtggaaaatatccaaatcccccttaaaaatctctttagagtttttaatgctcatgagttatattcctatttaaatactttttatcctggtaaagggatttcttcttggacctctttaaggaatacctacctttttcccttttccatgtctagaatcatcgaagagaaattatattgacaattcaacgtatctttaaacctttccacaagcatgcatttcttgcttgccttactttgagtagtccgcgtgctctggactgtgttaacgaccaagtttggtaataccagcatcggagatggagatgggatcgaagcggaatcgaagatgatggttgttgcggaaacagagtaaaatcggctggagtccgggtcggctacgactgggatcggctaagtctgagttagactgggttaagtgatacagccgattccgacaatacgatctgtgtacgatgtcgggttcgagttgatgtgcttcaagatgattgccatgcatggatagagtcctgggaaggcaattgtatctattaattaggatattttatgtaaattccttagagatatgtttgggcaaaagtctgccgcaaagacttatggtatcttagagtttgttagaaatagtagtcgtgtccggtatgggcatatcttgtaattttcgggtataaataggccccgagccctatgtaatttttaacacacgcacgttcaatacaatttcggcgcatcgccaccttttgctttagttttatttcgacgagttcttactttcgggttgagctgcatcggtttcgatcttcgacaagaggtaaaacttgttgtgatgatttgctttctcgggattagtgcttccatctcatgatactctaatcttgtttatgtgattcgtcaagttatcatatatcttacgtaatctctggcaataccgttatctaacctacaattggccaacatctatcgaggaaggcagccgattaggttagatgtcgatgttgatttagattatataagatatctaccaccctatgaaatatccagcggcttgattgtctagatattgttcttcttttcatacttaatgctgcatcagttgagtttgatctattaagtcgtgcttagaatcataatctctagcctgcctttggttgccgatcagggtagtatcggagtttcagccgatcttatctgatttaactatatttgttttatatgcttaattgatatgttaagtctgccctttatatcaagatcttgtcgcatctaaatacgttaagcttctacttgagtattctacttgctttaatatcttaatataaagtggtatcggagtattagccggtacatactagatctatttgatcggctatgctataaacatatatagtcttgttattaatgtatattttgatctaagtgatttatattgtctcggtgtggtgaccgatctatcccaatcacttgatttaagtatacgtcgatataaagattatatattgttaatatctacagccgatcgagtagatttagtttcttgctacttattgatgatcgccgatcgattcacatacgacatcggctcggagataaatgatatgttatcggcacctagccgatcggctatcatttatagatttgaccacggtttctttgtctttgtttcttgttgattgcaggatcaaatcaactggcacgctcatacatccgaaggcgagctttggacctgcactggagttaagcagatctcccaggcctcgtgttttctgtcaacagactgttgaatagatcaaagtggaaagtggaaccatgcttcctctccttggtgagtttgccctccttcagttctagcaagatgatggtgacaatagagtcactaactcttccaggtgctagacatcgttactacataaattgacatatgtgacagtccaacatgacccatttgagatgatcttatctctaatagctatagagatccaaagtttggatccaaatttcagtccttttccatcacatcaacctgtcatacacacacaacttttaagtcacatcatcttcaatttcaaccaaaatctaaactttggatccaactaaacacagcctaggttgaaaagtaccatgtttgagatatagctatagggaacgacctatcatagatgtgacctcacatctgtgcatgatgggtgacattgtatgaaccgtccaagatgagctctcactctaacagatctattatgagatgttacgtatgcacgggttttatctttaacctattagtcatcagagatgactcattcacttacaaacaacactaacctattatgagatgttacatacgcgctatgccgggtcttatattgaacccattagtcatcagagaagacttattcacttgtagacaacactaactcttgtaattcccgattcttttgtactctccacctcctagctactagcatcctcctctccaccttgagttgccctgcgttgacgacctcagtgctaatatagccaatgaagcagcaccccagtggcctttgcttatgctgccctacagcaggtattatactgccctgtaaattctaagttgaatatctaggaacagtattactgaatctggcagtgaaaccttcctgtgcttgtttctggtttgatgggatttggttgaagcaaacaaccatgactgctctgcttgtacaactcttgtccctctgctcagcttacttgaatgtgtactgattgtgtgcttcacccatctaactctttgaatttgcacttgagattgttttttctaggagctttctgttactgaatctgtagatgggcatctactgcatcatcgctttccatatggattgttgtgttcatgtctttcaagtttacatgactatatctcctaatcttaacatggatatgtatatcatataaaatttcaggcttcagaaatttttttgaacaaataatttcaagcatcagctatgcttcaagtcattgtatgaagtatgaaacttcagccatcatttaacagttaacattttggtgctaaacatattaactatattctttaaaagcttacaattattatgtctactactcttggtaaatattccctacctagcttctatattgtgttgctaagccacatataacattttggttgctaaacaacttctactactggatgttcttagaagacaaagaggtgcgtagagatgattttgtgcttgtggattgtaaaacgccaactgacacacatatgtatgtcctagcagacactacttctcgttcactgttatattgagtcagtatttcagatgggaagtttgtgtgccctgataaaattctgaaggtgcagtgccatgtggaccatcagaaagtagattatggcattcttgcgaatcactttgtgcgcataggatcaactttatacattatcccttcatctccaagcaaaaagatgggcacaattgagagcaggtgctattagccagctctaaacatattttaatgagataaacgatgagagagaagagaagcggactgcagatctgtagccagctgcaacacggactccaagacacaccgtgtgtatgacaggtgggaccatatattaatagtatagcaagcaactattgtataaattgactatttaattggctatagatgaattggagctagtagtgggctgtactattagacttgctctgatgatcaggctattacggtctgctttgttcgaacagaacgatctcctgtatctttcagttgatttcgtagttgaccatggtagcattgttggtctaggtgacactctgaagcatgtgtttatcctgcaaatggcgaaatggcaacacatggagacaatcctcgagttcatctctagatcgaactaggagcatcattgtttctgggttcgttagcctaggtgatacttctttcacaatgaccgatgccaagaccagtgacttcttctttccttgacttaatggatcaagaatggcgtgtcatcgggccacgagtaccctaaagcatctccaacagcctctccaattttgactctccaaatgtctatttggccaactctcaatctaatttggcaagtcaaactctttactccaacagcctctccatctatcatctccattacaagtcaatgataaatgaaacccatatgtcagcctcatcataccttcttccatctttttttccccacccatggccatactacatctcccttggcatgctgtttgggagatgtatattcattggaggatacatctacacaccatgggaaggtgaccttgctacattcaaatcagaggcacccccaatggcatgagagcacttccgaaattgtatcctgtctattcccgtctgaactctgaagttgctatgtaatgaagaaacggtgatgatacatattactgtagcactttagacatgtttaatgaaaaatttatttactctttatgtaaagaacagtaatacggacaatattcacagcttcacataatcacactagcagcaccatcatttctcttatgcctatacttaagctaaaatgtgaattttaaaacttcattttagagttgattttgtgttttttttttcaatatagtttattttacagcatttgctttcaaatcgataaggacacgtcccacaaactattttttaagttgttaataaatggttcgcataaacgtaagtataaacaaaacgatggaatcgtaaatatcgagaaaattgcatatctatcatcgtataagatgggattagctcaaataccattactcaaatgggcttcactgaaaaaacaatcctcaaccaagatatctttgctcaaataccatcccaggcgaaaatgccccttagcacttcttcttcctccctccctccttcgttgaataggttgacggtatagatggccataaggcccgcccggcacggcctagcccaggcactggctaggcacttcatgcccacgggctacacctcaggcccaggcacggcccaccagtagtcgggccgtttcgtgccggcctgagccctgaagacacgtgtggcccatcgtgccttctttaaaataagtttatttcccctccatcctttttgggttgtgacatatatatagctaaaataagtctattttacgtcccaactctttaggccatgccatataatatgtctattattcctccctattctttgtgccgtaccacacatagggttgaaataagtctgttttgcatccctgaacttcgtgccggcctagcgtgccgaggtagcagcccgggcacgacactgctgttgggccggccgggccaaatcactgggccttgggccatatggtcatctaccgtcgagggcaacgagtcagggtggggcggcaacgcgcgacggcggccagcgagtcggggcggggctaaagtgtgtgacaatgtccgagactacacgagcgacgacggtgaggcagtggagccggtggtggtcgccggtgaactattcagccactggagggagggagagaggaagaagaaaacctaaggggaatttccatccaggaaggtatttgagcaaaaacattttggttgaggatggtattctagcgtagcccatttaagtaatagtatttgagtgaatcccatcttatgcgatggtagatatgcaattttctcgtaaatatctaattagatgacaatgacagagatgcactattatagtcgtcgttgcgccaaaagcaactaactgatactacatccatcccaaaatatagtaacctagtacttcctccgttttacaatgtaagtcattctagcatttcccacattcataatctagatagatatatatgtctagattcattaacatcaatatgaatatgagaaatgctagaatgacttacattatgaaacggagggagtacattacatgatgggacatataggaataagttcacctgccgtccctcaactttacacagagtttttttgacatcccttatccacatactagaaatcttcacccctaaactatacaaaaccgtctaatttagatcccatggcagcattgatgcctagtttcgctgacgtggcatcctagtcagcacaaataaaataaaatgtggggcccacatgtcagtgagagaaaatgatgtgggccccacatctcctctttcttttcattttctcttctcttctctcgagcaagcgtggcgacagatgggggagaggcggtcagcggcggagcaggggcggtggccggcagagcgggcgcgacgggggcagagctggcccagcgggcgggcgagcgcacggagaagaagctagtcggcggccggcggagcgggctgtcgtaggctctccggaccttccattataattgagagatgaagtgaataattcaagtcatcaaacaagcataatgaaatatccgacgcctcgagagaggaatattggagatattgctaggcctttagcttgccagtcaacttcagcctgagatgtgcccgtcaaaccactcgaaggcggcgaccagatgtgttacacattcaggagacttgacaaaaatggctaaagttctacaacatctcaaatatttctaactcatactcatgtgaatctagttcccaggatgtgcactagattcacactttcatctcaagcatgattatacatagcaaacacaaataagatgaaagcatctactttagttacattggccgaccggccaaataaataatagaacagcggaagcttgtctacccaatccacaagcacaccgactaggggtttacccattatgttcaagtcctagaagaagcagtcgataacccgcatcactcaaagactaagtctaaatcctgcaagcaaaagttaattcaacagcaagagtcagtacattattagaaataatgtactggcaagcaccaagacaagcctaacaccctacttgcaaggtatataatcaaggaaggcatagtatggttctttttagcataaagcaagttttatttgcataaaacacattcaaaacggatttgctttcaaataaaatttcagcaagctagtacttagcatatgggcatcaaagtaggcattaatcatgtataaatattcacctcattgccatccatggcagcaaggagatcattctcaaatctcatcacaatttgaaggtaaatttcagcatttagcagaatgaacacagtctaaactcaatacatatccacacgccgctcatgaccgcgagcacggctaatcgattagttttaactctgcagagtttgtacactttacccacatgatgcgaaataataatcatgcaagagcatggcacgcgatacataagtacccgatttattacccgcaacaaagcttttccaaaattcatgatttagccttacaccagcacgatacgtgttcctccatcctagtcatactggaaatatgacctagaaccgttaagtggcgggcccacgccttgaacttaacgccgtggtggcggacacaacgggaacccacccacgtggcacaataccgttgtattggacagacttagtcacctaaactaccacgtcggggtaaataggaagttcctctgagttatccgaactcatacacaccggcctaccagaatgtaaggctaaaccataaataatttactaagcttgggctatcccatactagcacatgtggttgtactgtatacgaaatgaactgatattgagtgaagtccttaggtcggtttgggcgcactctccccctatcggtacacaactaatcaccatatgtgcaccacttgaggcccaaacctaaaatccatgttttccaccattttatttatcaaaatcacaagtattaaagttttgtccagattaattaaaaatcaattttcatgtttgaaatgagcccataatgacaagggagaccattctaa

SEQ ID NO: 6994 - DNA, 691 bp, Oryza sativa
aataataatctatcgggcaagataccctttggaatcaacttcaaacccttactgacccatcgatatacacaaaaatcctaggctatgtggttttccgttgaacatttcgtgcacaaattcttcacttgcatctgaagagagatattgtagacatgcgaggaccaatatctatcctactttgtgatgtctggagtggtttccgggctttgtctgtggtttggaatgttcttttccatcgagaccttaaggtatgtcattatctgctttgttatgccatacagtgtaaggttacgcagaaggtgtcctatattaatcaatttctttctagaggaaatacggcttagcatctgtgcagctgtgtttccgtaatgttaccttatgatgaagaagtatatttagctttctgttgttctgtaattggcatgtttcctttgtatattaagactaagaggaatttaaaatgctactttatcttatccaaaatcttatggctttattctggaaatactctatccggcagtattccagaaaagataggcagtttgaaacccttgtggtgttattcctccgagcatttcaaattcgttatgctttggtatgttaagtatctgaaatagggtgaggtaaccactgtaagtcaacttcagtcaattgtggatccatcagtctatagcaacaatctgcttctttg

SEQ ID NO: 6995 - DNA, 657 bp, Oryza sativa
gaagttatgctatgattgccccatatgacgtagatggtaaccgtattacgtacccttctcttgggggacgaaactacaactctactacccctgttaaatttacaaaactagcaaaaccacttaaagtcggggatacagaggtttttgtagaagatgttagtctatggaacggacaggcaccgcaagactaccaacgtagtattatcatgtggggttataaaaactcgttcggctatacttatcccgatggaacgtatagtcagctaatgcagatgaggacatatgatattggtgcagttgacaccacagctaacaagattacgttaaacaagccatgggcagttgcaaacccaaatagttcagatgggattttcccagtagggcatacacttagcccaacttctgacggctccacatatttgtatttgaatggtcacgtaaatatacaagtacctactacgtacaccaagtacagccatttgattagtggctcttctgagtttgctaatacaacgattatcccagtagaaacaggttttattcaacttggattcttggtgaaccgtgatacaacaggtgaaaaatcttggctaaatggtttacgtctacgtgactatacagatacgtataaactaaacgatgacgttagagaaacac

SEQ ID NO: 6996 - DNA, 27651 bp, Oryza sativa
  unsure (1)..(27651): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgggccaaaagcgcttggttgaagagcctagtatcacgaaagcccagaccccctctttgcttcgacttggctatggaattccaagatttccaatgcgtcttgcttttgcccccaactgctccccaccaaaagttcctaatggcctttgtcagctcatcgcacactgcatcagggattttaaaaatacacatgacgtaaaccggtatggtttgaagaacagcttttataagcacttcctttccacccgatgacagatggttttcgccccacagcagaattcgtttccaaaccttctcttgtaaactctggaaatgccctttcttcattctaccctccggtgtcggaaaccccaggtatctgtcatcgaaaccattatcaccaacttgcaaaatcgatctgatatcctgttggattgctgcaggggaagccgcaccaaacatgattgagcattcgacgggttaatcaattggccagtgcttgcggcaaagtcattcagcacttgcttgattgccacagcctgctctttcactgcttcaaaaaacagtagggtatcatcagcgaacaataagtgagagatccctggtgcccgtcggcaaacgtgaaagaggcaaaatagctccttgcctaactttttcctctagaaggagtgacagtccatcagccacaaacaggaaaagaaatggagagagaggatcgccctggcgtaaacctcttgttggagcgaatgcacttaacaaggtcccattgaatttcacagagtatctcactgtggttacacacgacattatccaactaacccaccggtgagcgaaacccatcttgtgcattgcttgctccaaaaacctccaatctaccctgttgtaagccttggacaggtccaacttgtaagcacatgcagccttgtttggattcttgttcttttgtatgaaatggaaacactcaaaagctactagagcattgtcagttataagacgctcagggacaaaagcactttgattaggcgaaaccagttcatctaggaacggtctcagcctgttaaccagacatttgcttaccactttataaatgacattacagaggctgatcggccggtagtccttcagttgggtgggctgcttaatcttcggaatcaaaacaattgctgtgtcatttatcccctccggcatcactcctatgatgaagaaattatgaactgccttgactacctcacttttaattgtgccccaatttcgttgatagaacttggccgaaaatccatcggggcccggcgctttcagcgggccgatctggaagatggcggtagagatctcctcttctgttaaatcgctgcataaagcctcattcatctgtgctgaaactttcgactggaagaaacttgacactatactgtgatccagactagggtcggcagaatacacttcctgaaaatattcagtagccagctgctccattgctgttgccgaacggtgtacagtgccagcactgtctttaagagactgaatccgattcttctttgccctccaaacagccttactatgaaagaagcgagtgttacggtcgccctcctttagccagttaatccgtgagcgctgtaaccacaacatctcttcacgataaagtagttcgttcatgtgatccgaggcttggcgaacagcagcactatctgcatatgtttccagcagctcagcaagctttttcctagctttctgtaattcacggccaatattcttgaattttaccttactccaggaatgcagagatgccatgaccttacgtagagcagcactaatatcacccaggtcagatttagtccctgcttccacccaagattcctgcacaacttctggcaaagacggctcacgttcccaacatatttcataatgcaagattttcttcctggctggctgtttcatctcctgagacagttgcaaggatatgggacagtgatctgaacggggggaggccaggtgtgcaagagtcgcattagggaaggtatcacgccatgcattgtcagcaatggcacgatcaagtctcactctaacattgtttcttccctggcgcttattatcataagtaaagggtgtgcccctgaatcccaaatcaaaaagtgcacacgactgaagaagatcccagaaagctcacatttggggctctcccctagggtgagatgaaaaatgctcaaactgccaaagagcttcattaaaatcaccaataacaagccaaggtaaattggatgaattcctcagagaccggagcatcgaccacatattgtgcctattctcaactctaggttcaccatacacaaaggtggcatgccacagagggccatccggcgacaagcgaacataagcatcaatatatctctcacacaaagcttttatttccacattaacagactcatgccagtacaaagcgagccccccactcattccatcactatcaactccagcaaaacctctaagacccaacctattccgtaaacgcctgattctatccgccttctgtctagtctcacttaggaaaacaatttgggaatcggcctctttaactaggccacacagatcgcgaactgtcgcagcgttccccaaaccacgacagttccatgataggcaactcattgctcctgacgggccctgagagcgggtcccgtcagtttaccagtagccccaggactggttgcttccaaaacttccatactttccacctccgtcttccgaaaccgtttgagagctctcgctggctcctttgggtccacctgcttagcctgttctctaccagatccttgaccatacaatactaaggcctgttgaactctgtcggatatcttgctcccgctctgtggttgcactcttttccggttggtatcactgatgtcctcggaagactctcctccaaaggatgccggttgctgcaggttctgtattgctagaatcatatcagtatcagaaacaaggttagatgttgacagctgatggcgttgttcctcctccatacccaccggttctcctttctgcaccatattctcacctgacatgttcagattgctagtctgactagctagcagttcatccaccaccccgtcccccacatcttctcttccctcaaagccatcctgagcatcgaccctgtcaggaataatctcctccctgcttttacctttcccctgtttggaggatgacgagcttgcactccctgctccacggaaggccagattgcgtgccactcctgacttttgttggccatggattgtgctcattcttctctcaaaaggcttcagcggagaacaacgtagctcagctgagtaacgaaaaggttgatcaatattggcaattcttttgtcacagtctttatcagagtgcccgatgtaaccacaaataaagtagaaaaagggcaccctctcatatcgtagctcgaaacgtcagacagcttcacttccctgcacattaattttatagcaagcgaggttttcagcggcttcttgactgataaatcaaccaggatccggaagaagtcatgcttgtttctgccatcttcaccaacatctacttccctcacatgtccaagtttgctgccatacagttctcccctcctctttgtcataagcaccaaggggaggtcataaatcctgacccagattggcacaaactcaaggggaaccatggacgggctcgtcaggccatcgaattttgcaacaagcagagcgtctccacggtgaagccatggaccgccctggagcacaaagttgtaatccccttccgagctgaaggtgatgataaacatgttatctctcagggacttgaccttcatgttagctcgcaatctccatgcacgcttcatgtcatcaaatagagccgcttgattgggtgatcgaagcgagtagaatctcgacaaaactgtccactgcccagctagttgtacttcatcatcttctagcagtacctccaccgcttcatcatcctcctcctccacatctccttctgtgtatgcacccggcccagttgagtaggtgtcgctagcccccgtcgctggcaaggtcttgggattagcgtggatcatcttatctttactctgactcgctgactccaaagcctgcttatttggggccaagatgatctccttggccgtagtagacgtctcttgatgggagagcatcgcgtcgaccaggggcttcgggtgggtgaccatcccagtgacgatccctttatcacccccaccgctagaagacgccatgacccgaaagagacgacaaagaaaccggagccctaattcgtcagattagatgcagaagcagcaattgttggttgtgcttgacagatctgacccagggttgtttatataagggccggagaccaagaacgaatccagaacgaatacggcacccggaccagatcgtgacgtttccttcttcacaatccatctccatatccaaaggcaaagatctcctggtatgttacgattgggaactaagaaattctagggaaaggactgaaccttgcaaccaggccggacacaccattgatgataagaatatgaatccgatctcagatcaaaacccctcaaacaatctgattggaagccggacgacgaatcctcaaagcaggcgataaccctgcagacaacacacgtggatcgaagacgagctccatccagaaacatctcacgacgagacttacggccgccgccgcaaaatcgcctgagtgccgccaaaaccctaacataatgcatgtgtcagtaattaactctcaatcacccacatcttcgtgacacatgaatgggcaaatcctagcgattcatgaaattcaggtatttaatccagtccctgaattgtaacagtcgaattaaatatactcttgtggagattatagataccacgtacccccatagcatgtatatccaactggttataggggatagcctatacagatataatatgtttaggaaaggactcgggtatttttgttaacttgtatattaaggaaatatcccgtaatcttagtcagttacttagcctagtcgttcgtaaggcatatgggctgtacattgtaatttcggttcctgcccctatataaggagggggttcaagtgctcgtagggcataatttttctctcagatcgttagatcaataatacagtcggtagaataattcctaggatttatgcgggtaaacctctcagattatgcggattcgtttgctggtccagtactggaggaggtgtgctgtactggcctgtcagcttgtcagtctcgctgctgtgaagtgtgaagctgccgtttttttgttcggcgtagtgaatgtttaccgctcgaaagttgaaacgggacttgtttagattccaaaaaatttttagccaaaaacgacacatcaaatatttggacacatgcatgaaacattaaacgtgaaaaaaaaataattacacagcttgcatgaaaattgcgacacaaatcttttgagcctaattacgctatgatttaacaatgtgatgctacagtaaacatttgctaatgacggattaattaggcttaataaatttgtctcgcagtttacaggtgaaatctgtaatttattttgttattaatctacgtttaatactttaaatgtgtgtccgtatactttaaaaactttacacctaaagaactaaacacacccatggttcatttttattatagcccgaataatgagaaaattcgatacctacatccctgatgtagattttattttggtttttgttagcacgtctttcaaactactaaatagtgtgtttttaaaagatttctatacggaaattaatttaaaatattaactaaatctattttttcaagtttataataattaaaacttaattaacaatatgttaacggatttctcgttttgcatgcgttaacttcaactttatctcagacaccacctgatagagtcccgtttgggagagataaaattgatggatctatggataatttgattttgtgatagttatttgtgggtataaacaagtgaaaaaaaactattacaaagtgaaaaggttattttagaaaagtagtctacgaaactttttttaagaaagttgttgtgtgaaatgtatcgtttatgagattgggaaacatgcaaataaaaatccagcatcaaaaaagaacaaagtcttaaatcagatgaattaaatattatatattattaacctaatagatagcttgaaataaaatgtctatcgagaattggtatgtgcaataaaatttctgaggaattgaattgtacttttaaagttggcattaataatccgtacctaatttttcggcattagtaaaaaagaatggggctgtaatgggaatgtcttaattttaaaaaaactagaactatgttatttgaatggagatgaaatctcgattatgtactatgtcatgtactttcatgtgtgatttttctacagaattcattcattttaaatatatagcgcctaataagaataaaaagtttgtgaaatttcttcttaccgtggtttaaaaatataattaaggtgtttttctttactagtgaaatggcgcatgaccattatcaactggaacaatttcagtttctatgtttgctctagtgacacgctggcgcgtattatagtaccggagtgcaagaaaagctgtctacaacatatatcatctaatgagaaactattaagagcagcggaaggggcgcccgctcggctatgccacgttggatagaaacggtgcgtggggtggtttttttgcgaaaagatccttctatgtttccgtaattcgatctaggtccctcgcaaatagtacatatgagacaattttttatgtctagtaatattagtatgagctgtcataggactcattaaaaagctcgtaactctgtggatttttcaaaagatgacagacagaatgaaacatcagggtttatcagcaattatcatgaaataatcaaataatacttgcactttaatatgaaacatatttaaatatatattaaatattataaaaatgatagatagatttgttcaaatattgtgcaaatgatgtgagggatgataattggatatgcttgtatgttaatttgtagaattaaataaattgtagatgatgtcgcatgcttgtatgaggttatatgtattattattagtgggtgatgatgtgacatggttatatattgagctttagatttagtggactataactttataactttatagtaagtatagatatgtcacttaattcattttatgcatgtctctgaatttttcctaccttacatccctgagagtctgataaataatgggttaagttcggtttaacctcctcacctatcataaaactataaattaccctccttaacttttataccatatattttacacctcctaactatttaatccagataaattacatcctcttttgtggttttaagctgatgtggtggcccagttagggcaagtactataagcccttaaacacttgcccctagatgacatgtagactcatttgctgatgtggaaaagagaaggaagaagagagtgaaggagccacctctggataatctctacacaaaattcaataaaaatgtgatagtactaaagttatggcaaaatttgctacaggacacccaaagtttgtggcatttgttgtgagacacccaaagaacgtgtatcttttcatggacactgcaaaaatgaggtaattagctgctggacacccaccttattattttattattcttggtggaaacggagagagaaagagcattgaaagtaccaaaatgccccagtacactattcttcttcctacttctcttcctttttctttattctcctcttttcttctcccacagggctctgctccgccatgggcgcgttgttgaggcggatgacgaggtcgtgccatcgatctgcgggccacggctggagccgaggagcacatgcgttgttctcgaccacagcgagtcctctccccatgcggcggaaaaacaaccgtggtgagggttagctgtcgggtcccgaaactaatgattcggtaaccgacatgtttaggctgaatcaagccctggatcagtagattgatataggttcaacaatctggttcttcattgcatatattttgacaaggctccaaaggagattcctttacataaaataatagggtatttacaaacttgtggctaactattacagcagaagctatacgatgactcaactctagtgttttgctatagacttaaaccatctatctaatctatacttgagaactaagttaaaatgagattaacttatatgattgaactcccagcttcggtaagaactctaaaatgactctgaaaaaggtggggttaaagcaagggtgagtacaacgtactcagcaagctattatattaatcaacaacgaatgcatgaaataataatatttgagtagggttagatttacttgcagaaagcagagaatatagaaggaaagtctataatgttttaaatgcaacagtatttaataaagtttgaaattatgtttgtaaccaagatgccattgtgagtcccaatgcccgataaccgcgaccacggctattcaaatagttttaataatattcatactacagtagatgtacgctttacccgcaatccatgacgtgccaaacacattagccttgtcatggcaaagcttttcggtcactaacatcagtggtacttgttccatgaactctagtccccatgcgctctgaacgtaacgttatcagcagcgagaggagttctagcgttcccgaggcctttagagagaactgattgtatgacaccatgtcatcgcaatcagggtttacaaacagttcgtgatatcacaattcatctcatatatttacctgcgcctcggtaaatatcacaatcgcccttcgcggcgtaaatttgcctcctgcgcgaggacttaaataagaaccactacacagaggtaccacctttgctagataacttaatcagctaggtctatgcccatacgagaattgcggtcgtactcgtatgttcttcacatgtactttggcaatcttatgtcggttggaacagtactagccacccggaaatcaaccatttctaccatactatcccaatctaagttcattaaattttgtgcataatctaactaggcagggctaagcaaaagctagcatatctggtttgctatatgttcaggttatgcattcaaaatcatgaatgactaatgcatagaaaagggatatagaatatagggtaattatgctcaaggggaggaataataacttgccttgctccaacgcaaataaatccgaaataggcaacctgattatctgatgcttgaaataccacaggttgccatccatataaaatagactctactgaagaagaggaagatccaaattcaataaaagccataaaatagcaagaaagagataaacggttaggaggactagggtttagggtatagcttatctcttttatgcaggtatatggattactgggctgatattttatatgtggattctaaagagttggtggctggggtagagagggaattaagcggctaaggtcacctatattttatgtgcagactctgattggttggtggatagggagtatagtggataattgaactggttgagcagatatgtgactggtattggctgatagtgggtttgggtaggattatacctagggttcggttatatttaggccgattgaggagtagggcagtatatcggccaggttctatattttatgtataggttctgggtagatggagagtaggtggctaagatatggtggataagtaatattgtagttgatgtgggatttggatggcaggctgattaaggtttcagttgtctaagccgatatcgaggtaagataaatattggctagggtttgggtgttcgctagtcgtagctaaagcatgacgactaggtttggtatcttctctagccggtgtcgatagacaatataacggccagagggatgggaggtttgtgcaggtctagcgaggcggaagtgttactccgacaaccgtgagtggcggcggagcggctaggatcacacagagctcaagagctaactgtacggcgtgctgtggaggtcgagggaatagtgaagctccgaccattgtacgcatcaaggcgtgggatgccgggagcagcacttcgaccttgggtttggttttgccgggatttacaaccaacggttcgacgttggggccaatagaccgcaaacgtccccatggaaggcataaagttccaaccggcggctttttagtggctaaagggtattttggggtaaaagaaaatatttgaaaaaggcaaatataaattcaaatgatatttgaataaattcaaataaaattataaaataacaaattaggcatcaaaatgaagcatttgaatttagatgaatttaggtctaggttttactgagatcggatctacggtttaggagatatgggcttctaaatattggaatttgaattaaatagagtaaattgcgaaagtatactgttcatgggcccacctgtcagggattcctttttctttttctttttctcctcttcttcttcttcttcccgtctctttcttctttttctcctcggtcgaacagagaggaggaggagagggggcgccgggctccggtggcgaggaggcggtgacgccggcggccagtggtgttcccgactgcaaggcacctagggatggcagtggccggaaaagggagtaagggaaatagccggaacggcggatggaaggtcgtgaaccgggaggagagagagagctccggtgaggtttgattcagaggtggaggaagaggggaaaggggaaaaatggattcctctcatcgaggcaagctcgatggcgcgagggattggccggtattgctccggtgagggagatcggccgacgacagtgatagccggccatggcaaggagagagaaaagagaggagagcttcaagctcggtttgtgggggataaacagaaggggttcatcctcttatataggcgatgagaggcggttcgaagaggaggaagacaagggagaatcggcgacggcgatggcgtgggaagaaggatgacggcgccgacttgattccttagcggcgacggttgcggcggcgtgcgccgcacgcgcactgggaggagggaggcggttgggttgtgggccgaactgggccggctcggcttagctgggccggcagcccaagaggaaggaggaaaatagaaagaaaaaggattgggccaaaaggaagaaagaacggagtttcggcccgatgacaaaaagaaagaagtctaatttgtatacttgatttggataactaggttttgcgaagaatttgaattaggagagaattcacaaaggagattttctaatttatttgagtgcaatatttagaggtggagtttgagggaatttatttggaagcactcaaatagaaaagtaaattaatagtattcctcaaaatattttttggaatgtggtaggaaaatatgtggaggcaaaaggataggatttgaaccctaaaatatatggcatgggtttcaaggaattgtttgaggctaaaaggaaatttaggtgacaaggatataaatttattttcttagcacaagagcaattattcacaatatttgtaataatatttttcttgtaccgagaaggaaatcaagccacgggaattaaattagcggctagatcaaaaggaagaatttagatatttggcgataaataagaataggcttggaatcaaaggataggtttaaaatcaaatgatgggtcgacaattaaatccaataaaattggaatcatttggtttaggttctaggacaatagtggagaatttcttggaccacaattcataataataaaaaggggttttcaaactaaatttgaataaaaaaaatttaatcaaaagaaggttttaaaccaaatcaagaaacacctcaatttaaccaaatatatatttttaaatgaaaaacacaaaagagattaaataccagagaggttttgtgcgagttagttctaggaggtccctctaattatattatcctaggtttaggaagttattaagaacataataatcggcatgatgcaggattagaaaatgacgcattttcaggatgttgcattagcatagtaagatttgggaaccctgagaagtccgagggcagccgggaggtggcagctcctgagctccaatttggtgagctcgcggcatgagaaaatggcggtgtaaagcgtgtggaagaggaaattgttgaacttcgagaagattagggtcagggttcgacgccccttccggcgaggaggatgagccactcgtccgtgtgggcggagccatccctctcgatctacccatggcaaaaatggtggacggggcacgtataccgcgcgaggatttggctgacggtggtggcgcccacttcgctgttgcccgatttgaaacggagccccggggaggactcctagcggtaggggtggatgtcgagctggctcggctcggcttggtctggctcgttaggataacgagctagctcggctcggctcgttatcctaacgagctagaaacctagctcggctcggcttgtctgcaagatcgagctagctgatttagctcgtgagctatgggggcaagcaagaagggaggcgaccatggggatgagctcgctggcaaccacggggagaaccggaggagcttgacggtggatggaacgagctcgacctcactggtactgcaaccatagggaggagcttgacagtggaggaaacaagctcgagctcgccggtgaccacggagaggagcacgacggtgaaggggacgagcttgacctccgccggcacttggaccacaaggaggagcactatggcggaggagaagagctcgagctcaccgacaccatagggaggagctcatgttcactgccgggcggcgccgcaggtgggtgggttggtaggtggcggcggcgtcaggcgctgcaggagaacgctgggggagagcggcgacgtcgggcgctgggggagaggcaaagagcggtggcatcgggtgtgggggaactcagccaccagccgcaagggaacaggggagggataagggaatgacctagggttttcacttttagtgctcactattgtctattgggccttctaaataaatgggcctatgggctttgtggcctggcagcctgatgaggtatgggcttgttaaggctcgtgagcagctcgtgagctagctcgagctggctcgttatctctaacgagctaaaatgccagctcggcttgttagaaaaatgaaacgagtcgagccgagcttgtcgcgagtcgaacgagctaacgagccacgagcttttcgtccacccctacctagtggcggcgcgccgccccgtgctctagcccagccagctgttgcacgtgctatatagctgccacaacacgcgcatgagaaagaaggtagccacataagaagatgaccaaagaaagagagattgagaagtgggtccctgggcaaacttgtctttaaccaatgtttctctctccgtttccaccaaaaataataaaataatgagacatatatccagcagctaattaccatatttttgcaatgtccacgagaagatacacgttctttgggtgtctcatgataaatgctacatactttgagtgtcctgtagcaagttattgggttttgtgtattggaggtaacttttattgtatagattacctcttaattatagattggtgatagagatgaaattagaggtaacaacaacctatattataaaacttgcccttagaaacaaatcgtaagaccaatttgtcagcttctttctctcgaaatcgacgctgtgtgcgcataaaagtgttctacatatatatgttgcataattaatacaggttttagggaagtaaggtagctagtctttgcgtaagcatccatcaacaaatagttaattaaggccactatcttgtacgagtagtaaactgctctcaagtctgaatagtcggaagcaacaccttgtgagttatttgatcaggttgactcagctcacaggcaaaacgacttaggcccttttgtttaggcttaaacttattgacttagactttcaagtcagtttattggcttatatgatttataagccggtagatttaatgtcctaaatttagtagttgagtcatacatctacctcacataagccaaaaaagcttctctaacctagcttttggcttaatagtgttagagtggcttacagcttcaaaaaagacaaatgaaaaagctgcttgtttgtttaggcttaaacttttcgatttataagttggcttataagcctaaacaaggagggccttaatcctgcccttacaccattgcatctttgcatgcatgccggctagattttagcatgagagtaggcgcgccacacactattggtttttatgctgtgcagcaccagcttcaggatgagatgcgaaacggcggtggcggcttcgtgaattttcaaccgtaaatttagagtcgattttaaggtatttttatcgtagtttattttttttcatttgtttttaaatcgttattaagaacacgtatataaaagttatattcacaaattatttttcattcgataaatatgttgttttgctttttactccaatataccaaatgatggggctggatggcccgtgtgtagctagttttggagttttttttttctttaagaacttagagtgtgtttggataatggaaaatagagggtgggattgggattgggaaatgaatgaagggttaggattaaatgaaagagggagaatgaatggttagtatttaaagatgccttttggtgggtgggaaatcatttccatttcccattagccaaacattgccttagagttggaggtggttggtgaggtttgctttgcacgatcgagtgaggagggtagatgcacgaggaaggaggtgactagtctcacatttggttttggctttgcacatacatatgagagccaaaaccacctaatagctagaaaaggggtaatttgttcgaattaaataattatgtggtgtaaaatgtataatataaaagttaaaaggataatttaaacttttgaatagttaagaagataaatcggatttaacccataaataatatactaccgataaaggtagtactatctctgtttcaagttttcttactagcaatgctcatatttacttacatagatgtataacctaaactgaggaagtagtaaaaaaagaagaatggcatcaacaatttacagcaaggacagaacgaataaagatcgaatttttatcaccaagagaggtgacgaagaagcaagcaaagaaagttgtcatcatcccaatcctcctccgccatcccatccatgatccatcatcccaatccaacgggagctcagcttttgttctcgatccgcgaattccccgtgggaccgatggcgacgggattcgtcgtcgtcgtcgccatgtgtcagctcgctggcgtccggatcacccaagtgtgcgggtgggtggccgccacacgctcgccgcgtgctcgccttcttcccccaccttttccactttccaccctcccctccctctcggtcttcgtctccctcccctctccttcctccttcttacaaatctgcagctcaagctggtgttggtggtgttggtggtggtaggcggcggcgtcgccttctcctcctcttcttgctgaccccgcctgactggcttccttccccttccacacctgccggatcgggtggctgggttggttgagggtccaagaaagaaagattttgggggttcgggggtgaacccccctccccatgccccaagtgaggtcagcccccctcctggttaactaatcatgctggcttcttgttcttgatgtgggggaaaagaaagagaagaaaacggtttcttggtgggattatgtgcagatctttagtactactgtttcttgcaagaagaattgggctaaactagctttgtctcctagtacacatggttagttcttgtgtatttgtagtttggtttcttgtgtaggtataaaaaagtgtagcttctggtgatttctgtgttatcattgttgggttttttgaatggactgagcctgatcttctaatagtttgatgatgtttggaggaggaggagttgttttcgatttggttttgagccttgtttcttttggtgctccagtagacctttgtgtgatgcaggaaccagaatctgggcatggtggctgacacggagagctcggggtcactgggtggcagctcaaatgctgcttctgacaaggctgttgatgggttcgttgttaactgtttactttctttttatccaattcccatttattaagcttcataacaataaccaatgtctttttattgctatggacaattaggctattgtcgtcgcgttagacacttttaggttgtatttatgctctaattttggctaacgtgcttacattctcatttctaatatcctgccgaatctgaatgtatttatcaccacattttctgtactacttgttttgggctattgttgtggaacaatgataacgactgtgtttagttcctgaaattggggagaagtttggggaaagttggtagtttgaaaaaaaagttaggagtttatgtgtgtagaaagttttggatgtgatgtgatggaaagttgggagttggggggaagtttgatgtgaactaaacagggccaacatctacccgtcaatcataatatctctctcttttttttatctccatggtttggttcccacattgaaactagctgtaatttgtaaatatccattgcaaaagtgcatgaaagcgtaatttggccagtagttcaagcacaagaaacttgccttcatcatgatcaaccaactgaggaaaaagctacacataaagaaaatgttactgaatttttacaaacacagatgtggcacactatgattgaatcttgattttctataacttccaagaattttgttggtaagatttttttttagtatgtatagcactgctcatcatctatttcgtcttagttctccttttcatgcatatattcttttgctaaccatagctccgtatgcttgagacttgttctctgaagtcactttgaaagagaaaggttatatacaatgcacaaatggacaaatccaagacgatagagtttcctttattagaaacatagttgacaagaaaccttcttgagatagagactgtttaggaattatgacaagagtaaccactaaacacaggatcgtgcagttgggtccattctcctttaccctgtgatcctgtcatatgacgggggagtgagctcactatggatgatagatttgaagttatttatctgttatatgtgctgtaatgattttcgcataaagagtagatattaaaaattattgcccatagtaagttgctgacagagtagcaataatattaaatattcaaaacatcaattcagttgacaattggtatcatttaaggagcttacgttacatgatatttgataatcaaaatatgtatgatgcttagtttcatattcagatatccaccatgattcagaattgcttcgccttttaagtttatcagtgagttaaaattgacctatgtttacatgtgcactttcagattattctgaatcttgttgctgttcatgctttccgcacatttatttcccatagcagtgcaattcctaccatgatgtacttctatttccgtgatgcttatttttgttctgtgcaggtctcttgacaaaagatctcaggaaaaggctccaaagaaaactcataaagctgaacgagagaaacttaagcgtgaccagttgaatgacctttttgttgagctcagcagtatgcttggttagcacagtcccatcatcatcaatcaatgtcatatctttatagtagatatactatgctctttcgagaaaataaatattagtaccagcaacttgcattctattacttgaatccatctttcctttaattacttaatgatatgtaactgagtgtacattgcggagaatacgaagtcaacttaaattaggttgtgttttagcaggtcgcaggtacctgatgtaagtatgtgcgtattgtttagagtatgaaattaggaatacaacacctaagtggacatacgttagttcctgaattcaattatttgctattgtcccatagttatatgttgtctctatctattttggagtttgcagtgttagactgtgccattcctatcctgccattctatgatcccaaaaagaatgggtcctacactgttcaatttgctaaaatatccccatgtgaagttctggctttcctgctttattcgaagcccccttttgagtggtccatctgagaacaaaatttcaagagaatcttgtttggtccctacaaaagattgatgcaatgctattttttagtgtgaatctgaaatccaagattgctatttatttgcattatctttgctttaaactgcatagatctaattaaccctatctttgaacggccacttactgttcaagtacacaatgcgaataaaccatgaatttatccataattttgtgtttattgctcattggcatcttccatgctaacttcatctgatatggagtaatgacaattcggtagcagcctgctcatgaatgaagatgctaatttgtcaaaacagcacaatgttaacctttgctacatttattgtactccataattagaaatatatgcagagctgatatggtgcacatgtaataaaatattagaatttaaataattcttgctgatctaggacataattgtgcaaattgataaacagttagaaaaagttgtctgctgattggtgcatataaattttagtgcgttgcactgaactttcttcacatgatgaattatttggagaaccttaccttgaccaaacagttttttgtgtttactgctcttagttttacttcaaatatcaaattcatataccttttctgatcattgtacttctgctattacagatcctgaacgacaaaatagtggaaaggctactgtgttaggtgatgctgcacgagttctgcgggatcttgtttctcaagtagaatctctcagaaaggaacagtccgctcttctaactgagcgtcaatacgtgagttgttttaatgaaattggtgtgttttataagtagaacctaagttgcatatagtaatgtagttttcctgtaacagtcacacataggtgtacttgcagttgaaatgccttcatggaaactgcaaatatgtagttagcagacattactttcttatcaccttttcctctcatatttccagtgggttaattcaactgtttgcttgatttattacttgccgatagttgtttaggtactattcatcattgcctttgcagctaatactaaaatgaacatattaacaggttggttcagagaataatgagctgcaagaagagaatatcatgctcagagcccaaatattagaactgcataatgagatttgtgcaaggatgggaaacaaccacctcaatcaaagcaatcttgcgatgtcacaaccagtagccaacaatggcagtaactcagcaactcaacccgttccacatcacatatggggcaatggtccgaatttagctatggtgcacccaacaaacacattatctccgttgcacaatcagcaccatcagtctgctggtgccagccaggtttatgcgtcacggcctcaggagctgcagctctttccagggacctcagtatcaacagagcgagaacgatcccgagctggaagtggaagcaccccggctacttcttcaggcctgacggattctttgccagggcagcttcgcctcagcctcccgcaatcttctcaagaagaaaacagcagcggcagcaagaaaggtcgaaaaaagggctagccggccagttgacacttgacagttgctaaaaaagaatcgataaatcgatacttggtgaatggtgatagttacacactcctgtaaatactgcgaagcgcttactgatacctactgtgatagttgccctctgttgtaatttgtatttgtagtgcttgctctgaaacttagatcacgtttgactatagttttccacttccagtccttttacggatatatgttgccatattacagagttgtttaccaggaagagagaaaaatgatgcaattcgatagcagtgttaactgatgataattatatgatccctgtcaccaagtcatgaaaatctgatcttgtatgttcatgggcagcttgtttcagcattacaagttgaagaaatatttgtaatctgttgcaaactgcatgtttatggctatgagaaatgatcaacaagcacagctgaaaccatgagacatgcaaagtatatgcttcttgaatctatggaaatgctaagtcctgctaccgaacatcatattgttcatcctaagacaatcatcaaatcgaaagaacacaactcctgatctcccctatcacactgaaaagaattgaactccccaacaactgaaaataatcacacatgatcagcacctcttactcctctgaacccttctcttctgaagaacttgctgtactctcctcctcctcctcggagctcctctcttgtgaagagctccccgccttcttcttcatcttctccggctctggctccggctccgagctcttgtcgtcggcggtccagtaccgcttgacggcgtagagcaccttctccggtatgtgggggctgtcctcgtggttcgccatgatcatcttccaccgcatcccgctcgcgatcctctgaaccttgaggaggacctcaatgtcgtcccggaggatcaccgtgccctccggccgcaggatccgatccatctccagcaggatgtcctccatcttgcaccttctctcacacattaaaaccaacaaattgtttaggcacagaacatcatcaaacagcaagaattcataatttctcatcacttcagagatcactcaacagagcatagcagcatgattagcatatacttcctccagtgataaataagtatatcattttggacattaacatggttacaagacactagttgaattgttaattattatcataaaaatgtatgaaggttatattattttgaaagtaattttgtagaaaaatacaatcatagcattttcagaactgaaccaaaaaaatttcaaagagatattgatagtcaaagtttaaatgcattgactacatgtatttcaaaaccttacttatttcttactgaggaagcaatcaagaaacagatatgaacagaatgtgagtgagactcacttgtccttgtagagagtgaagacaccattgccatgtatgaggtcatatgttcttgggtaagtggagaatgcctcacacctgaaggagaagaaggtgaaaaataatcaatagaaaaatatttacatattcttggataatacaccctttgtttttttaatgtatgtcacaattgacttttgatatgacgattgaccattcatcttataaaaaaacaatataaatgttatttattttcttgtgacatgtcttttataatcaaagaaactatatgtaatcttaacttatacttttatatatttatactattttttaataagataaatgatcaaacgttacgtgaaaagtaatcaacgttatacagagagaaacaagaggtagtaatattcaggtcatggaaagcaataaatggaaatgcaggttgaatttaccagtcatggaagatgccgatgaggcccctctcgtagacgacgccaagggtggagagctcggcggcggtggggacgacgttcatgacccacgacttgggcgagaagacggcggcggcgaacccgccgacgccggcattcatatccatgatgttccggtaccggccggcgtcgagccggtagttcaccttcctgtacgccgccacatgcctctcccaccgcgcgttctcctccgcgtacgactcgccggtgagccccggcacctcgccggcggccaccctcggtggcaccgccgtcagcctctccgggaacggccgcagcatcacctcgccggccgcttggggcggcgtgatgcacggctccatcttcttgtaccagacgtcgtcggggctggcgacggcggcgtcgcacgtcctcggcggcgccggcgtggccgtggggcaagacacaacagcggcgtcggggcgcttgcgccacacggcggcctcgcccatctcggcgagtttctcccagcacagcatcgcggcgtactcctcgatcagctgctgctcggcagcgaggtccgcctccgtgcgctcccacgccttgtggttggtccgccagttgatcggcgggccggagagcacccagtagccatccgcccggagcacccggtcgatctccatcatgtacatcccacctgcgcgcgcgagccggcgacatgtgcatcaaagttcatgctcgcttgctacatactccctccatctcaaaaaaaaaaaaatctaggactggatgtgacatattttagtactacaaatctggacatggatatgtctagattcatagtactagaatgtgtcacattggtttttatgggacggagggagcagcatatactccgtccatttaaaaatgtatgacgattcaccatttagttttcatataacgtttgactattcgtcttattaaaaaaatataactataatttaatttattttgttctgacttgttttaccactaaagaaactatagtcttaacttatacttgtgcatatatatactaaatttttaaattcgtcgaatgatcgaacatcatatgaaaagttaatggtgtctcacattttgaaattgaggtagtcagtggcgcaactatgggggtgccagaggaggtcaacacccccctatacgaacaccgccaccatcacgcctcctgtttttactctatattgaggctaactaagatatgtatttatctagtttatttgtgtagcttacaattattatcaatttagttagttagaaagtctaaaaacattagcaagaaacatgatctacaaaattactttgtgatttctcatctttttaaagtaaaatagaagattcttatttgtgagattattcattagtttacattaaaaggatttagtaataaagtctagttccaaacttttaatgatattattaaaaagctaaaatttaagttttttttaaagaactattttacacattgattgttattaacggtgactatttgacatcatttgctatcgatattggttattcggtcttatggcctcttccccaccccacaccccctaatcttaaattttggagttgcccccagaggtagtatatgtgtgcattgggagtcgtgttcggcggcggtggcggtgagggtagggcttaccgttggcggaccaggggatgaggcagcgggagcagtgcgccatgtcgaaggagcggggagggaaggggagcttgatggagccgaggacgccgatgaacgccgggacgccgcgctccagcgcgaactgcacctgcgcctcgtgcgagtcccgcggcgcgaacgacatggcgatcacccccctcgcgtccaggtacgcgcccaggctcgccacctgaacacgccacgcacggacgaacacctccatgagcgagcgagcgagctatggtggaatgaatcaatggcggcgcgcgtggtcggcgatgatgtcgcttacgccgcagccggtgtcgaggacggtgcggacggagccgtcggcgaaggggacgacggtggcgagctggtcgatgtacttgtcggcgccgccggggaactgggtgccgccgccggggaagcggaggaggcggccctcgtgtcgcacccagttctgcaccgccttctccacggtgaggctcttgtacggcgcgttcgcgaacggcacgtagtcgcggctccgcggccacgggaacggcgtcacgtaccccggcggcgccggcaccaggcaccgcagccgctcgccgtcgccggggcagtgccgctcccggtacaccatgttctccctcgggaacctcatcgcgcgctcctggtcgtggcacggcgtgtggtccgccatcgccgccgcgcacgccgcgaactccggcgccggcgccgccatggtctcgttctccacgccggcgccgccgtggtgcgtctcgaagctcagccccacgccgccgcaggccgccgtctgccggttcacggccatggcgatgctgtcgcccttgccgtagccgctgcgctgccacgcgccgagcaggtagaagaagcagcagaggccgacggcgaccaccatggcgagcgggctccgccccctgttctccgccgacccgccgccgcccttgatcgccatggatccacctcaaacctgcaacacacaacatcaagaaacgcaatcaacggcaacgaattcgatcaaatgcaagtgcacaaatcacagtggcgacgcacggaaccttgattaattatgatccaactataataagaatagtggttgattattgcgtctgattgatttcaagaattggtcaagaaagatgaggaattggagggggatttggttggtgctgagagcgcagagcaaccgcaggagaaagaagcggatcttggattcacgaacagagaagaggagtctatggaaaaaaaggggagtgtttgctcgataaaattaagcttgaaaaatgcaaatgttttgaaatccgatttatggaaaaataatctgagtggtaaaaaacgaaccattttttaccctttttttaaaaaagtttttatatttttttagaactattttgatggtttagttatctacaaagtgtttcaactattttgctttatgcagtttagtgtgtcatagatatttagttaaactagttggaagacatcaaaagtctcataacacatttggaccaaatccaacggataaaaattggacttcttctgcccggaaattatgtgatatatcatatatgtatagcaaacaaactatgttagattgtttatttattgtgggattgtctatgtcctatttagaggctgtgatgcaagggcagaaaacatgtggatatatcatatatgtatagcaaacaaactattttagattgtttatttattgtgggattgtctatgtcctatttagaggatgtcatgcaattagttatgaaaaaagattaaaacttttgattaaaacggggaacttacaaacatgcaaattcaaattcaacacctattatagagtatagaaaacaacaaattaaattctaactaatggaaggaactaaagttgtttccttcaaaactattgtcttcttaatttcagcttccaccaacatgtcacttgcatgctcaagatcatgtttcatcgacttcgtacacctcgttccctaaaaaatcaggactattaatctcagttagagttatacattaacaaccaaccaatttcgatagtaatgactcatctatgcaattaggtttatatttatacggctcttctatagtttgtccaagaacaacatgcatgtttttggcgtgtattaattgtgaaaaataacatgatggcatgacatttctcacattagagaaatgtcaccaacaagtcgttaagtttgattgaacggcttgtttgcacgacacaaacgtaggggcagggatgcaggccagccggcggcgatctcctcgattccttgtcaccatatccagtccatatcgacatggcatgcatatgattaaatgaaaatgctatgcgtacgttttttatgtacgatatcgatcctcgtataagattgctaacggatggtgaacgacatgtgttgcatcgctaggaaacaacagaaaaacgtgacaggctttcacgtttatatagccaatcaatgaaaattacggggcagatgttttactttttttcttagaatttctaggattttctctaatttattagagcgccatgtgataacttgagagcgtttgcaggaagtttaataggcttttagtatataatagatagatagactagttgaaatacatcaaagccttatcacacatttggactgaatcactgaatccaatggataaaaattggactacttctgcccgggaaataagtggatatatcataaatgtatggcaaacaaaactacttgattgattatcttgggcttgtctatttcctactaagagaatgccatgcaataagttatgaaaaaaaaaattaaaacttttgatcaaaacgtggtaccctacaaacatgcaagctcaaatttaaaaactataggttgtaaaaaagaacaaattaaattctaactaattaagcgtgtattaatggtgcaacttatgggtgtgtagtactcctctgtccaatataaaacaaatcagtaccggatgtgacatatcctattactgcgaatttaagacaaacatatgtccacggagggagcatgtagtgtaggtgcttatttccatataatagaacaaaaaagtgattaagcatcaacaaaaatggataagatgcaaatccttcaatatatttaattatctacccaataatgcctccaatctaaaacgtctagagggagaaatatgtaaaataccatgaacaaaatgccaaatgtatacaatttccattaagattatacataataattcgtatagagtttttattaagattatacataataaatcttcgtaatttttccgaacttcttggtgttatattacctcactttatccaatttgagtgactctagatactattgagaatattttgttttatgatgcaaccatgggatagtattttgaagtaatgctcataaggaaataaagttgttgctttgaatccaatagtgccttcataatttcagctcctgctaacatctcactcgtcactcgctctaataatagttcaacttctcaagataaataatatcaggtttagactatgatggtcagatcgtgtttcatcaacctaatataccttgatccctaaaaaaaatcagaaaaagacctttattactataatatcagtcagagttcaacattaacaatcaatcaatttcgatggtaatgcctcatctctccaattggatcaacaaatttagcaacataggtttatatttatacggcttttctttctatagtttgtccaagaacaacatgcatggttttggcgtgtattaattgtgaaaaataacatgatggcatgacatttctcacattaaagaaatgtcaccaacaagtcgttaagtttgattgaacggcttgttttgcacgatacaaacgtaggtgcagggatgcaggccggccggtggcaatctcctcgattcttcgtcaccgtatccggtccatgatcgacatggcatgcacatgattaaacgaaaatgctatgcatacgatttctaacaaatagtgaacgtttttgtgttgcatcgctaggaaacagcagaaaaa

SEQ ID NO: 6997 - DNA, 4641 bp, Oryza sativa
gttttctattcattatctaaaaaaaatatagccaatcaattttacatgatgaaaatagatgaacatgcatgtatgggaaagaaacatttttccacacgttgctcaacggatgctcatgcgtgtatggcgcaagcatacaagttcatccaatgtgaacatcctagctgcgctcacactaccagctattatttagttaaaaacacatcatttgtgttaaactttctctacttgagcacataagtcatcaaccatgcatgatacaaaaatatttctgtcacactttacacattcacatctatattttttttaaaagatgtttagtttctcaatatgttgcattggtgccccaagcccccgaattttttaaatttttaattttatttattaaaatatttacaaattttttttcaaagttttacaaatctacacccctgacgcctcagagatggtgtttttttatgacgtgacacatgtacattgggcgttaggggtgtagatttataaaactttgaaacaaaactatttgtttaaatattttaataaataaaataaaaaaacccaagcccccaatccgaccggactggcttgcgtgggctgtatttgtataacgggcctaatggcctttccttgacgagacttcagaaggcccagacctaagctctttctgggctgtcttgggcccgattgtgaggaatatatcgagtagcagaacgtattggacgatttgttttcgatgttattcacctcccgcgtttgcattaccattcctacacgagaaatggattagattgagcagtttagtggctattattttgtttcgttgcagtcattaatagaaaaaaattcttctccaatattaataagaaaaaaaaacgttctccttcactatattcgctcaaagcaaggtgcctaagtttcatgaaactgtttgtcagtataggatgctacaatgtgcgaagtaagagagggtattctcagccgtccgatttatagcgaacgaacgagatcgagcgctacagggcacatcaacagtacctctgtacattacgctttacattaacaacttgcaaatcgctattctgcactgcagcacaaagcacaatataggagccggatccctacacatcggcaatatttaggactttctcttactctttcctttagcaccttctcaaaaacccacattgcaaatgctcttaggaagcttgcaatactgacggccggccggcatgtgcaaaatctttcgagatgctgttcatcctcaaaaatccttcgatgctgttcatcctcaaaaaaaccaggtacgaaagcaggcagctagggtggcgagctccttgtcatgtacgtgatgtggttcacaaaagctaacgagagatcaatgcagtttttatagtgactgtaagctattgcagtcacttagaaatgaacaatccagacaacagtgtgttgcctttgttttcgtagtgatatttacactaatcttcaggtatatatatatatggacagacctattgtgttattcatcgatcctttgtctaaaggacatgtttttggcatctgctgctgcctgaataaagagaaaaatgtgaggatagtgacatttttcaccacattactagtaagacgcctgacgccactgtcggtggcacgacatgttggtggaagctgaaatgttgaggcaattggtttcaaaacctaaaatggttgacattaattggtttgccccattgcaaccgcatcgcctggcttgccccaactcttgacatggcaactggccaccagcccacacttttgtcagttttgttcaatgctatgagatttagtatacgcaaatggtcaaattgacgaccggaatgtatgaatatccaaaatgtaccagatattcttataatgaaatattatatattgatgagtgatcattgtgactttctggcaataaaatgaatgatactgcttggttaaaaaataacatcattttgtcattctggtaagaatacaattggtataagcaattaaaacatcttattttcagttgttcagaattgccaactgatgcataaagatgggatttggtatggccaaaatttcttcttttacatcctctctgttcacgaacaaacaaaaactggaaaaaaaaagctcatatgcagacatgtaagttttgcagcaactaagctagctagtcattgacaattgtctcgtctatgattgacaaatattattagacatgacacatagaacacatccccttcaaatcaaagcaatcgcacaaaaaacatatatgagacaaaccaaaaaaaaaaaaactatctgccacataggatagacattgtcacatcattaagactgggagattcaagagctgtggatgcctcttcctttgttacccttatgtgaaaatatgctggatggttgggtttaggcagtgtcatattctcgctgcttagcatcacaaccacatctgacattgtgggccggtcagccgcattctcttgaacacacagcaatgcaatgttaatgcatctcatcatctgaaatgcatgcaattcagtagacaacgaagcatccaagagttcaacccatctttattctttccacaattgccatgccttcaagtaatttggtcacaataaatagaggttgattactacaagacaacacaatgttatgtgtttatgtataggaaaaagaactcacatatccaagtagggtgaagaaatctccacattgatgaaaaccagagttccttttcccactaacaatctcgagaattaggacaccgaagctgaatacatcagatttaattgagaagagtccctccgaagcatactcaggagccatataaccactgaaatatcataggtaaaatttataaagaaacaaactatatgtgaagtttgtgttatgtaaattgatgatataatttggatgtgctaattgtaagaaaaactcactatgtcccgacaatcctttttgtgttttcttctttatcattcgagctgaatattctcgcaagcccaaagtctgaaattttaggattcatttcacagtctaggagaatgttgcttgctttaagatctctatgtatgactcgcagccgagaatgtttgtgcaaataaagaagtccatgtgctatcccttcaattattgctaggcgattattccaatttagcgtaactcttcttcgttcatctgcatatcaataaacgtaagtagttgataaaaacaactccaacagccagatttagctatgaatttgcactaggatattatgagaagtaataccaaagataaagaagtccaagcttttatttggcaaatattcatatatcagtattttctcctctccttgatagcaacatcccaagagcttaaccagatttgtgtgctgaagcttggctatgagttggatttcatttctgaactctgtgaaaccttgccctgaatgtgaagcaacaagcctcttaactgctatctcggatccatcagaaaactgaccctaggaaaaaacatcaaaacagatttatcagtgataaatgattatgtacatttttttaataaaaaagtgggtaaaacctggactctacatccaaccagatgtacacgccaaaattatttacatttattatgtactgtatatcagcattttactcatccttctaagaaaataactttcattgtatgacttgtaagaggatttgaaacatattcattagcaaccagctaccagatgctggaccatatgtttttgactctcttaaaaaaagagatatatctgattttaagatttccatatctctacgagtctatgtatgatagggcatgttgctgttaccttgtataccgggccaaatcctcctttcccaagcttattatcttcagagaagttgtttgtagcatctaacacttgtgataatttgaacgatgtgaactctgaactacatgcttctcttccccaggccaatgcttcttcatctgtctgcatattcatatcaccctgcaagctcacttcacctaaattcagaattgaaacaattctttcagtaaaaccgctgccgtctaattttctcggaggtgttctaccatgctttctatcggtagtagaattaatctaaaccatttttctaatcaaatacaccatatctatttgtactaacctatcaactatatagaataatttttccgacgagcggtacaactcataaatcaaatgttgagatacttctagtgcgataatactggtagtagagcaccgctcattttcttgcacaattgcgtggctaaattacagttttctccttccattgtttgacttttttttagttgaagttctttaggtttaagtttatagaaaaattaataacatttataacaccaaattagtttgattgaacttaatattgaatatattttcataatatgtttgttttatattgaaaatgttaatatttttttacaaatttggtcaaacttaaagaaaatttaactaagtaaaaagtcaaatgacttataatatgaaatagagtagcttttacctttcttgtaccttctgaccaatccgaagcaaaagatgacgcagcaaaatgatccaagaagtgggaaaatcgtggccatggccatgactttgctcctcctcctcct

SEQ ID NO: 6998 - DNA, 911 bp, Oryza sativa
gtcgtcgccggcggcggcggcgacgagttgtacgccgccgtcctcgccgtctcctggacgagcaccttgatgatgttggtgatgatcgccacgctgtcggcgttgccggggtcccacccgggcagcatcggctgcgtgatgttctccgtgttcatgagcaccatggcatcgtccgcgttcgtcgtcgtcgtcgtagagttgctgctgcggttgaggatgtcatggccggagaaccggagctggcagccggcgtcgtcggcgacgaccacgtcttcggcgagcgggcacgcccgccgcgccacccgggacgcgccggcgacgcagtcgccgcaggccgaggcgttgggtaagtcgccgcggcagagcgccacgccgtacacggtgtccggggcggcgccggcggcgcccttgccgaacagcgacggcgtcgacgcgttcttggccagcccagcaatcaatcgctcgaggttggactcgtaggcgctcctcgccgtgtagttggtggcgccgcagttgaaccacacgtccggatcggcggcgacgatcgggtgatcgtggccgacgacgaggacgacggcggcgacgacgacgatgtcgatcatgtcgacgccgccggtgaacacgaaccaacaagaaattaagcggcagagttgtgggaattcgtcttctaccttgaggaacaacgacgatgacgtcactcatgtcggcatctttggtgagacaagcgtatgccgcttcacatgttgattttgttcgttcgttcttctcgccggtaacgagccaaaatagaatgaaatcagatacttccaacaatgtgtgtacgtttattttgatcttggaaattttattgaccagtattatgtcttcctcagtagttaattacacgagagtaccttcacggtctctattct

SEQ ID NO: 6999 - DNA, 29397 bp, Oryza sativa
  unsure (1)..(29397): unsure at all n locations
acaattgtaaaacacctcgccacgatcaacttgttcaagagtttcaaaggtctgttcggttcgttttgattgcgaatcgcgatgtgaaattagtcttctgcaaaacccccctgaccactacttgtgtcaccgttgtattcaaatgttacttctaatatattgacatgtaaagcttttatgcattcgaaaaaactgaaaggaaattagtcttgatctgcatcgtactgtatattttgttgtacagaaattataacactgtattactcttctgaatcaaacagtggattgcatctatataaattacccaaatcaacctaaacaaactcttttttttctttcatccattttccatttccaactttgtttggaattttcgtgtttatgttacaacttttcaaacaaataatacctcaggtgtaaatagtgagtttttatttccatactatataggacatatattgggggtggggaagaacaacttgtgttgttcttcactcatcatatatagacaattttccttaaaaaatcgtctaagaaatatcatagcaaaagatccaatccgtaccacaaaagtgtacacactgtctttagcacattctttgagtacgtttgtgacaacgaactatagttagcaataagcatctgtgacgtccaatcaaattgtcatctgggaaatataatgaattagcagacgccatgatgttgactaacatgcggaattaggtgcttctgattgttgaagtctttgttttttacaccataaccgtaccgcaaatagaaatgctttccaggtgagctcaccgaatcagattaaaacgtttaaggacatccaatatgtctatataccacaattgtctgaaggacacacttggatgaatgaaacaatatgattttttttgttgcaaaagtaccaagagaggatagttcaattgcctttcattctctaactatggtttttttatgccaatatatatggactatcacaatcagcttgactgacgatcataataattgtattagctagtgtgatagaaagttatttcagagatttctttattgcattgggatgatggcatctattggagttcttggtgttaactgattcatgactttgtaatttcagctcccgccaacatatgtgttttaacaaattaatacattccgctcgctataaggacaacaaaaacctttaatgccatatctcactcgaatcaaaattatagagacataaagtttatatttatacatctctgttttttactgtgcaataataacatggttttggcatgtatcctatcttattataaagttatcccccactaactccttaagcttaacatgcaaagatgccacatcatcatccactaatccactaattaacaagataccacatcatcatccactaacaatcatcacatttaaacatcatacaaacatgttatattatctataattttatagtttttataatttaagagcttttaaaatacaagcataatacaagcatgttaaattatcatcccacataatttaaataatatttcaatatatatctttattatgtcttatgatatcctatatgcttatatagtttatcctcacttagttagtgcttaaatgattaatttatggtctaaattatctttctcctttttttttctctaattaagtcatatcacatcaattgtttttagcctttagatgattaatctacggtccaaactatctccctacttttctccaccttactttttagtttgaatcaccattctatatactatttaaatttaaattatcataaaccacattaatttacttaatctgatgttatgtagctatcttacacgttattttttttgttgttatcatactaaattcccgcagcgatgcgtggggtttcacctaattattcatgccagaaaacacatgatggcatgtcatttttcaagcgccaatagtcattaatagtcatttaagttcgatcgatcaaacggggcttgttcaggaatgcaggtcggtggcgattgacctcctctacaaacgaatattgaaacaacaaaagtaccactatgtcaaggcagtttttcggcacataattacacttatatagacatgtatggaaaagattacgcctcttattatataatatatatgttctcacttagacgaatatgaaaagattacacctcttattatataatatatgttttcaacaaaattagatagtgggaaacacaaatgaaataggtaaatctcatcatatactcaatattacaaactaatgcatgcatatatttcaattatctaggattacgtagtggcggatccagaaagaaatagcagtgggttctaagcaaactagatagagttatagtcccctctcccatctacatatgctaaaaaaatttagtggggtctttatagtcttcacgccagtagtgggggctcaagaccccgccgcgctcatgctgtatccgtagttgaatgtggaacaaaatggtaaatctcatcatatactcaatattagaaactaatgcataattatgtttacaacatgtattttaatcgtttagggttatctaacttgattatggaacaaaatttatatcttccaagtggcgataagaattatactctagcatgtggcgataagaattatactctagcatgttctcaggcgatgtttcagttattgtttgttcaagaaagtataggctggttatatctattcagttctcaccaacatctctacatgtcctatgaacttttcaaagaggattagcatgtattaataaaaaaccttatgtaaaaaaagtcttgaccagattatctctaacttttctaatagacacgcgtgtcttagtgtcacaaaaaaacaaaagtaaagaagtcttaactcaaagtcttgtccaagagacaccaacttctcaaagagaatgagcatgtccatttacctagctcctctatatagccaaccgattttacagatgatgcatgcatttcataggatgaaaatagagatgaacatgtatatggggagaaaacattaatttttcggtacattgctcaacaatatgctaagcatgagtgcatgacgcactcacgccctatctgatgctcgtgcgtatatatattgctcttttcctgccaagttcgtccaacatgcatgatctagctattcagttaactaggtgaaaccccacgcattgctgcgggaatttagtatgaagatatacattgaaatattatgtgaattatgttggatgataatttaacatgtttgtgtttgaaaagctcttaaattataaaaactataaacatatagcatgtaattgcatgatgtttaaatgtgatgattgttagtggatgatgatgtggcatcttgttaattagtggatgatgatgtggcatctttgcatgaagatatacattgaaacattatgtgaattatgttggatgataatttaatatgtttgtatttgaaaagctcttaaattataaaaactataaagatatagcatgtttgcatgatgtttaaatgtaatgattgttagtggatgatgatgtgacatattgttaattagtggatgatgatgtggcatctcgttagtggatgatgatgtggcatctttgcatgttaagcttaaggagttagtgggggataactttatagtaagataggataacacatcatttgtgttgtgctaaacttttctactgtcacacatgacacattcatctctttccgttgcgtattctgataaattttcagacgttaaatatatagataacctagtggatgaaagcatccgagaaatacgagaggtttttttcaataattttataggtatatacatgtttagaagaaaataacaaaaatataccactatcgcagaataaaaaatccgagaccataaggcaagtgtgtgataaagcggtcttgcgtggagaggaggcgacaccacgcagtatcgcgctgcgagtccggagacccaaaaactcacatgattaattaattaattagtgtcattagcaattaattaattaattattatctctttaattaatatcattggtaattaattaatcactaattagtatgattaattgtgttattaattagcggccagtgtggccatctcgctcgggcaacaagcgagaccgaggctgaatagctctcccgctcggccaattagcgacaccgaagtcggtctcgcatttctgccttacgaaaccgcccgtgacagcacatttctgtcagtattgcgcgtttgtcttacgatttcattgtgatttcgcactttcaaaccacgacgacggtttatttgtgtaaatcctttcgcatctagtatatttctgagaaaaaaactacaacagtataattttaaattttatccgcgaacgtgctagcctttgatcagttagcgtgggccgtattcatatcatgggcctcatacggtctcagctataattgggctttcttaggcattcgggaaaaccctcagacggttgcgggttaaaaagtaggaataagtttaccttaggttcctcaatttatcgccgagtccgaaattcatccctaaattgaaataccagatatagcgggtcccttaatttacaaaaccgaatcacccgaaatactatacattattataaccagttttagctgacgtggcaagctgagtcggcgtgggacccacacgggccacacatgttagtgggtagcactttcttctacctctcttctctctctcccctctcccctcctctcttccaatcgtcctggactggatgtgacagatcgatccatcgatcacagtggcgacaagttattgggcggctgtggagaatttgggctttagacgtagagttgtggaggcccgtgacgggatagtggggcatggcacgggccaaaactctcttgctgctttgtacttaggcccatggggcgcgcactcttatgtaattgggcttccttctggagagagagagagattaatttgggggattgcaaggattgtaccagaccgcatgtttttcgagtgtgatttcacgagtgatgcacgatcacataccatgatcgctgattgaatttttttttatttgaatgaaaaatacgtaggtatatttctacacaattcattatattataccagcaatccatcccaaggtagtaaattattatacattattatacaagtaagtaaataagtgttatggcaacaaatacttttgctgttattcggaaatctaatcaacgcaggagcattatgacaacaaatgtctattctcttttctgttatttagaaatctaataacgcaatacatgccttatataacctcggcgacacacaccttcacacaacaccttagtctgagtctcatgccatgcccacacatgcatgctccactcgatccactcaatccggccactactaactacttgcatgcaacagttgtatgcactgaccggtactagtctcgctaactaattagctaactaattgatgcatgcaagcaccataagttcaatatgaacccatgacattttcagctactacgtgcacgctcgcctcccttctccccacaaacctcgcctatgcctaattccctaatcatatatatcaccccgctaaatcttgatatatatcccgttaaatcttgtaatcaaatatttatttgacttactccaaaatctcactctctgcttctttatcttgtgcctctccgattctttttctgttgccacatgcacggcatgttagcagtacatacgaataagctaagataccgactacacttgttttagttgatatcctacaactcctcttatagacaaatattatctgatatctgaatgctataacagctttcaggtggtccccttccactaatagatattttaattatatatgcattcacaagccatccatctgctactctctcttccaatcatgttaattacatgttttctttcgaaacatgctatctccattttgttgttcatctcctcctcgtatgaagtgtgctaatgagatggaagctaaccacaggtaggacaacaaccattacgtagggacactgaaaatgaaaaacgcaattggagatagtgatctctgtctcacgttgtgaatgagtccgtacatacatccttcatatggtgatagaatatacgtcatacgtatggaatatatgtcattcttttggtacgtcatccatgtttgagttagttttctaatatttatctttatatctaacctatctctttatacctataataagtaatgattccattaatttgattttgtacgtcctctatacgtgtctaatccgttgccacacgcctccagccgccaccgcgccgcccaggccgaaccctaatatcgccgccacatctatctacctccacatgcattttctcctctaactaattgcaaaaatctatctacctccacatgcattttctcctctaactaattgcaaaaaccgattctccactcctcactcatcctttccttcataatttcacctttcaattcggcattaattcacaagatttaatctctgtttaacagttgtgaaggattgctagccgatgatcttctccgccatttttatccagatgatcttgccccgccgtttttatcctgagttttacggattcgctctgattttaggaaaaactaaagaactgatcaagtggatcaaaagccctcaatcaattttgggagattgataaaaaatcgatttgatgggatgatcagtgaacagttttggcattgtgcgggatcggcttcagcattgcacgggcacgtaactgtcttatggaagttaagagaggcaagcaggagtcaacgccttttcaattataatgtatagcaatagttatgtttcaatttattccttggctcttaatagttgtatcactagaaaaaaatgcctttacccattgcaacgcatgggtattttttcagtctctactattataaaaattgaagatgtttctgtcggaattttggtacgtcattcgtattgagttagtttttaagttcgtacacttttggaaatacataaggagtcgtataagaaatcattttagtaaactcacatatcaactttacaatgatttttttctattcataaagaaaaaagatttggaatcgcaatgctactatacgcacccggaggaatattcggaattatattcttatataatccatttttgtgcggggtcttactaacaggacttcgctacacgagatgaggattcattgaaaagctaaggtcatccggtattttcataccctttgggggtggtatatggctttacaaaggacgagagtcggactcataattgctttagaattcttgccagataattagaaagcaacttactggatatgactatcatcccaataagattcccaaattagatatcaatactatcaaaataaaatcgcatatactttttagacaaaaaaaattctaacaataattgattaaaatagccttcacccgttgtaactcaagtatattttttatagtatagaaaaagtatgaattaccccctatggattcctaattgggtggatatgcgtcgctggaggcgaccatgaggagttggggtttcgttcctcaccttcgcctgaggagagatgccgtcattggggttaaatcactatcacgtagcaagagctgttgccattgggtttcatttccatcgtcggggagctgtgcagtggccaccgtggtattgatgagctcgcgaatcgcgcagctccgcggcacaaatctctctaccatcatacgattgagatggtgcagcacatcgatcggggcagcggcgattatgtaggggcagctgaggttgagcttgtcagtcgtgggtgttctgttctttgccatcgctcgctcacgatagcactgcagcattgggggagacgaagttcacgaaggataaaaaagacatttcgtgcaaaccttaattttatcaaacttgtcggaaacgtcaaataaaagaggatggagagagtattctgatgaaaaatttttttatagctgatttgttatgaaaatgtttctcttcgaacgtccgatcagataaaaaacgtcggacgcctacggcagctcactccgttacgtcatccatggatgcacgcatgcacaacatgcaagcaagcacatatatacggtcacaccgatgtgtaaatgaaacgtggtctttaaaattatttttcttcaaaactatttatccgatccaagctctaattatatcgaagtattcgttgtaattaaatcttcaaaacaagatatcacatgattatatttcgataacatatatttatatgtttcaaccattaaaactcgatgtttcactcggtgagaagagaatgtttcatttaaaattagactatgttgcacgtttaattttttttaatgttgcatatggtattatataaatgtttcaataagtaattccgggtgtctcactacttcatgtacaaatgttgcacataatccttttttatgtttcagcagggttttttttttcaacaattacaacgctgtgcttcatggatgagataaagaaaatatttcaagtaattaagtatttataaatattttgtatattcatatgattttgttatgtatcaccagttcgtatttaatgtttcatacaatggttgtcattgttacagtcaatatattttatatgttgcatttctctggaacgcatttcattagtgaggtgaaacaattttatataaattgtgaacaacaattgatttttatacatatatttttaataaaaatataactgtatgagattttttataaaaaaattcaaatataacaaacttaatggtataattagatcataaactagatgtatattttaaaagaaaattttgattaaattttggtgaaagaaaaaaggagaaaaaagtgctagtatactatactccctccgtccaaaaaaaggcaaaccctgggtttccgtgtccaactttgactgttcgtcttatatgaaatttttttataattcgtatttccattgttgttagatgataaaacatgattaatattttatgcgtgacttgtcttttaattttttttataatttttttaaataaggcggacggtcgaacgttggacacggaaaccagggtttgtcattttttggacggagggagtacgtgagaaggaaagaggaaaaggaagaggtggtgtgacaggcgcatatactagaatatatgtggtaggctgcatgtggcatacagaggtgcatgatagacggaagatgcatgctgcatcagcaggaggcatgacaggcgcgcagacagacgggtgtccgatatttggtggaatatcggacgttcgacgcggagtcgtccccgatttgttatcatagattttttaagttgcatacagtattatttggattttctagtaagtacttttcgatgttctgcaattgatttggaaatgttgcacgtagtgttatttcgaatgtttcagtacatatcctgtgatgtttcatactgttagaacagtactcttttattgttgggcaaacaatattaccaataatcccgatgccaaacccagtcaaaatcccataaaaaatctcctcacatatagcactagatatgtaggggttaagatctgttggatccaatctatcacaaaaaattccttataattagtttttgacaagaatatgggagtagtaatgctattattataacaagtatccctcctccccagccctggcctccgcccaatccccatcatatcatcctgttaaatatatttctttggcttcctctaaaacctcattttccatatttgttcttttgctcgcatttcacctgtctttctttggcttcctccaaaacctcattttccatatttgtttttttctcgcatttcacttatctagtcgcgctatgttagtagcacatataaaatactgaattgtttcagccaaatatcttaatgctataatgcttttcagctgatccccttctaatgggtaatggatattttaattatatatgcattcacatgtcatccacccgctcctctctttcaatcatattaattacatgttttctttcgaaacatgttatctcggctttgttgttctcctcgtatgaagtgcgctaataaggtggaagctagccaccgttaggataactacacagagaaactacaagtgaaaaaaacgctattatattggagatagttatctcggtcacacgttgtgaatgagtccgcacgaccttgatatggtgatgaaatatatatatatagctagctcatgttgtttttacatcccctgcctccccggttcacttttaactgtcacacggtatgtttaacacgagtgtttgttgtcacatgcatgaagagaagtagtcagtggaacttacgaagagaagtacaattttattgatatgcatgacatgcaacacaatacaatacaatggcaacgcatagtagctcatggtgtattagcagtttttactcatctattcgtggtgtattagcagtttttactaatctattttggatttgtagttgatttcagactccaacaaatcattaaccattttctctgccttccattactcactatatacaaagtttttcttatagttcctaccaataatattccgatgctaaactccgttaaaatctctagtactacatatgttttggatttcgagttcatatttcttgatcagttgatcagcagtttttgttccatacatatgtttctttttttcttggcactttcctcgtcaccaaccaaggggttgttctggtaactttatattcagataaacagctggttaaaataaagctgataagaatatatccaaataatcgggggaaaccaactaatgtcttcaaattcattttctagaccatagaactaaagctcttgtaatttggacgaaaaattgaaatgttttgggaagctctagatcctagaactgaagctgtagctgctcgaagcttcagagcgatcagattcaggcacacctattgtctttacttaggtaccggctgtatgcatgcgtggaacttatatgtgttagtcgaaaaagaatacgacaaggatgctaccttttctctcttcaataggaaagcatattcgtttacagtgtgcagaaaaataatccacatttctttgtgttcgccggcattagtttctgcatgattgaaattgctgatcagcttaaactcatgcatattgaagtactatctagcatgagtgtacgggggtttctagtggacgtgtgccgggctgcataaagcgcccgtacgtcccagtcactcacgcaaatcactattaacgctaatgatgatgcttagctctaatttttaaaaatacataaataacttagttaacaacttaaaaaaagatagttgaaagttttcaattttgagataaaagtttgaattttgacttaaaagttttttaaatttgaattgaaagttttgaatttcgatatagaagttctcaattttgagatgaaaatttgagttgaaagttttaaatctggatagaaagttttaaatcttgagttaaaagttttaaatatttatttgaaagtttttaaatttcagttgaaagtttcaaattttgagttgaaagtgaaaacctgagttcaaagttttgaattttgagatgaaggttttatttggacctttttttttttcaaatttgagttgttgctttttgttaaaaaaatgtcatgtataccaaataaatgaaacacatacacttacctggaaaaaaaactcatcattgtttctctagatctgggaatcatgcgcaagggaaatacatgtataccatatggcgtagttgatggggctaattttatttccagatccaaaaaaagaaaaaaaaagggaaatgcatatagctggtgggacgcacgagggaatagaaacacacagcacttctggtgcatatgcgtggaataggaatttcgtgagtgcacaggtaaattaacgagacaaaggccatgtttagtttatttccatcacatcatatcacatcgaaaactttcctacacacataaactagcaacttttttttccaaactaccaactcccaacttttccactatctaaacacagccaaaggatgatgacagtagaatagctatcccattctattggcagctcccacaggcaggcctaaccactgcattactgcactattaattaattagaggcgcattacggtgctctctactggtagtagaaagtaatctgaactgttaatcttatttgatcgaagggttcaaatctatttataataccatcttaattaaccgtagtaaaatcgtggagggtattattatcaaggaaaaaatatttccgaagggatataattaattgtgatgtaattcaaattattgttgataaccgacaatttggtaaattattgattttatttctctttgttaaattacatatctttcaagttattatttatgtgagatccattggatacccactgaacatacccgcgcccgctgggcatggttatgggtatggagttttgcccgctaactctagtgggtagggtttgggcgggcaatgtcgggtatcgggtcgggcatggttttgctctacccgtacccgacccgacccattgccatccctacctacatgcttaaaagaggtggtttctattccataggggaaggtgcatcatctgactctaatcatcgtggtggatttatttacggaaataatatcaaaatgttatgccatttgttggctcaaaactaaattctcttctcccactactaccactctcaattaaactaaattctctctcccactagcaccactattaatttaatctatcttgttattgattaagattgaaacaacatttcaattcacactagttattgtgattcctttcgctttcaccaacacaattgtataaaagactaagttgtattttcactatccgccagcaccaatgttgatttaatgttgtggttttttaaggttcaatcaacattactactgacacttataattatggtagcttcagcattcaccaacatctctaactggtctaaaagactataacttcattctcgctagccatcggcactagtgttttttaatcttgtagtcgattaaggtttaactaacatcttttacagttgtgtccgcttcaactttcccagcatatttcctctcatttaaacatcactcttcaattacaaaaattgatgtgtattctcaccaactgtctggctatgctactttttcaatagcactaccaaactacttagaatgtttattttacaaaaacaaatctcaaattttcactataatactccgttagcataaatatttcccctctctagcttagcatctcctcaagttactctatgtgtaatatatatatatatatatatatacatctccaattctgtgcagtcaggttcacatgtatgccgcatgcttatctattgtctttaatttttaccaagtctagctggatggatggaacttatgcgtcagttgcagaaggaacatgatcagtatactagctactatcgctaggaaagcacatctgtttacatactacagtacacatcaaatccaaatttctttgtgttcattaagatttgtgtatggggaattactgaccaaacacttgtgcacatcgaagtatcttgcatgtgtatgtgcagtgagatcgacgagacaatgaagataacagtgaatatttcaattagcaagttcccacaggcctaaccattacgctatactaattattgtcagaaattgcaattccaatttgctactgtatatttttttagctgatagaaagtctagtcttttggccattcaatatgtttctttgaatttctttctgacagttgaaaatatcaaaataggccttttcaatccagataaaactgagagcttgttgtggaagttattttgtattcccagcagcaacggaagataaatatcattcgttttaataacgaaaaatacaccatttgtgatttgtattagtttttctacaggagcatgtctttcactagctcaaagctcattgaggaatcatagtcactacaaaatggcaacgtgtaattcatcaggcatgcatgattaatactccctccgtttcgaaatgtttgacaccgttgactttttagcgcatgtttaaccgttcgtcttattcaaaaacttttgtgaaatatgtaaaattatatgcctacataaaaatatatttaacaatgaatcaaatgataggaaaaaaattaataattacttaaattttttgaataagacgaacggtcaaacatgtgataaaaagtcaacggcgtcaaacattttgaaattgagggagtattttaggcaaagtttgccatgggacatccaaaaaacgtgtaattagctgggagtcaccgcaaaaacactaatttgctataggacaccaccaaaaactggtaattagttactggacacccgcaaaattattttattatatccggagaaattggatagaaaaacaatcattaaagacaagtttgcccttgctcaaatgaatccaaacgtgggccccacatgtaagctcaaatttaagccccctctctctctcccacgcagcgccacgtcgaccagccggaacacgccatggcatacccacacgaggacggcgagacgccgcgttctccttcgagacgccccagcggcgacgcggcggatgagggcggcgtggcggggcggtggtgggcgtgtccgagtcgagcgagaacgtggaggggtggctagtgacactcgccgtgttactgctaccgccgcacttgacctgcctccaccacgtctccctcgtcagcagtcggttccgccgcatgctcactagccgccgcttcctctgccaattcaacgacctccacggcggcgcgccaggggctcccttgtcgggttcttccacaaccacaaccatggcgcctgggcgaacaaccgctccatccctgtcggcgtcgacagcaccagggactgccgtcggagccgccgccgtggtgccacggcgcgtaatcccggcggggtgtttgccttgggcgatgacgccgagtggcatgtcatcggctcacgtggcgggcgcgtcctcctccttagccccacccggctccgcctccttgtgctggagcccatgctcggtcgccgctagtacatcccggcgccactggcgcccgagtacaggccatcatacttcagcaatgcgcaacgccgttccaaccgaggtgcccacactagcccgcgcctcgtcgcgcggtcaccggcgctccctcgggctcgcttgaagagcaaagagagaaagcgagaaagaatagagagagaagaataaggaagaaggagtagaaaaggatagataaaaaataaaaagaaaaaaatcgaagggtagaatcgtacttacacaattgtttctctctgcaatttctccggatataataaaataatcctataggtgtccagtagctaattaccagtttttggtggtgtcctatagcaaataagcgtttttgcagtgtctcctagctaattacacgttttttggatgtcccatagcaaatttttcagttgctcaattctgccggtggataaagcgagagatggtaggagaaccacaagatctatactagtatgtacataaaggcacacgacaaatgcggaggcctttgatgccccaatccataatagtggataattggatatataaatacagagtgagttaaaatacattctcaaactaacgatctggtaacagtttcacttaagacgagaagctaatgatatacaactgcggctgcatgtgatagcatgactgataagcattaagatagaagtggtggccattcatatcggttgttacaatatttagttctgtgctgctcattaataaaaaactgttatcgttattttggaatcaaatttcaatcttatattatattatattatattcctacctcaatatattcacccaaaactatttagtgcccaccccatcttcatttataatctttgatccaccattataatcttcgatgacttgtgaactcagacaacttttaatcattcttgttcattaagatggcctctctcctccttgttgattggttgatggtcacgccttcaatacactcaaaatatattcaatattagggaggtcaggtttctcatgggttatcatgctagtctatccaaaataataacacacggtctttatagatcaccattttttagtttcctccaacatctaatataactttgcaatgcgctaaccttaatctaagataaccttaatataagataacatagacatgtgtttacccgttcactcttattgaaatccttatataaccaaaactgatcatgctatgtaccagccatttcatatgatgaagtagacaaaatatactaaatgaacacatttctggctgtatgttgccaaacatatgtacaaagtcacgctctaatgcagatgttgctttctcatgccaaattcgtccaaacatggggatggaatcaacatccctgtctcacaccactactatgcatatattattcagttaagaacacatcatatacatatgttttctggcagctgatcatggatgcatggtcaccacaaaaacacagctaataaatacatcaggcatgatcgaacaaattcctgtcacaattagttgaaatcgctgtgtatgagatggcaaactcatgcaattagcatagatatgttactcggtgtacttcagctgggccgcttaattatggtctttggatcatgtgaacaggattgagaacgtatgtcccacgcgtttttaggggcttatcagaattttgctcgtggtgaactagatcaggaaatgttgtgtatgcttgtactattcatgatattagttattcttaggacgctccaatgtgataaatcatgcatgtacacatttatttagtagtgaacaggtaagcatagaaagttcatgcatgcttacgtgctaaaagttcatataaaaaaggaaaattacaataacccccacaaaagatacttgaagtttgacattacaccccataaatcattttgttgcaaatgtccaccctctacatggttttggtaaaaaaaaaccatcccgttcgcacgtgtttagctgaattcaggggcggagctagagtatgtgggggggggggggggtgcccaggaacccagcctaaaaaaaatttttagctatacctcacatattttcaccatgtgtgtaccaccctcaatacaaatttagatacttgcatcggcttgaacttgatctaaaatagagtaaattaagcaagtggcaccctctccatttcatgctgaattagtctgttatcattgatgaatagtctcataggctaagatagccgggtcaatcttatctaagtgtttgcattagacttattctttgtgtttcattattttgtttctgcatataatgaaacttagtgcaacaacatttaacctctcatcagtaattatatttgtgaaaactcaagaaaagtgtcaagacaatttatgaaaacatatcgattcatttaagcacgtgtgcactagggtggtttttgctacaaaaccgagtagagggtggacatttgcaataaaatgacttataagatggaatgtcaaacttaagtgacttctagggtgatttttttttgtaattttccctattaaaaagtccttagaatggtaatatgttgtttagtgcctcgtttaattaattcgttggttgttaccgaattcttctggaagtgcttgcattgtgatagtgataaaaggtatggtatatatagcgatggtgaaagtgttgggtttcatggcccaatctaaacggatcagaataggtaaaaggtagtagttcatataattagttaatagtgattttgtatgctggttggtggtgaagttgtgctcatattgttaactaataataactaaacaatgatctggtagagatatgtaatgaataaacactgacttgggtggtaatatataactaatagatattgaagaaatggtttaaagggaaaccatgcaaacttttagtggttttagaattaactggaaatttttgatatagtataaataaaaaattgcattcttttagtgttatagaaccagattttcccttcttttttttaccggtcaaatgggtcgagaaaatcataggaaaaaattatactcattattatttctcatcaagcaacatttgcatgtctcatcaccataaacgcattgtagatacaaccaactttaaacaagaagggagacaattgaggtgtgatatatgaaatataaatagatagtagatgtgaagactaaccacacacacatgtatagtataggatggtttttcgaaaagttataagatggtggaggaagctgaaaagtaactagtttagattatcaagaaagtttagattgtaatcagttcttgaaaaacatattggtaaaattgaccagatccctcctgacgacgcatgaataatccaacaaatatatttttgccattagcttacatggcgttaagtttatcaatgtcatattagcagagcctctctttctctctaccactgatgaacatgtcattaaagtcatttaagagtcctcatcaaacaagatatgggatatctatcctcataaaacaagatatgggatatctttagcatagcttctgtggacccccgtttttataacaggaatcaatcgtgtaaacagtaccatttccctggatcaagtagtttggtacacacgaattcatagctggaatatcaagtgcacatacacgagtatcaaatacgaattattacatcataggcccgcaggcatagtcttaaatcatcggaccgagaggtccggaatacatccaaaagcagaaatagataaggcagcggaattcaggcagcggcatgccattgccacaggcaacgaccgtactaagacctactggacgccatcgtcttcgtctccctcctgatagtagacatagggatcctccgaggcttcatctcccgcttctgataaattttatatttgcaaggatgagtaccaaccgtactcagcaagccaccacagcaacaatgcatatgaaagggggagttcaaaggatggccatagttcttttgcgcaaagcaagttttgtaattcttttcacaagcctaagacctagcattgactgatcaaattttagtaccagagtttgtatttaaacaacgacggttctgtccaccatccattgtgatcccaaggatagcttcccaccattgattcgtcatggttttctgaggacgtccaccttcccgcctctcaggaagtggctccaacagcataaaattcatcatgcaatatcccttcccacacaagttaagaatttagagtctagccaagtgtaatacacgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagctttttgataacctcgcattggcagtacccgctccatgaacttttcatcctcatgcactctaggcgtacacggtttctagcagtgagaggagttctggcgcacccgggaagggaagactcacacatgcattaagttataattatgttttagattctcacatggcagtcctaccgatggcgacaccactgtagacacccgcctcgcggtcctaccaatggctgcccccaccgtagagcccctgcctcacacatcaagaaaccactatgcatggatactgcctccgctcagctatctactccgctaggtctatacccatacgagaagtgcggttgtacgggggtcgtttcatgcttaacttcatggctcggtccttaattgaccagggacggcactagccttttccagacaccacccaagtcctccagccgccctagtcgaaaacagttgttttactttattttcctttcacaaattatgtcgtcaatatcatggcaatgtggcgctcatgtctccacatgccgcatctcaattaccttcccaaaggtaattgcccaagcatatagcatttgataaatatgagtatgcatgaatctaaaatagcatttctaagcaagtgtcatagttgactagggactcgtacgtatctatggttacaaagatttaaaggtgaacaataatcaaggcatggtataatcacaagtaggatgttcataattgcatgcaattttatttgtaaacaaaacaatttcgcaattgggatcaacatgttcaaagaatagtgatgacttgccttgctcaaagtcttgcgggtcttggccttcgcttggatccgcaactccctcgggctctatagttacgtgcaagaattgatttgaattcggttagaattcaaataaaaatccaaataaatccaaataaaagtcacatgcgaaagtcgattcctttttattaattttactatctgcgaactatgacaaacccaatttcgatttaaactattttgcgggtataaatgttttattgtcacaaatttttaatttaatctacctgagcattatatccatataataggttagagatttctagcgcgagctaactatctgacaaaatcctagaaacattatatgatttaatttagtctatgactaaacgattaaatatattacacggctataatccctagtaactaaatccgaattttctaccgttaattgattacttatagggattacccaaaataatctataataattaccgcgaattgatctaaattattaccgcgaattgatctcctatagacattactaaaaataatctataacaatctattaagattcatctaattgttttaattcgtaaataattagttctataatcaaatcttagtactttaggtattttaaatagtaggagttcatctaacggtattctcattaatcctataattaatttctaatatgttaaatattctaaatctcttaaatttttcctttttctcttttctctttcttttcttttttctctttttctctcttttccttttcttttctttcctttctttctttttctctcttcctttttctttccttcctctccctctcggcactcttttcctctccctctcccggctctatctctctctctcggctcttgctctcccgggcggcggcgacgatggacgcgagggggggaaaggttgggcggcggcttaccgacgacggcgacggcaacggcggcgacagcgacggtggcggtgttggcgcaaggcgcggcgcggcggcttcgtggcgggggcgcggcggctttaagcgacggcgtggcggcgtggagacggcggcgcgatggcgtggaggagtggtagagatgagggggtggagacggaggagaagaggggaatagcggggcttatataggggaagggaaagagataaggggaggggaagacgtgacggcggcgcggggctcggggtgggggcgcgcggcacggggctcggggcgggacgcgacgggcgacggcgtgcggcgcgcggacgagcgacgacggcgacggacgagcgacgcgacggcgatggacgagcggcgacgggacgggcaacccgacggcnnacggcgcgcggcgcgtggtncgncanacgacancggcgcggggcgcaaggcgcaacggcgacggacgagcggcgacgggacgggcgacgtgacgggcgacgcgacgggcgggcagcgncggcgcgcggcgcgaggttcgggcgcgggcgcggcagtggtgcgcggcgcgaggcggcgtcagcgcgtcaccggcggcgcggggctcgagatgacgcgacggcagcagcggcgacgcgacggctacgcggcgcggcgatggcgacggcaatggcgcgcggcgggacgaggcgcgaggcgcgacggcgacggccgagcggcgcgaggcgcgcatggcaggggaggggaaggggctagggaacctcgtcgaacacctagaggctaatgaatagtgtctttttcctatttttcccaattttagtttatttcctatatgaatttgattctataatttctaaatcttgcataaatgaagtttactcaatatgtgtattatctcaactaatgaattcaccctagattagattaatattactcatattttatttttatataatttatttgagctttaattagggttaattcttattccatcgcaatgaaatttaattgatccaaatatggtcgcgataatattttatttattactatccacacctaatctttatttttaatttatatttattttaccaatttgtttttagggtttatttctaattaactattctttactcacgattaataatcctcgagatcaactccagataaaatagacgaatgagatcggcatgatgcaattagtttaaaaagtttttgaaaatccgtatttttagagtttttgttttgtcggtcgaattttcagggtgttacaaacctaccccccttaaacaaatctcgtcccgagatttcttaccagttttcgaatagatgcgggtactccgtcctcaagaattcttcgctttcccaggtggcttcagcctcagtgtgattactccattgtaccttgtacatacgccacactttgctcctagtcctcttttctgcttcatccaatatccgaatcgggtgttctggatatgtgagatcattgctaatgtgaatctcttccagcggagcttgttcttccggcactcgtaagcatttctttaattgggatacatggaagactgggtgcacctccgcgatattcttcggtaattgtaactgatatgcaacttctcctcgcctggcggtgatctggaatggccccacatatcttggtgccagttttcccttgaccttaaacctttttgtttcccctcatcggagaaacctttagataaacgtaatctccctccttaaattccaggtttcttcttcgagtgtcggcgtaactcttttgtcgtgattgtgctacttttagacggtcacggatcaagcgaaccttttcttcggcttcttgaataatatcaggtccaaataccgcccgttctccagtctcggaccacattagcggggtacgacatcgtcgaccaaacaatgcctcgttgggtgacatctttaggcttgcttgaaagctgttgttgtaggagaattcggcgtagggcaaacatctctcccagtccttgctaaaatccagagcacaagccctcagcatgtcttctaggacctggttggttctctccgtctggccatctgtctgtggatgataagctgtgctaaatgcgagataacttcctagggcttcatggactttctcccagaaatgtgaggtaaattgtgtgccccgatcagatataattttctttggtacaccatgaagacatactatcctggtcatgtataactcggctagcttagcactgctataatttgtcttaacgggaatgaatctcgctgtcnnnnnnnnnnnnnnnnnnnnnnnnnaaatggaatcatatcctgttgcggttttgggcaatccaacaataaaatccatacctatctcatcccatttccattcgggaatcctgagaggttgcaacaaacctgctggcctctggtgttcagccttcaccttctggcatacgtcgcagagtgctacgtattcggccacatctctcttcatgttgggccaccagtatccttccttcagatcttggtacatcttcgtacttccggggtgcaatgaatatgccgattcgtgagcttcctttaaaattaatcccctcagtccaccctgttcaggtacgtaaattctctttttataccatagaacatctttttcgtcggttgaaaattcctttgcacgtcctgcagccaagcgttccttcaactctcggacttcctcgttgtccttctgggcttcttctatttgggttctcaaaagaggttgaatgtccagggtgtttatctgtccacggggtactatatgtaggttcagctgagctatttcctccctaagctcagggaccatcccttccattctcagatgattgcaatggctcttacgactcagagcgtcggccacaacgtttgctttgcctgggtgatagtgaacctctaaatcatagtccttgattaattctaaccatcgcctttgcctcaagttgagatctgactgggtgaagatatactttagactcttgtggtcagtgtagatatcgcaatggtttccaattagataatgtctccaaatctttagcgcatgaaccacagctgcgagttctaggtcatgggtagggtagttttcctcatgtggtcgcaattgtcgcgacgcataggccaccacttttctgtcctgcatcagtactcctcctagtccttgccttgacgcatcacaatatataacaaagtctttcctgatgtcgggaagaactaaaataggcgctgaggtcagcttttccttgagctgctcaaagctttcctgacactgttctgaccacacaaacttctttttcttcttgagtagttgtgtcattggtcgggctatcttagagaacccttcaatgaaccttcggtagtatccagccaagcctagaaaactccgaatttcagtcacagatttgggtgctttccattccgtgacagcctccactttagcagggtccactgctactccaccggctgagattacgtgacccagaaaagcgacttccttcaaccaaaattcgcacttgctgaattttgcgtataacttgtgctttcggagtttctggagaaccaatcttaagtgttccgcatgttcttcttcatctttggagtagatcagaatgtcatcgatgaataccaccacaaacttatccaagtaatccatgaatactttgttcataagattcatgaagtatgccggggcattggttagaccaaacgacattactgtgaattcatacaacccatagcgtgttgaaaacgcggttttggggatatcctcggtcctaatcttcagttggtggtatcctgatcaaaggtctatctttgaaaacaccttagctcccttaagttggtcgaagaggtcatcaatccgtggtagtggatacttgtttttgatagttacttcgttcagtgatcggtagtctacacacattctcatgctaccgtctttctttttaacaaacaacactggggctccccaaggtgacgaactggggcgtacaaatcccttctcttgcaactctctgatttgccttttaagttcttctaactcattgaccggcatccgatatggtctcttggatatgggggcagttccgggtatcaggtcaataatgaactctacgtcacgatctggtggcattccaggtaaatcttctggaaacacatcaggaaatcgctgtactacaggcattccctttaggggtagcatggtgaatatacccccagcacgttcggttagcctaggttcttgatccatggttgctctcatatccgatccccagggtgtggtcagggtaacctctctacgtctacagtcaattactcctctatgctttgctaaccaatccatacccaaaatgacatcaagagtttggggtattagcaccataagattagagggaaataccacatccctaaggcgaattggtacatctatgcaagcatgactcatagttatctcgcccccaggtgagtgtactatcataggctttctaagtcccacgagggtcaagttgtgcttttgactagccttcagagatataaatgaatgcgatgcaccggaatcgaagagaactttaaccggggtggaattgatagagaacatacccattagtacgccctgatcttcctgggcctcttcagctcggacatggttcacttgtccgcgcccaaatccagtggcggtcctgttagattgcggagtcttgaatagacctcgcccgatagcaggggtagtagtgccgcgaacagtcattgcattcgcgccagttcggacaggggttttgcgtggatgagggcagttgttagcgtagtgcccgtattccccacagttgaagcagtccacattcttcttggctccaggggcagccaaagttggtgtaggggtgcggttctgaagtgcaactggcctgttgaagttgctaagtgcagcgggacggttggtcaccatgacagggggcttccatccggacggaggggctcccttaagtcgctgaggcactgtctgaggtgggtgactcatagcaagcctcctcttgcggttgtgttccaccgtcctttgatcgttctctagcctgacgaccttgttgatcaggctctggaaactctcgtgatcctgcccgatcataggtccacgcaattcatcattcagtccttctatgaacttgtcgatcttttcttcttcatctgccaggtctccaattgcgtagcgagccaactgagtgaacttgtttagatactcctgcactgttgtattcccttgccgcagtcttctaaactcgttcttcttcatgcgcatcactgcagcaggtacgaaattctcgcgaaacgccgcagtgaactcctcccaggtgggttctccagcaccgtcttctcgggcttccttgtaggtatcccaccaatcaccagcgggtctttccagctggttcactgcgaagatcaccttgtcggcttcgcgtaccctgactagagtcagtttcttttctatgatgcgtagccagtcttttgcttccatgggctcgtcggcagtagcgaacgtgggcggcttggttctcatgaactctccaaagcttgaccctccgcggttgccttggttgtttgcgatggcttgcagaagttgagtttgggtggccataactccggccagagtgtttaagtcgggtgtctgagtttcgtcattgctggttgttgcccgacgtcggcttgccatctgtgtaggttgatggagtaagtatcctaattttctaactagctcctatggctttatcccattaaggggggttgtgttgatatggactttgtttcgcaagcatggtggaataaactcatttataatacaacaacaatagatatcataacatcacagagtttcacaaatggtacataaatcatgatgcaattgactgcatacatacgcagtccaaataaggttcatccaaacgatacatcaaaccaatcatcaaactactcgtcaatctaggtaagggagggggtcttgcatactatccaaaaaccatctgatacgagatcgaagctgcaaggagtccgtcagtctagtcctccagccatccgcaggatcccggggcaggtagagggtggtcgctggctcgcgcaaacctgagtccccacggcccagaagtagtggcctctggatctggcttgggcctcttgcccggaggtcgtgtgctcttgcgagcagtgctgagggtgcgagggcctccaaggaaggtgatgcggggaacaggagcctcatcctctgaaggatcagtgatgtctggctcgatctctggctcggtgtcggtcccctctgtctcggagtcgacctggatcggagtctccaaactggaacccagctgcggagaaggtgtagggatcagtggagtgtgcaccaactccggaacaggtggctgtgtcgctgtagggtccactaggtagggcgctgactcggtagctagcatactagcctctcccagaagagcgtggaacgccggtgggtatggcggggtgaggaaaaagtagcggtcacggcctactgctgtggaagtagaagcccctgtagtgctgatcttggctgctagaagctgctcctccagctggctgacgtgctcctgactctctctcagctgctcctcaagagtatccatcatcccgcggtgatcgttgtactggtcagataactgctggaactggtcgccgtggacctggagctgtgccttcagtgagtctatctcactgccccaagcctggtgctcctcctccaactgaagctgctgtgctgtgaggtcggtcacctcagtctctaactcccccacacgtctctggtggtcgtcaatctccaacagagcctcctcgtagtagtcatctactgcctcagcccatcgtgacaaccgagtcaccatcgggttgtagcagcagggcgtgtcctgaactgtgcaaactgagttgccctcctcccggaacaggtgatgagcaaactcggtactcactaactcagctcggtggatagagctgagtcggaggaaggcctcccgggcggcatcctgcatcgcagtctctggcaggtctcggtggtgacgtgtctggaagctgtagtccaactcggaagggactcgggggtgaatctcaacccgagcctcccaaactgagccacactgtctcactcggtatgacgggaatccagggtatcgcagacgcctcaacatccgatgcagctcaatgacatacccctctgattgaggtaagctcaactcccaggtagcgggtgaatccgaatctgccatctaattttaagaaaaacccaaagtcagttgagagtaaaacttgttttgtaaataaaatagttaagagtaagatgaaaattgtaccgagttttgtaaacatagcgtttttatttttgaaagtattactaaatgggaatatctcccttggccaacttagaaaaggggtggggcgccttttggtcttttcctacagtcgtatggctctgataccagctctgtggacccccgtttttataacaggaatcaatcgtgtaaacagtaccatttccctggatcaagtagtttggtacacacgaattcatagctggaatatcaagtgcacatacacgagtattaaatacgaattattacatcataggcccgcaggcatagtcttaaatcatcggaccgagaggtccggaatacatccaaaagcagaaatagataaggcagcggaattcaggcagcggcatgccattgccacgggcaacgaccgtactaagacctactggacgccatcgtcttcatctccctcctgatagtaggcatagggatcctccaaggcttcatctcccgcttctgataaattttatatttgcaaggatgagtaccaaccgtactcagcaagccaccacagcaacaatgcatatgaaagggggagttcaaaggatggccatagttcttttgcgcaaagcaagttttgtaattcttttcacaagcctaagacctagcattgactgatcaaattttagtaccagagtttgtatttaaacaacgacggttct

SEQ ID NO: 7000 - DNA, 15620 bp, Oryza sativa
gcatgccaggaagggaaaggggctagggaaacctcgtcgaacacttagaggctaatgaatagtgtcttttccctatttttccaaattttagtttatttcctatatgaatttgattctataatttctaaatcttgcataaataaagttaactcaatatgtgtattatctcaactaatgaattcaccctagattagattaatattactcatattttatttttatataatttatttgagctttaattagggttaattcttattccatcgcaatgaaatttaattgatccaaatatggtcgcgataatattttatttattactatccacacctaatctttatttttaatttatatttattttaccaatttgtttttagggtttatttctaattaactattctttactcacgattaataatcctcgagatcaactccagataaaatagacgaatgagatcggcatgatgcaattagtttaaaaagtttttgaaaatccgtactcaaataagatatgagatattcttagcatagcctgactcccaaaatgtaaaaaatcatatcttttggaatgtccattgaattcatcatgccagacaagatggcaacaaagtatcaaaacatctcagatgctcttattatcaattttattaacaattttatacatacacacttccatatggttggatcactatttgagaacataatcctgatgggcttttcattagcaataaaattttttaaaactttcagtaaacgggttacaatcaaatcactaaaaaaatataactagccacatcaatcttaaaatatagtgaagcaaaaaaaaaggagtgtatgtaaaacaaaggaaggtgtacaatatgtataaaagagaatttcccttccattcaaattaatataacgtattaaatttacgtaaaacacagtactcactatttaccaaaattaacatgcacatccagttaaaaatctcaagcgtacaattattctgctcagagttagactcatagcatggtcaatctacagttagatgataatattgtctgaattcctactagcatatgacagttaggtttcgcttgggattcatttccatttttattatctctttggttacttgattgtccccctctgcttcaaagtcgtggccaatcttttccaacctccatggtcagcacctgcaacttcatcatcaacccacacctcgggcttctgttgcacctgatcgccctttatggttcctcgctaggccagcaatcttcatcaattacgcgtcgaggatctggcccccacttgtcggctgccggccgccggtaccgtcagatgatgatcctctacctagccgccatggaaactacccaccgccctctaccaactctcgcctacctcggtcgctcggttcggtctaccttgttgtcctctctatctttccactctgttttttcccttgtgtggatggcctaaggactgctctcgaggaggattgttgctattgtaaccttcttttttccagagtagcaacttacttatccattccatgggataaaaaaatgaaagttcagccacatttttaagtagacagcattttggggtttttttatattcttttcctaattagatggttttctagagttaccactaaaaagcatgttttagtcccggtttgaagtgtaacgggaatatatgatctttagtcctggttcattcattgtcaggccgtgacaggccccccaatatctttagtcccgattgtttataccaaccaggactaaatattaaaaaaagcgcgcgagcagtaaaaaacgtgcgtgggaggtacagagataaaaattcacgggggagagagccgaaaattctttatctctttctctccctcatccttatcttcttcaattctatctctctatcttcttcaccctcctgtatcctccttatctactcctcctcccactctactccctgttctcccctccccatctacatcgtctgcggcgcgcgccctcccctccacggggccggcaggcggcgccttcccctccgcggtgccgacgggcggggccctcccctttgcggcggcgcggaggcccacccggcgccctctcctcccctccgggggaacgcgggccacgcgccggcacggcccgtgcggcaccctcccctccgcggtggcacggcggcagcgacagcggcgcctggctcggctgagaaatttgttgtgtggatgaatttcttgatttgtgatgtttttgatgttgatctgtgatacgaatttgtggtttgtgatgtatttggatatataaatttaagatgtatgcgaatttatggatgatattgtgatatttttgtgattgtgcatgattttgttgctgagttcagtacgaaatcaatatgcaaacggtaaaaaccaatggagaaaaagaaagaaaaaagtgtttaggatagtgtcagcacgtggcgctaccatctttagtcccggttggtgttaccaaacgggactaaagatctttagtctcagttattccacccgggactatggacatctttagtcccggatttgtagtctcggttacataactggaactacaagatgttgcgaaccgtatgtaaagatgggttctccaccggtgaaacatgcacttgttcagattcataggtaaaagttattatattttaagaatgttgacaaaaaaatcgaacacaccggcctgggagatctgcttagctcctgtgcaggtccaaagattggtgagatgcgggcgtgccagtcagtttgatgctgcaactgacaagatatgcaaatagtagatcaaaacagtcgatcggctgacaagccgatggagtagttccagccgatagccgataccgatagctatagggtttaagcaatcggctatatgtccaatgtagataatgatataaaggcaatcggctgatgatgatgtaataaaataacaatataatctagtataaaccaattggcaaataatgatatgataaataagcatcgatccgaaagttaaagcacacatcggctggagatccgatgtcatgaaatccacaggattagattaaacagtgaaacctttgttgtcatcggctaaatccaacttatatgtatatgcaatccttatgagccgatgcaacgtccagataactcaccggctgaaaccccgatgaaacccttattggcaatcaagaagcaggctggagattatggttctaagcacaacttagtagatcaaacttaactgatgcagcactaagtatgaaaagaaacataatatctagacaatcaagccgttgactgagttttcaggatggtagatgtctaagctaatctattctagcaatgcgatttagccgataccgacagaaaccctaaaacgagaggcagccgatagagctaaattgatatgctaagactagattaacagagatatatgataaataggtaggcaaatatatcattcaaaccagagcaatccaagaggtcgaatgtactgatgcagccttgaacgacgccgacgtaaacgatacaattgcccgggctggcagaacattggacttaccccttagccggagatcgaacaccgatgcagccccgcgtcaggtgccaagtcccgtcggacgataaaataaagtagaaaaggcaaaaggtggcgatgcgccgaattgtattgatcgtgaagatagattacatagaccccgggtgtacatatttatacccatgggttgatacaagtccttgtcggataagaaagaaactttcctaaagataaaaggaaagataaagtccttataggacactaaacacacttttctaaagataaaaggaaactaacaaactattcctgattaatagataacttgtcatgccacattctctttgaactcggtctcttctggataagcttcctttagtagatcaatttccttaaccgaatatagcaaaaatccaacaactaaaaactaacaaagtattctaattaatagataacttgtcatgccgcattctctttgaactcggtctattctggataagcttcctttagtagatcaatttccttaaccgaatatagcaagaatccgataactgacgacttgacaactctcatcggctaatcccaggacttcgaagccgatgctgactctaagccgatgacaactccgggcttaccaaatttcactgttaacaaagaaatagggagtatatgattttggagttcggaggtgtatttttaaacaaagtgaaaggtttgggaggttaaatagacatctcaaatacaaatactcctagttgttctaaagtttgctagtcataggtctagtccgtacatgagctaacatatgtattttagatggaattcaactatttagtcccaactataatttaattacctgatgtatatatatactcaaaacttctttattcgaaattatttggatgtccatatgtaagccaatcatatcatgttgttgtgtccgcttctacaacaacacaaattactcacactttaatctaaggttgctagctcacaagcaagtgctagtttctaaattctagtagtcacacacacatattgcagtcaaatgattatatatttggctatctttatccataatcgaaatagggaagtattgtccctcactctaataaaacacaaatatattcaatatgattgaaaaaatatatattaaaacacaaatatgtgtttgatataaaaagctaacgtaatgtacattctcgctatctattataaactcctaccatactttgcctcttcactttctatataactaagatactagtatggaaaactatataatatactagtacggaaaactataccccatccgtctaaaaaaaaatcaacctagaaaacgatgggacactagcttcagattcattgtactatgtagtgtctcatccttatgtaggttggtttttttagacgaagggagtataatataaaaacattgagtaaatcaaatttttttatgaagagcagaaacatttttcattttactcctcatcaattctaagttagaagtattgaaaactatataatataaaaacattaagtcaatcaattcttaatttttgaggaaaactatataaaataaaaaacattaaggcaatcattttttaaaattttttttatgaaaagcagcatttctactcataaaaacattaaatcaatcaattcttaattttttgaggaaaactatataaaataaaaacattaaggcaatcaatttttttaaaaaattttttgatgaaaggtagcatttctactcataaaaaacagcagaaatttcagtcatcagaaatttaattcaagaatcaagaaagaatatgtattcccagctaactcaacatcttaatcaattgcttttataataagagtcataattccggtgataatctacgtctaaagttagtatgactggaatagctaaggttgcagttcttttatagctaatgttgttcaatcatctctcgttttaggcagaggctctgcagctagccattcctctcaacagtccaacaccatccctttcgcatgtaatcacgaacaataatattctgccgctagccaaggatcgaaggaatcatattagttattctatatccaaagcaaacttcaattttcgcatgtacatgatgaatgaataatcgaaactagaagctcatctacagatttcatttgcttccagcgtactgaaaaatgtaaattacatattggggaaaaaaataaacaggattaagggtatgaaagagagagactttatctccatttgcctatacactatgatggcttaactagctaccttatgataaaatgaaaggacgacagtaagacacccgttttcctaccaattactctcgcaataacctttaatccctgaagatttgcggtgttattgaagtcagctgaagaatctgctgttcaccccagccctgtaaagctgcatgctcccaggaccagaagcaaggatcctgacctcggtgtgcgccggcacgaagaaaacatcgccttcctttgcctttccttcatcaagcatggaatctgcctcaatcttgccttcccctgtcatgacaaggaagatggatgggccaggcaccggtgacatggtgaccgattcaccggagggcagcaggcagcgatcgacttcaaactcctcagatgggggtatgtagcgcgttacatatgcttgcactggaactcctcgcagaatctccgggtagttctgcataaggaagatcgtaagttatattacaatacggaataaagagcacaagattttctggagtatatttgaacattctggctgagtttgttcgtgtaatcaagctccacatgtttgaaggaagtattttccttgcttaattttgaagtgaacaagcaattctagaaacatatgccttgtttaatcactaagtgaacaagcagtttttccataacagtagtagtaccatacgcctttcttaattatgaagtgagcaagcaattctaccataccagtagtagtaacataatcaatgatgattacttgattagtgtagcatcagaagagttagaaacactaattgtcaatagacgataatcagataacagcgaatatcaacagaatataggtgatgcttatataaataagaaatcagataaacaaacctgcttgtatgtcagcatcgagcaaagagtttggacgtctctgtatttaggggtcagaccagcacgaactacattgtcagatgtggccatacattcgacgcactctcccgaaagatatgcatgtggttcattagcaccaatatagagtgcttcaccggggttgagcttgacatagttaaagaagaatgctgctaaaacaccaacatcttcagggtactgcatctccagtgacaacactagctgctccttctttgtcaaggttctaacctgaaaagaacattaacagcaaaacagttcaattgcagaatatcaggcttgaatctcctcaaaaaggaatatcaggtttggcaatatctttgtgtaagcatgtaacatgttgctgaactgctgatcctacctcagatatgaggctgccatatctgaaattctgaatacagagctaggaactgggtttcagaaagcagaaatgtgaggtagctcacaatcagaaccattgccttacttttttttattatttaagaccctcatttcaccatgttgtaaattaaaccagcccaatgctaccagaatctgtcatacaaggtgctgcaaagcctatgagttcaagaggtagtatcccacacacaatgtcttgtagccccaagtacatgaggtcaaatcacactccatcttaaccacacaattggattatatggcactaaagttggacagcaatattcccaaaaaaaaaaaagttggacagcaacaactatgcttttcctaaaaagtcttcctttgtcatttagaaatgaacaagaagacagatagaagctcaaacattttgcaaaacgtagcgtacgacgaaggaacaaactgatattgacatcccagctgacacagattataggcaagtgaaataaataatacatctgtcaagaataattaagagaatagtttaccttactctcaatattcagccgactctttagctttgagactgcttcagaaactgtttctttgcttgctgtcattaaattagtaaaagctgattgcagatatgaccttactccgatgcctccatcatgctctttggcacccataagcttcacagcctcttctttgccaactaactctcgaacctcaggtacagtcctcaagacatccttgagctcctgggttgcagtataataggtcagtacttaattttacaggtaatcaatgcttagagtcctaaaagctccaaggtactatgtagcccatattgttaacaatgagattctatagcatttgtaatctattttccgaaaaattggaaggatttaaacaaaagaattatattgaaagtgtattctatatacttcattataccttgtttcctactctgaaactagtcacacattgcgtctagctaaatatcggtcaataaagatgtgatacatctagccaaacaccagtcaatgaagctggagtgcatctagaattacttaagtcacatggtgaccaaccagaatctgaatttcagagtacacattgtacatctagaattacttaagtcacatgctaaccaaccagaatctgaatttcagagtaaacattgtacaagaaccaaatatgagcatattacccccccccccttgtttatttgtccatcggtgatgcatatgcaattcaaatagggaaatattactgcaacatatgaggttcagaataataagcagttggctacggctgttgaacaacaccctttttttctgtccacgaaatgcctgctgcctacctaagctagtaagcaagccatacttccaattgctgtccacgaaacggctcccacctacctaagcagccatacttgtaaacgcatcgctggatgtgatttggacagaatctacactatacatggacatggggccaacaataaaatgatgcctttggcgttgggggataatccattgcagcttgctggatacttggacagcatcaactgtttgtgaagcactggaccacagtacctcatgaaaggcgtgtgattttctaaaaaaaaaaacaaaatgaaattctaacctcatcttctctgcattttcttgaaaccaataaaaagtttgaaggtatattatatactactattatagatgacgatattttagcgaaggattaacaggttgttgggctgtcagtaagtacttgcccgttcgataattacagatcccattaatcattaatcattagttcgttgccaaattcatcagcagccagatccccacttgacatttcgatttcgacataagtcaactccgcccctcacacccacctacccattaggaatcatccatgggatctgctggcaacatctcataaacaatttcaaccaaccaaactaacaaaattcatgcgcaacaacaacatcagaactaatggtatcatcaaaaattcgatctcaaagtgcatcaagaagcaattagaactagtgattaatcagcgaaatgcgggtggtggaaaaccaacctggacggagacgaagccgcagagggcgcggaagtcggtgacggcgacggccatctcgggcttgtggttgtcgtcgcggtacgtggcggggcggagcgcgtggagcgccctggcgagggcggcgtcggggtgggcctggatggagagcgccctggcgaccgagagcaccttgaagaggaacgggaggtcgccgccccacctcgccgccacgtcgcggccgaggagcgcggcggggccgcgcctccccagccactccctcagcgactcccccgacgccgccagcgacgacggcgccgccgggtgcgtccccatccacagctccgcgtacggcctctcatcaccatcatcgccctcgccggcgaggcgcgcgacgagggaggacccgcgacggccgccccactcgtagtgctggacggcgccggcgaggcggaggacggggtgggaggcgtcggcgtggagatcgttgccctcggcggtggtggtggtggtggcggcggcgtcggtggggatgaggaggccgccgaggccggggatgccgagggcgagggcgagctgggaggaggcggtggtggaggaggccatttcgatcgtcgtcgtcgtcctcgtcggcggcggcggcgaagggttggcgcggtggtggtggtggcgatggagtggtggtgggggttgggttttatggcggggaaggaggcggaggaggaggaggagggagggggagatggcgacgtggggatcggagatgggaggtttcaagttggttggttggtttggttttggttttggtttgtttcgtcttccgtggtgtttgggggagggaagggaggggtggttgactgggggtggggccggggtgtcagtgacggtgggatgtggaattgtgacgttgttgtggggcccggtttggcggttttacgttgaagaccttgggagatccgttgtttatctttcttcttctttttttaactagcagtgtaactgttttttttattcggtttagtgggagatttggatctagtaggctgtttggttttcttttttttttacaatcttttttttagaaatgaatttttgagggtggatggtttttatgagaggaaagaggtttttatatagtagacaaaccaaaacagtaaaattccgatgggttacaagaaaaaaaaataaacaactcgacaaagcaaagtatggtcaatctcatggctgtctgaacaaacgcggcacacccacctccgcacacaccatgcatccctccaaatgaccggtaataaacagagcccaaacgtaggttgtcattgccgagcttatcacaaagcaacacgaaagctttgatcccgcaacaatcgtgtcatcattgtcgagcttagtcacgtctacaccgatctattttttgtttggaagccaaatggatggatacacaagtggagttgatctatctattttttgtttgggagtcaaatggatggatacacaagcggaatcgactccagcgccattggatatggatcaatcagaaaacaaagatcagcttgcagtgtttcgtcactcctcataattaagtggggcgtccagcaagagcattcattggctggaaattggggttttcatcctttcccttttttgttttcatctgcctaaatgccacctcatcaatgaccaattaatgaggcaatatatattcaactaaggcaactctatggaggaattaatcctccccacaaaaatatatgtttgagcattagacaaaagggtgggagcattggccaaaagtagttttgagagtagaagtttcataattaccaaaaattaacaggattatgttggcagtgacatgtttatagttcattgtctcaccaaattttggtattaccaaaatttgaaatggttcggaactgtaaggaagcgagtaaacccttaaatataaaaaggtgagaaggcaggaacaagatttcaccaagattaggattagacgatgttattctagatttttcaccgaaactatatccatagagttggtgttttttccatcgaaattctttggcacaagagcttgaatacggttgctgcaatgcgaagttgtccacctgaatccacgcaagagtaagggtgggtatttggtcagaccgaaaatttaggtcttggtctttcagtctattcggtcattatcggtcattaaaaagtgaagaccaaatttcaacgcaaaaaatatcaaaactagcaaattcggtctcattcctacccgaaattcaggagcagtttcatacatggaaaaaaatcatagcatctttcaacacaaaaatcacaaaaaagaaattcacaagcacgtctgaataaagactcttatggggttgcatgcctagaaagagtaggaatatgaaaaattagagtttaatcctattgaacttagtggattgtagtttgcattgagcattttcatgttaattcggtctattcggttagctggggagacaaaccgaataaaattccgtctttcactatctaggattgaatttctcggtcttggtcaggtcttttcgatttggtctttcagcttggtttttttttatgcccactcctgagcaagagaactcgaaacaaagaaagaaagaaaaaaactagtattagccaaaggtcacggttaacaatatgaaacaaaccagggactcagccgtaaatattccacgcacccggcgccatttcttttcttcttctccaatcgccaagccgaacccgccgcgatctcgggattgagagcgacgcgacgtgaccccgcggcactggcagccacccatgccgcacgcgcgagaagagcggccacggaggtggtctaacaaattctcgttatttttctaaactcttttttttagtttgggagaatagcactaagtttctttgtaggatcagtttagtccctaaccttttaaatggtccaaagaaatcattaacctttgtcataaggcctagaatagtcattgggttcaccaaaatcatcatatggatatgccatgtcatcattcatgcaaatctataatgaattgtccaatatactcttacatatatcatagaaaaataaatataagagtgaattagacataaccataggaaaaaaatacttcttttttcacccttttgaggtatatttttgctcttacatgtaccatatatatttttttaacttttttcttttgttttttatttacctatgcgtaagggtaaattggacaaatcatatagattttgcataggaaggtgacatggcatgtccatgtggtgattttggtgggatcaaggactatattacaatatgaaagattaagaactaaaatgatccaggagcgaaactttagggaccatattagctattctcccttttagttttaagagtacgtacaataataaataataagtcggctataaacttacgtggaggagataagagaggagatagaacagaaacgggttacatatttgtagccagctacagtacgaactctaaaacaaaacaccgtgtgtatgatatgtggaactaattattaatgatataatatatatttatagctaactattatatgaattgattattagattaactagaaattagaagttagtactccctccgtcccacaatataagggattttgagtttttatttgcaacgtttgaccactcgtcttattcaaattttttttggaaatataaaaaacgaaaagttatgcttaaaatattgtagataataaagtaagtcataaataaaataaataataattttaaattcttttgaattagacgagtgttcaaacattagaagaaaaactcaaaattctttatattattatgatacggagggagtaactgactaccctactccgtattaagcttgctctaaacccaacgagtggagactcgaaaggcttcaaattcccagacgtcaagggcggattgggggcgtggactgccacgtggcctaccgcaatccacggaggtatcgtggtgcggggcccacgcaaagagcaaagcgcaaagcgcgatgcgcatcgggagggccacggcccatgggggtggtcgacggggaagcacgtagatacgtcggtggggggcgaaacgtgcggcttttggggccccagatcccgatccctgcctcctgctgctgctgccgcggtcacggtccgctttttcctgcctacccgattcttgtggcgagacgcgagggtggagcgtgtgatgtagcttacacgttgactaccttttgctctcaatctctccacccataaaaaaaaacgacgttctgtaggacactaaatctatatagagaagagaccgtgtttagctcttttcaaattttttttaagtatataaacatatatttatatttaaagtattaaacgtagactaataacaaataaattacagatttcaccggtaaactacgagacgaatctattaagcttaattaattcgtcattagcaaatgtttactatagcactacattgtcaaatcatgacgaggctcaaaagattcctctcgcaatttgcaagcaaactgtgcaattgttttttagtccaaatttaatgctacatgcatgtgtccaaacatttgatatgatggaatttttagaagtttgaaaggaactaaacacagctagagtctatttgttgtaatagagaacgtcgtatcctattttatttagttttttatggaatggagggagtactattttcttctatataaacaaataaaaatacaagatatgagatatcttaataccaaaaatctagacaatatctaaattcatattactatgatatatcacattccttggtttcataaaaatagttttttatgggactgatgaagtatgtagaaagtactccttttgtcttgaaaaaaaagtttattttccatatatcctatacataacaataaaaaaagctagaatgccactgctctgtcaaatcctaatataatcattttccaccttttctactttcgatacatattatttcttaatttcacaaactccgattgctaagaacgaacttgtttctggacaaacgagacaactttaaaacaaatgaattgtgggatggagtaagcatgtagttggttcccgtcacacttttacccataaatattgtcacaccttagtaagtataagaaaatcttatcacgttttgttagtcaataacgtgtggaatctagtttgttagaaaagaatcttgccatagctgtgactacaaccatatcaaacttgtctaatttaatttagcaaatagatactacaatcatacccatctgattaggaaaaattagaaaatgagggtagtttattaccagccaaagaggattaatttaaccgatgaaaacatttcaaaattatggaataagttaaacgagcaccaagtaacaactgatgcgtcctaatttagcacaacagcaacataatgaccatactagctgccaaatgcaggatctgagttccccaaacccgcctttaggtcatgtaacctgattatcttgttcgggagagagatccactttgggctgagaagctagattcggtcgggggggcagaagccagaagcatcccaaacaggggcttaacctctcagcaaacgtagcctaacagtttcacactcactcagattaattctttgaaagataaaagctcccatgtaataatactgtacatggcagtaaaacacttggcaaaggaactaaaaaaatggactccaacagacgacaaatttacaataaatcaatgcttgagttacacagagacaaatcgaagggtagcggggcttaagctgcggtcgcttgcaacaaatgaatctctggcgttttacaaggtttctacccggccacacaaggcgaggccaggttcttagcgtccctgggccagttgcaacaggaaacaacaaagcggccactagctgaggtatcctcttcttctgcatgtgcgagtcagtagttgagagacgctactgaagtaactagctattgctgcggctgcggctgcggctgctgctgctgtggctcatgctgtggagtggcgggggagtctggagcgatggtgaactgaagggcatggccttgggctgattgcaggatgaatgccacctctgctgcagcaattgcagccgcttcctgccaaaaatacaagtacgaaagagtttagatgttgcatcgatgatagttatactgcaatgcccactagagtaattacggcaagtaaggccccgtttggcacagctccagctcccaacaaacttacctagagtcgagctgtgccaaacagtctagatcctctatttttgggagcggagttagcagagctactcctacaaaatgaactacgggggtggagctgggtttttgctgcttcacagctccactccaccccaaaagacccactaccctttaattttttaacttatttacacagaaatgccactgaactacccccaatc

SEQ ID NO: 7001 - DNA, 11554 bp, Oryza sativa
agttagggtttgggcgtttgtttttttcttttttaaatttttttttcagatctggagctgaatactagccaaacactggagtgaaaaagtgtttggagctcccactggagccagctctcactggagtgggagtttagagttaggagttggagtttggagtttggagccctaccaaacggggcctaaaacttccattccataatactacatcaagttggatagggatcatcacgtgattctggtgaggtggtgtcatttttcgtttttctgctaaacatgataagagtgacacaacaacccatcccattcgttaaaccaaccaagtggttaatgtgtcaaagttaggatcagatggtccaccaatcatttcattcctccataagaatagcccaataatgattttattgacaatcaatgagatccatacagaattagaagtacctgtctttgtcgccggcgatgcaaaatactgaatatccaagccatgatatagcatggcagcagaaatccagcagctcgaagtagaaagagctgttggacattgaagaacattaatagattttaagtcatgtaaaaaaagatttttaagtcaacattgagctcagaaagaaccaataagataaaaaaagtggggaaggaacacaagactaaccgagaacatggtagaagcatcatcatctccttcattgtctgagatagacaaagcatgcctcaatagcaacaaggccattagctggaaaagcaccaaggattttagaatgttcaatcttgagaattccagaaattcgagacaagccatttggctagagaagtcatacaaaggattgactagagaaggaggctagcttgattgcctatttgtaaaccaactaaaaatattatacttccattcattaaacagaactatgagagaaatgcaaggtatctctaagcatggttcttcaattataaaacagatcgatagggcgataggctatactggtgactggacaaattgtctggactctggaagtagcaatctatgaattagcttagcttattaagcacaacaggaccttgaattgttgtttagtacttactataagtgcagcagaacggcagaatgcagcaccactagcatcagtaccagcatattcatcatactcagtttcaagaagacgacgttgtgcagccgctacagcaataattcttgggtcacgtgcccaatcaccactgcaagccaacagtattgacttagaaatgttctaaattttcaaatttcaaaggcacttgaacacaatataatcaaatggacaaactggtaaatttaagcaaaataagtacagaaataacttacccgatatctatgatggtatcgtctggttcaacacgaggtggagctgtgtatccatgcttatattgctgcagaagaaaatacaagcctcaacgaaattaatacacaggaacggaaacacattggaaaatctacagaagactgaaagaagctacaggtattctacgagtataaacatatttgaaacataaacagttaatcaatcacaaaagcatgcaatgtaccagcatagtagggctctcccggtctcccctacattctcctaaaactaaatgctggttttaagctcatgaaaggaaaggaaaagatcgaactaatactaaattggaaggccacaactaagcacccatggaaaaactcaaatctacccaatttatcacgacctgtccccgtcactcagattacttcaaatcaactaatattgattaaaataaaaatgagctgctttagctctcgctccccaagcaacttcaaatggtaacggtgtaatggcagatagacaacactaaatgagttcaaggttgtcacacaaaagccatgatcctgtatggagtgaggcctatgtgaaagaagaagagcaagcagcacacatcaagaaaaaggtgcatatggcattaaagaggaattcagctatcgcaacagcaatattgtattggtgaggacgtgagattgcagaaagaacaagtcaaatcatcaggtcaaggtcagatcagaacatttgacaaatgaagtcctaagaagaaacaaatatactgcaatttggatgcacacatatcaaaataggtgctatcttagcctctagataagaactagaaagcaatgcgtagtaatggagtagtagagaagaaatcttactgacctcatgacagatttcacatgtaatgtctcctttctcattgcaccagcgttgcacacaagctctatgagcatactgtacatgaagaaagtaaaattgtcaattccagaatacaaaataattacatagataaaacatacaagtactttctcatatggtatacaagccaaggacaacacacattataagttagttgactacacagaagcagcctctaagttcatgtcaaacacacattatatccaaagaatagctatgacttaaaagcaaattccaagctaaaagaaacaaagcagataaagtagtaacgaatctcataaatttgcttatttaatatccagtttttcacacaaaatggactgggttaatggattataagattattaaggatctttaatcatctcatgagcttctatcagaaatatggaagaaatgtaatgaaatgaaataacaagacataactcaagacttaacagtaccagcagacggtacagaagagatcaataaagtattactgtgataagtcatggagatagttggggacagatggtttgagtagcccttgatatgctcccaatagaatattaagagataaaaatgcatttttcgttgttggatcaaactcaaaaccaatatatttaggctgagttcttttcttcactttcccaactcacctctctcattttccacgtgcatgcttttcaaactaataaacggtacattttttacaaaaaaattatatacggaagttgctttaaaaatcatattaatccatttttcaagttatttttagctaatacttaattaattaaacattaataaaccaccatgtttttcttgcggggaggtggaattccacctcccgaacacagccttactattggtggttgcttgcttgagtgtgggtttgcattacgtattgccattggcaattaatatgacgtaagaccggcccatgcactgtattgctgttgaaatttagtgtccaaggtagcatcataccataaagtagcaatgtggtgacccaactattgcttcaaaaaccattgcacaaaacactggtatgtcttatcccataaagattgtaaaatggaattcatagctgctttgtttaacggagtgctgactcaacttgtctttgcaaagtgttctccacaagggattgtgacaaacagatgatatgcaatatccatatccacatcacttccctatgagatcaaaggttggttcttcattaaaaagtatatgagaacaatccaacttgccatttgcagctagattcaggagaaagtgaggacacagtcacacgagcatgcttaaaggtacatacatgccatgcccgatactgcatagttattggataaaccaatttttttgtacacagcatgtttaaaggttagcatcctctacaggtagatagatagcatcccagtaaactatgctgccataggggtgaacaattttatccccatcatatgatatggcagtgatactatcctgaacatacatatacaaggcaattaaacaactacttcctccgtttcaggttataagactttctagcattgcccacattcatatatatatatatatatatatatatatatatatatatatatatatatgttaatgaatctagacatatatgtgtgcctagattcattaacatttatatgaatgtaggcaatactagaaagtcttataacctgaaatggaggtagtataacctatcagggaatctaatgtgataaatcaactttatctaacatggtagatcaatttatgtgcaagaaaaccatcaacttatccaacatgaaaatagaattgaaaaaccataatgaagccaaaatggaaactaggaaaagcactaccccaactagcctattcttagccccagtaactacatgcactgcatgaacaacaagctgcctacaataatttcaggaacataagaaccatatccaagatggaaataacatcaaaagaggaggagctggaccttgaggctgccactgcaagcacaaggcttctcgaggttcttgatgctatcctcctcctggcatatacggcactccgccgcctggatgagcggctcctcctctccaccgccctcctcgaccgtatcaacagtcgtagaaagcgacgcagcagccaccactgagctgttcacggcctcagatggcttctccacagcccctccatcgtttcccaagccttccacattcaccaccacatggtcgcccatcccaaattccttttctcctaacaagttaattccccaggagaatcaaattcctgcaagaaaccaacaaggcaaacaacgccattggtcaatacggggtaaactcgcacaagaggatggctaaaaatgggcatagttcgaatcgggcagtaaagcgaaaattcctgaaaaataaaaaccactccgtttactgtattggactactctaaaactctctagagactagagcccgtccccgaccgaaaccctagctacaaccaacccccccccccccaactctccacagcaaaattccccttctgagcgcggatcatacgaacaacccacccaatccctaccgaatcagcgccataacaacgcgaatctctccccgattccaccgtagaagagcagccaccacaccacatcacatcacccccaaatcgggcggcaccacacacatcaacggactccccaccgccgcgccgctcggcgacgggctccgcgcaaagagaaggggaaggggatcgcacgcacctacttgccgtcgtcgtcgtcggcggcggcggcggcggcggaacacggcgcggggtcggtctcctctcctcttccggtcgccgaagccgacgagaatccgctctcctcctcgtcttgcccccgattagttaggcttttggtcgtctcgactcgtctcgtgggggataaaaacgcggcgatatttttttttcttcacccaaactttggtttggtcgttggggaagaaggcgtgtttcgttcgttcgtggagtcgagacgagacgagtcaagcccgaggaggagcagctgtgtggtaaacaataaaatattaaattaaatctggattattattatcaataaatcggaagccgacgcggtgcaacggccacagcacggcggccgtctgccgtcgtgcggcacgggagccgcgcgatcaggatcggacggcgcgggatcgatggtctcggggtctcgggttgacggcgttacacccgctcgtggttttcgcagccggcaaaggcaacgggcggattccgcgtgacacgctggatcgaagcgaatcaaatgtatactgtatttttaatttcctgtcttttcgactaaatctcgagttgtattttaatttcctctctttttcgactaaatttcgagtgagaagtaatttatgttatgctggtaaatgttttcggacctcatcggtttgctgtggctgaggctgatatttagcacaagcccatcagttagcttattgtgctgaataagtaccagctattggtagtgtatttgatctttgtggacacctttttatggctgattatgctgaattgaaaaggccaatttagctgattagccaaagctgtagggttaccgacgagaaccttcgcttttgcattgcactaggtttgatccaatatcgtgaagtcaaaattaaccttgtactacttctttggttctttttgttggtgatggttaaaaaataaactaaccaacgttaaatgttatggtatagagggagttatttttaatgatcggtgatgcttctcgaggtattatttaggttttatcggatttcataagatttagtgatttacaaaggtttcatgtcactagcgtgtaatgtaagtaaatcatttagtgagatttttttttttaaaaaaagagaagtctcctccacttctatcaccagaaatgaaagtacgagatcgtttaggtgacacgcactctattttcaaagtaaaaaaaaattctaaacaatttagatttgaaatagatgcattttacctgaagcaaatgttttttttaaaaaaaaagaaaaatcaggtccttgtatttctcaactacttatagttaatcaagagtgtagatcacaaatcagaaggaaatcgtaacgccattcgtcagcctcagctttgtgacaggtcactccacgctgcctaacacgaaatcttcagcctagtcgtctccaataaatcaaaccgaaatcaacgaactggcaaaaatgttctagatgagaacatcagattgcattaatacttttatccttcaccacacgcaacatataattgaatcgatcaaagcaaagattcagatattactagaacagaaaaattacagtagaacaaacacgcctagaaagttaattaaacaaataacaactttgactaaaaaacttactagaaatgttataattaattgttataatattatggtgccggcgactgattatcagtcgttaattaactcccaaatcctctctttcatgttacacagggtgtagaaacactgtaacagttgtgtagaaaatagtagagataattaagtatacatgatatggtacaggtacaaagtctgaattttctctctgaagaaagtgaccatggatgaagttttctctgaagattttttgctgctgctgctcagtttctcctctcctgcccccatggcgagtgccgatcgttggcgccggagcccgggtaatcggtgagctccagttccatcctgccgttgacctcgccggcctccggttctccggcgatgacggcggcagccttatggatcatggttgagattgagcagacagttttgcaattgcagctaaacagaacatgttctgaaaagtagctactagtactacttgaaaacatggtgaacatgaacagttattacttatctgaatatataggttctaaaaaaagtgtaagctgatctctctctttttttttcaaaaaaaaaacttgatttaatcaaagttatgagatggaaaagagagctggacccggatcacctgatcatctcctctgctagagactggagttgcttcaaaacgctgcatcaccttgagggctggttgtgactcaaacatcaatattcagtcagaatgttcagatctcattatgttttactatgaatttctgaaaaaacaatatgccacgaagaagatacggaggcgaggaaccgagaagattaccaggtgggagtggagtttcagcacttgatgatgcatggatgaggcagcagaaggccaggagcaccactgccagatgaactgcaggaactctctccatcttgaagtacttttctactattcttctgcatccatgagggggtcatatggagcttcagaattgagctattttatagctcatttgtcatggagcatggagtcatagaggactctgaaacatcctccacaatcatgtgtttaggctagctgtagcccaatctctaatctgctataaaaattgactttttcttgaagtgcttcattagctcatatgatgggtttatttttatatctacaaaagtaggtgagcattttcataggcaatgagaggctaaaagctcttgtaatgaattcagtattggctaatcaatcaacctgtatgtgccctttcttggcaggtatctagggtagcatagatcgaaagccgcaaaaaaccgaatcgctcgtcatgagaaaagaagatacaacaagatagatacatatcgaaaaaagagcagatgagcaaacgaggaatcaagggcacatataaattggcaaagaaatgacaaggttagaaataaagcaggaatggatcaagaccacctaaaaggaggatgtgccacacaattgcttgcaaattgggtggtgacatagtgcagatgatgctggcagtttttgctgcttgagatgactgtgcatcagcagcatggtcaccaaccgtaccggcttttcttatcctgatgcagacaatgtgggcttcaaacttcaggtaaactaaagctagtcactttaagcatgatagtggattcggcactttggttagatagtttgttagcctctactatgctaaattgctaatatatcttatctgatgaagtaaacagtagttaactactcatctaagttagttcccgccaatagaaactttacagctgtccgaaagacttccaaacatcaaaatttgtttgtggtgaaaaaagttacagcaagcattagattacacttgcatgtagacaattttttttttgtgaaaaatatgagaggcttgaaataagtgctgtgccactggtatataggttatcactgaattcctgaacctcggtgagtcacaggcaatcaggcactatgtcacgttggtatcgcaaagcaccgatgaattctttctcgttttttgttcaggcaatgtccatgcaatgaacttgacatttctttgaaaaggatgagctgattgagaaagattgtgattgacatgtaaacaagaggtgcatactggatgacaccacacgaaatatatgcgcaaatgcatcgcggaaatttaagagggaagaaaaaatgaaacggaagatgacggtaaaaactcaaattttactttgtcagcttataggatcttgacttgttcagtcattggcagggcaggttttaccttctcaagttcttcaagaaacatatggcttctttgataattagacacatatgattcaataaaaaacagatgcacatgtgcatggtattaattcctaacattttagcaaagaacaagtctttatcaaaccagaatcaaaattgataagtatgaacttccagtcgatctacagtagtacggttgacattaaattaaaggaagaagcatttaaaccaaagatacgaatgagttagtttgcatccttctacacttcctctcaagtcttgagtctctattgaaaatgcttataaggtcttgagtcttgttcttctttccgacagcatttataggcttccctgaaatttcggtgcaacctccatgcttattctacctgaaaaattttcagagactgattctcctacttgggacttaataaaagttcagattaacatatactacatgacctaaaagaaatggattgctagccttgcctggcccatgatgagtccatgtaaatttcagaccgttttcaccctaagtacccaaaatggcctccactgacaacccatctccagtcagagttgatctgataagtttgtgcattccaacttgaaatacccagttcggaccggtacagcccggcccaagaattagtacccagttcatacaatttccttttgggtggatttcattcaacaacttttgaataatttatttctttcattcaatattcgtcagatattcagacattaaccttgaatatttaaccactgaccattttcagtctgttccccaacatgtacacagttaaggagccaatagtttctgaaaactactgcatcataacatagagcatcatcaagtagactactgtttgtaattgaaagagagaatcaaactctctgactcccctcctttccaggcaagttccaattttgtaaaagaaaattgcaagaaccaaacggaggcaaggcaagaccaaccagagtagactcttgaatctgtcagacaaagcagccatcttgcagccgtcctctagtcttccttccatacaaatgttctaactgggaaacatctcgtcacttgcatagttatttcagattgattctgttgaagccatacgctacaaaacaacatacatcaacaaggtttcctatataaccttcctacatggatttttcctctcaccaaaaccaccaagaaagtgaagaagcaacaaacaagagttcagttcaagaagccaactaggcaacaatggagaagtcaccggccatgcacttcctcctggaactggagtcccaagaaccggtttgcctcctcatcctcttcaccatgtttacctggttcatctcgaaggttcagatgatcctccctagttcttgccaacactgcaattatgccgtcaccaaggtgacctcgacaccggttctcgccgacagaaagatatcaaagaatctaagtaagcataaagatgatgggatagagatgacacatgaagatgttgagtctgtgatgacaaagatggggcctgattttgatcacggaaaaactatggtttacaaggagattggttctaactgcatgtcagagttgttcgatgacgatgaaccgagcttggacgaagtaaagcaggcatttttggtgtttgatgaggataatgatgggtacattgatgcattggatttgtatagagtccttaggaatctaggattaagagaaggtgtaggggttgatgagtgtgagcaaatgattgccaaatatgacatgaacagagataggaggatagatatggtagagttcattagggttctggaggccagttttttctgaattacttcttgtgtttatttcaagaactcacaggagagttatgccattatatctccttttttttgtgcttttttttctattttttcaaacaaagaattctcaaaaacagtactaattaagaatggttaggccagcgcattgctttttttctttttaaaaaaggttgtgtttgatttgaaatcattccatcttcaagacttgaattgtcaataccttactaagtccatgctattagttccatgcatgcaaacttctgtaaacatctagcaaatgtgaatagtgcactctcttcaacaagtgtattattcatgatttgcacaatgaagtcttgtggctcttgtattaaagggaaacataaatttgtagctcccagttactgagtagaatcactttattcctatataaatatctcatgtccgcatagagataccaacttctttgcaaactgtagagccagcataatgagaggaaaccatgcctttgctgcaagaacatttagtatactctgttggtcatgatagtgtgatagagcaagcatcattgaccaaaagagaaattttacgattagaaagtacctcgaggtacttagaggtacttcatatctaaaggtaccaaattttatactataaaatattgtattgggagatacattctcaaggatgataaaattatcctgaccaaaaacatcgctcgtaaaatgcatgctacatagctatgttcaatcttggcttgggatggataaggaattttgactatccagcatcgccacacacaacgaggccttaccacatgtcttgaatttaaattcctttacagaatattccctccgtttcacaatgtaagactttgtagcattgcccacatacatatagatattaatgaatttaaacacatacatatgtctaaattcatta

SEQ ID NO: 7002 - DNA, 5574 bp, Oryza sativa
atgcaaatatgttgttaaggtattcctagaaacataggtgaaactcaacccaatgtatgacacaatcagaagatccaatataaaaatttctaggaggatattatgggaattaaaggcacctctctaaaaatcaagatatttatatggttccttgaaaagaaagtgatcttagcaaatcctatcttcgtatagagttggtacctactaagaagcatttactcctataaaacaagacatgcaagaagccacatcatcaacaatttaagccattggatcgcattagtatagagttataagccgttggatcaagaagctagctactcatccatctaaattaatcattgattactcattcattcacctccttttagctcataatcacgcgtgacattgttatccattctgcacatccaaatcctcaaagatgataataatattttttttgttctaaatacaactccaattattacataagatgtgagctttattttgttataaacaattagataacatacaataattaggtatcattaatccaaactcatttttgaaacatgcttgagatgaaacagagaagtgctacactacctaattgtgacgatatccagattgtgcatgaaaataactttcatacatcataacaatacacaatgatgtttcaaaaaataaaacatgaattgtattgtaataacagaagctatatatgaagccacattatcatctattttgtatatacaaagagttacatctaatcatttaaaacattgattttattcgatgataaaactaacaaatcccgtggcaaggcgcggggtgccaactagtaataacaaaaactcatttaaaacattgattttattcgatgataaaactaacaaatcccgtggcaaggcgcggggtgacaactagtaataacaaaaactcgacctgtgggggtaagacagcccccccttacggtagtccatgtcccaacgagccttacagtagtccatgtcccaacgacggcgtgggacaaacgaggagatttttttaaccacagcccccgccttacggtagtccatgtcccaacgatccttacggtagtccatgtcccaacgacggtgtgggacaaacgaggagatttttttaaccacaacctaaattttgttccaagggggaattaaacacagaacctgagaagtgctactatagccacctaaccaactcagctagaggctccttgcatcttaacaaataataatcaaggtatttagcatccagcatgtcttatgaaagacataggttgctactgatacattacacacatgacaataaataggttcatatatacctttagcacgtggatgcagggcatagctggaatgaaatggagggcgtgccactcgcttaatttactatattttaaatcgagtttaactgatgcggttctctaagtttttatttaaaagggtacacatatagtgaaaataagtaatgtatagttaaaaaatttcttaatcgggttcctacttcctaggcacccctctcatatactctagttccacccttgcttggatgccattgaaacactgctagctaaaacataacttcgtccacaaattcatcgttgccctaagagtttgcagacttgtagtcatagactctggtgtgcaaactacagagaatacatgaagaatatttcctgaatgtcctttctattacctatctgtctcaagcaataggctttggaggtttcaggaaaccactgcatctgagctagagagatcaaagagtaatctggatttccttgcctgcaggtgttctcgatggcttccttgcctagtgatgccacctgcagcttgatgcaaagacggccattcacagtcagagccacgctatgccgtgcctcaagcaaccaattcaggtggtgtttacatccagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagatcatggatgagttttattaatagtctacgtttaatatttataattaattttcaaacatccgatgtgatagggacttaaaagttttagtcccatctaaacaggcctctatattttttctgttaagtgtagctgatcagtacaatggaattaaacgatgccagttgagagaaccaaaaactcttaatttgttccatagagttggtattcatgtttgtttatagctcactgcgggcagaaatcgcccgtcatttacgagatcttcaccaaggactgtcttgatctctcccttaacatcctgattctacaatgtaatgatgataattaagcttcagaacatctattgtctgcatagagaaggagtgctacatcctgcaatttaatgcaactattttcagaggactatttcacacacggctctcacactagacatgattcagactttcagtcaacaaggttaattatgccttgtcctgattttttcatgtcacactccagtatgcagagtagagatgtagagtcagccaagtacaagcggtccatggtccaatagttttatgtgttaatttgctagaatgaatcttttttgtttgtttatgatcataaaggcagcgagagatatatatacatagaacagatgtgtatctcacagtttacttcttttgttctaggttttaatttctccattctcacaaaccaaacatccggttctcttatattttttggactcatgctggatgttggtttgggaagcattgggagattggtgcgtgctgtcacggctcgactgatgccaacacttggcgacgacttctcctgctgataatgcttatgtcggaggcagtactgtattaagggaatgtcagttaatcagattagctgcattgagatgaagatcaggaacttaagaacacttgttctctgtatcatatacatctgtagtgcttcaactactttcatctaaatatatatgctgttactcattttgccttgtggtgcttaaccatcctgatatatagacagctagctcacaagccacttaatttggttctctgaagaacataaaattggtactaactggtaactgacgaagcactgaatctttctttcgccgattgtgcatgcagataacacgacataattttgggtaagatcatagtacaagtacttgcatagcacagtgaaatgttgagacttaacgccattaagttctctcaaatcaaaattaggaaaccactaatacttccctcacagtcacagacaattaaaaacactagctagctggaaaatggggaaaaggagagagtctgattggcaaagaatggaggcaggctgatggcccatgaagtcatttctctttgttttttcaatacattttccttttctttccaactttgtagtacaaccactacatggaaattcttttttttttacaaaaacatgacaataggttctataatatcttactgcctccattggaatataggctccaataattgtggtttatttatcttgtgttggtgtctattagtttgtgttggagttttgttaaatttggattgtgtcttgtgaactctgtggtgtgtgatcgcagttgagcaattttgtgtaataagtgattgtagctcttttgagcaaaggctaaatttatttacattatctatggaatatagaaggcacggtgttgaacatccaactttggctatcactttttcctaaagtatattatcattggcagtgagatcaaatatgaaagtacatttgaggcaaaattcaaatatacaacttttaacttttatgtcactagatttatatattgttaagccaattgctagttaaaatatttataatgaattgcatgcagtttgggtcaccttttattaccaacactttggaccatcctttattacctagtccaaagtgaaaatattgagtagattatggtttaaaatgaaattttggtaataaatggtggaccaaattgtggttcactctgagactttaatcttgaaattgcgtacaagtattatattttctagtggaaggagtagtattataggatttgtttttgccatttccaattttcttagttcaaatttgaattggatcgaaataattcggatttgctagcggaatatattcctaaaacagcctggaatcacggttttctgttgaaaccggtcggtttttactggaattaatggtgatccgtgactgtttatgcaaaccattgttcgtagttctgctgacacattgcacacatcctctcaagaaagaaaaatgacacattacacacatgacagtcagtgcataggttcatatgtacctccacatatgccacaatctaagtaatgaagaaaataatattggaacagagctagctataacataacgtggtcgagatattgatctttcccctagagctgtagctatgaagtctggtgcatgtgcagactacaaagaacgaagaagatagtaatactttctgaatgtcttgcctatcacccaattgtctgaagcaacaggctttggaggtatcaggaactactgcatctgagctagagtgatcacagagcattctttcctctccttcagttgtcgctgttcttaactctcatgcttctctcacatggccagaagaacgtacctacgtcttttggagctctgctcatccatagccatggagctgtgtttgagggctagcaaagcaataagcaactcagatggagttgtttagaacatagttcagattgctgactggatgtgggtatcctgaatccctcccgaaattgtttccaatcggttgaaaacttggatccattggattaaatttgttgaaatctgttatgaatttcgttcaaaattcgaaatttaattagtgagatatcaacacctcatatggacttgcatttaaaaactgagatagtacgaacgctagtatatatagtgttgattcagatggatatagcttaatgtgagagaagcatgagagaatctcttgtggatgatctctatgtctctctatttgtttgttactcatatatagaaaatggcctcaaataacttgggtgcactttatttctcctataaattgttatcacattttcttctactttcaataattaaaataaaatttctcgtctaagtttttctaatgatcaatcatggcatctttaatccgagccacagagctgccgacacattacacatgccaacaaatagtttcatccctctagaacatgtacatcttaggtggggtttgaatctcatgaaaatgaagataaagatgaagattaagtgttttacgtaaaacgaggtggtaataacatgtgattaatttagtatcttcacaagaaaatcatgtacataattaatgacaactacttaagagtctaagagcaagtttaatagtatagccaaccattagctccaactcacctatagtt

SEQ ID NO: 7003 - DNA, 14639 bp, Oryza sativa
ttgcgaaattgcgcccctagtaagtactagtagtctatttttaccctctagaacacaacggaagcatgatgaagatcattgatgaaggatcagtgataaagctcttcacagacaaactggacgtcaccaattcaccaatctgcccgaactctgaaaccgtaagcttggaaggcgttaggaactactgcatgggcctgatcagttcatcagcacattcgtgccttcttctatcctccatcagtccatctatccaattgaagggagaagaacctacaagaaaatctccggacgatcgatagtcctgcgcgccaatccgcatctctgattctttaggctgagttcgggagcctcctgatacggcgcataattaataaagtattagttaaaaggactttaaaaatagattaacataatattttagacagtggttgcgcttatacgtggtgagtttgttcttctccaatgacacattcacaaacgacgctgagatggagtagatgtggcatagaaggcgcggcggatgaattgtctgctcctagacaccaccgaattgaagtggatgctgttagttgagagatgttgttctttggccacatttctagttaaccttttcttcaactaggaaggattaatcacgcgggcatgcatcgtagattgtgtttgagaaacttatataggagaaatattaaccgaaacatataaaatatcatttggcttgtctggattatttgagaacatttagaaaaaaaacccttggtaattggtatattttatctaattaaaggcactcgatttggtaattggtatattttatctaattaaaggcactcgatttttgatccagtggctaagactattcatatttcactcgatatgggcatatgtatcttacattgttagtttaattataaagagagatcaattagataaaaatcaaatgtgtagcttataaaaaaacactatagttgtttcaatattgattgtttatcttatagtttagtagctaccaaaataaagaagaggatggcggtgtttttttgcatgtgagagggaggaggagatggagggactttatttttctaaataatttaagtgaaaaccgattataatatgtttctttttttctcaaaatttcttttattgcttttataacttttaagacatgacacatgttgacttaatgttttgcaaaaaatatatttaattgacgaaaataatgaatccatcgagttaatatgaattgttttctaatttttaagacgtaacacattattagttgaaagtactctgggatgtttaatcaatttttatcatgtaaacttatttatgacataatgcatatagtcaactttttttaaaaaaaaatttcattcttatttggtttccatgaaaaaaattggagtctacttcaagtgatgtattttaatttatggtaaaatatggataatgatgaacttgaattatttatttagttacaaataaaacaacaattgaaacaaactaaaaatcatatactccctccgtcctagaagataagaagtttctagggttggatacgattattaagaaagtaggtagaagtgagtggtggagagttgtgattggatgagtagttgaggtaggtgggaaaagtgaatggtggatagttgtgattggttggaaaaagaatattggtggagaagttgttatattttgggacaaatcccaagggctaaaagttattatattttgggacggagggagtacaacttttaaaattatagtcgttaagctatctgattattgatttttttatatgatgtgtatgtgtggggatgttcatgtgaacacatatattatgtgtgaagggttggaagtgggccttttcgctttttatactgttaagatatcagttgaaaataataaggacaccgtgtttaacttaaaataatcaatggttaggttttgtacaagttaaattatagtcaacgggtgcattaaattctaatttatgattttaatcataaatagcataattacacaaatataacgtataatttggtctgatagaaaaaaatttcataaagaaaaaaaggaagaggggacatctccttttcaaaaagagaaaaaaatcaatcttatcctgcggcttggagtggtgggcctattaattttagtaaaaattaaaaggctagttatttcttttttctcatcttttctaagattttatctaatttattaaagcgccacgtagtatcataggagtatttatatgagcgtcatgtggtggcttagaagtgtttataggaagtttaatggacttttattatataatagatagatagattgattgattgatattgtcgatataattcagcgacacatgtttgtagaattatttaaggtgacatagtatatgttgtcaacttttttatattttaaaaatatttcattgttatatttggctgccatgtaaaaaaatagcccatagaacaacatagatcttgaattatttatttaattataaataaaacaacaacaaaaataagccatgtaactattgaaattggaagattaggaaaaggtagagaatatgagaggagggagtacgtaacgtacgtactaattggaggagggtaacataccagcgaggaggggaggttgggaccggtaccgtgaagagggggattttatttatttttattactaaggccctgtttgattcatcttaagattattataatctagcttattaggagtaagctgaaataaacaagtagattattatagcagattattgtaatctataagccagattattataatctaataagctgctctaaaagagcttttttcagattatcgagtggctaaagacccactactcctacatacttgagaaaaattacccacctatgccatcaaccgaacagatagctgggggcattatagactttagcctttcaaacccaataatccatgcctccaataatccagacaaacaaacaactcacagcttattctatatcagcttattataatccagcttatagcaatctggtttaataatctagattataataatcataagctgaaacaaacagggcctaaatctaatggttgaaaatattggacccaccaatttaaagaaaaatcaacggttgtattttagagtgccacttgacggcttatgagcgtttgtaggagtgacacatggcggtttaggagcgtgtatgaactaattggaggagggtaacataccagcgaggagggaggtggggaccggtaccgtgaagagggggattttatttatttttattactaaatctaatggttgaaaatattggacccactaatttaaagaaaaatcaacggttgtattttagagtgccacttggcggcttatgagcgtttgtaagagtgacacatggtggtttaggagcgtttgtaggaagtttaatggacttttagtatataatagaagatagatagatatatagtagcagatttttttttaataatggattaaaccaatctctgcacccaaggcaaatgtacacaacatatagtactagatagaaaatgaactaaatatatagtactagatagaaaatgaactagtaaacgggtttttatatgctgctagcgggtttgccgacatacatacattagccgtcataggttacaggagcaagacacaaatgatgttcgcggcgcctctggaaaaggtaaccacaggtaattctaatctatcactaggaagttcatcccgttttcattggacactgaaaattcagtctgcgcctgcgtgcatctattaactggcagtatattatatatttatgtcatattttattagacatctttggtgccttctaatctactccttctagatatagagtaatgtctacatttattgtactatgatgtgttatatcctagtacgtacgaggttagtttttttttttttggacggatggagtatactgattctaccgtgcgatcctgatgaatgttcaacaaacaatattgcatcatggtgcatataaagtgcaaaacacgatctcatgtagtttgcgaacatcatgaacatgaaatttatcaaatctcaagtttggcaaattttgtctgccttgaataaaactattatagatatctagtgcacctgtttgcaccggctcgtgcgactgtcgttccttcttactctctccgtccaaaaaaaacttaacttctaggctttgaactttgtcccacaaaaaaccaacttctaccatctacctaccgtcagcacgtaaaagaataagttttattccttcaatagtttttacctacctatcatcattactacttttttcaataatgaggagcattttgatcattttcactctccaataattttgcattgggatgcttgggactgagggagtagctttttagctagaggcgttattgttggagggtctttatcgcggttcaagtgttgctacagttgagtatgtagatgacaattgtttgtggctgtagctcgccgcggaatgatattaatttgctgtcgtcatggctttttctttttttttcccaccttaataaatataggttatgttcatcctatgcagaggagaggattggtcttagattaagtgtattactatcttgttgtaatagtctgggatataaaattcctttatcgtaaaaaaacatttgcaccgttgcgcagattaataagatccttttcacaaaagagctatgaaaataaaaatgttgtacataccataagcttgccaaatgaaaaaaagaaacagctcaagcaaggagggggctatgttttctaagagattatgcaaaccaactcctggaagacttactgtaaagtatttgccatactgcccatatgggtggtttcaaacaaaaaaggcaaaggacaactgttcttagtttggtttgttgtaaaaaagtaagaaagtaaaaaaaaacttcaagtgctttctgaatccttattgtgaatgagcttcatggaaccaattgcgtgttgccacgttaacattgagcgaactcatgttgactgctgagcaaatctggtaattgcatatctcagctaggtcatgcaagatgaacccaaacaatcgttcttccatataagaaaaaaatagtcttatacaatgagagcatattgaaactcttcctattcaggattaaagaaacataccaaagtacattaaaagcttgaagggtacgtggaaaataaaccattgcatcagaaatagtgcccattgaaacattaaagaatctagcttttcagaagttcaggcatatatagcataggtgtaaagtcaaacaaataaatagtaatttgacaaaagaaagatacttgagatgggaatttatcttacaacataaacagatatccacagggaattgcatgagctagtgtaaatcctaatggcctaagctgaagacctggacaaaccaatcacaacagggagcaaagatcacctgatcaacattagtcaatcccgatataaaaataaattagtgttgaactgacgtcggaaaactaacatggtttttttcctcaacaaacttgctggagtaattaggaaggatcaatcgaacaaaccaacgtaatgcagataatcgtcattttgacaaacggtcagcagctatatataaaatcaagttgttgggggtcaaaacatcggcaaggtaattcagcatcaccgaggatgagaaacatagattagtagttgtatgcacttactgctttactgaatcaaagggctggttagcacgctgcttgagcacgaaatcctcctacatgaacaccatgtaatccaaacttgagatgaatgcaaagaaatactgggaaaaacgtagggaaatcatcaaatatgctccctgacaaacttgtgtccggcaacaatgacgacgccagtggccaggaatcggaagggatggagaagtgaatagattgaactacaggatgagtgagatatcattttctaaaaaaaaggatgggtgagatataagcctttattgggtcgtcggtttctggtgatcgatgatcatggtttctggtgagggaggcgaagaggatgcttttcatgacttaatgtcagccatcaagacttctcgttggttggcgtcggcatttgccgcttttcatgatacgtacgtcgaggaagcgagcagcctggaggagtcactagtaaaaaaaacctcatatagatcagcactataggtgccgaaatagctaaaaccggcacctataatgcttttccctcctccatggactcaaaacacgtaaaaccaacacctttaagcaactataggtgccggttctcaagaagaaccgacacctatagtataggtgccggttttttttaaaaaacaacacctttaatataatataagtgtcggttttctaaaaagaaaccagcacctatccaaattgagccgatccaggccgacgcatcggcctcatcctatattagtctcgtccttatcagcctcatcgatctcttagtctctctctcgcctctctcgatctctctggtctctctcgttctctctcgcccctctctctctctcgcctctttgtgtagcgcacggcggcggtcgggcggcgtcccggcggaggcgtcagtggcggcggtgccctcccctccaccggatccggcggggggagacggcgggagacgggaggcagcggcgccctcccctccgcttgatccggtgggagggaaggcggcgggcgacggcgagcgcccttcgctccgctggattcggcgggaggggaggcggcgtgcgatggtgggcggaaccaaggagagggaacgcatgcagctgttgagccgggtggggaaggtgacacagaatcgtcggggagatggcgcggatgagatgggcccgcccggaggaatgcccgtcgcctgcatgcacgcgggagagttaacgttttggcctatcgggtttttctgtgaatagcgtccaggatgttccactgaggggacacgcaggaccatcgatatttgatcaaacggatatggatcaacctgatgtaggcacacggaggaccatccagatacgattgaatgggtgtgatcaacttgatgacgtggagcaaccacagtgcaggaaattagtaagtggggataatttgtatagatatataggatttcaggcgaacatggggtgatgagccacaacctatacatggcctctaaggccaaataaacgtacatatcttaattagtgctagctcttgaatatggagaaattatgtgattaattaagaccttctaattatctgacaatgagtactatatcatgcaatttaatgcaactattttaaacacaagacatagcttcaggctttcagccaacgaggttttaccttatccctgttttatttttgtcatttcagctcagtacacagattagagatgtagaatcagccaagtacaagtggtccaatacttttatgtgttcatttgttagaattaatgaatcttttttggtatcataaaggcagcgagagatatatatgagaacagatgacatgtatatatatatctcacagtttgcttcttttgttctaggttttagtttcgccattaattctcacaaaccaacatgtgtttcttttatttttttggactcatgcagtcatgctggatgtaggtttgggaagcattgggagattggtacgtgccatcttggctcgagtgatgccaccactccgcgacgactactcctgtagatagtgctgaaatcggagggattgattgtacgattgcacaccaataagtaagccaaccagagggggtaattcgttgtagtactccaaaaccaaaacttatagatgaattaaaagattcccttgaatcgatgaagatcggtctgaccggagttgatgcaggtctgaccacctagaagccaccagtctaactggtgtagtagctccggtttgatcgtcaatcaccggtctaaccgccgttcactcgccgaaacctaagtaaacacaaatcgaaattctcccaaagtagattgaactttattgtttctattcgtgtttataaaatgcaacaacaacaatacggctgtcatttttttttctaaagtaaaatatcattggcagtgcgaacaaatatgaaagtacatctgaagcaaaattcaacgatactatttttatatcactaaattttatattgttaagctaattgctagttaaaattatttgaaatgaattgcatgctgtttgggtcaccttttattaccaacactttggaccaccatttattacctagtgcaaagtgaaaatactgtgcaaattattgtggtctaaagtaaaaaattggtgataaaattttgtaataaatggtgaaccaaattgtagttcactctgaaatttatagactttgactcttgaaattgcgtgggcaccttgtattttctagtggaaggagtagtattatagttctttttttttgaaatttccccaaaatttctttattatttcaaatttgaattggatcgaaataatttcgatttgctagcggaatatattcctagaaaggccaggtatcacggctcaccgtggaaaccggtcggtatttaccgaaatggtgatccttgactatttatgaaaactattatttgcagttctactgacacattacacatggcctctcaaaaaaggaggacatattacacacatgacaatcgatgcataggttcatatgtaccttcacatatgccatggtcttatagtactgaacaaaatagtatttgaacacagatagctataacataacgtggtctagaaattacaaaagatgaacaaagattatctcaatatcttgtctatcacaaatttctttgaagcaacaggtttgggaggtatcaggaactagtgcatctgagctagagagatcagagaacattcttgccctccaattcttgcggttcttggcactctgctcacactggaaacaactgtcaccgcgcattcatgatcactgacgtgaaagaggaaaggattgcacggctaagtgagaagatccaccgatgaaaagacttgcgtgttttcgactcatccatcggcattggagctacaaagagtaagcttgatggcaaacgtagcaacagccaggacataattaatttagatggagttgttcagaacatggttcagaacttcagattgcccacttgacattggtaccatggatccctcccaaaatggtttattatcaatttaattttctcctcatttggttgaaatttgttggaaactcattcaaagttcaaaatcgagtgagatatcaacatcacgtatggacttaaatttcaaaaactgatattgtgaacctggtatagagttgactcaatggatatagtcaatgtgagagaagcatgaaataattctctcttggatagtctctatatctctctatttgtgctatgtatgtagtagtattttctcaataaataactgtaaaatcaatcataagcaacactttaaaatatcctatatatattgttatcacaatttttttgctattaccaattgaagtaaaacttctcgtccataggttaattttttctgatggatctatcatggcatgactaatgcgagccacagagctactaaccaataatttcatccctctggcacatgcacatgccacttatagataaaaaagaagaacatataattaatttgcaaaaaagatatcttgtacattagtgcatatacatttaataactggttgctaacatacataacttggtccataaattggccttgcaaaattgcacccattgttgacttaaaccgggagacgtttatccaactgggagaaggccttgctacgtctcaaaagctagctaaagaggtgagcgacttcctccacttttaacctgattcaattcttcataaactattaatgtaggactattcccgacaccactaataagtactagctagtagttgtatttttaccgtctagaacacacaatggaagcatgatgaagatcattggtgaaggatctatcagggataaagctcttgacagatattctttcaaaaaaaaaaagctcttcacagataaactgcacgcatcaccaattcactaatgtttccgaactctgaaacagtaggattggaaggcgctgggaactgctgcatggacctcatcagttcatcagggcatccttggcttcttctgtcccccaaatttccagttgaagggcgaagaacctacaagaaaatctctggacgatagcttcaggtcccgtcctgccaatctgcatgcatctctgattctttaccagaacgcgtatgttttgaccatccaaagttcctatgcatttgatgtgtttttgaggacagtcatgaatatgaacatgcatgtaaagtgcaaagcatgtcctaatgtagtaacatcatgaacacatgaaatttagcaaatcaggttgtcaatttttggctgccttgaataaaattattatatctagtgcaccgctacaatgatggcgtgtgcacctgttgttccctgtttttggagggccgttatcgtggttcgtattgctatagtgtggatgaaaatcacttgtggttgtagctcgctatggcataatatttttatatttttaattagattaattttatcatcttgatgtattgtctgagatataaaactttctttatcttaaaaaaatatacactgttctgcaggtttaataagctacttttcaaaaagagctatgcagatccagtgatcaactggtattaacaatttgtaaccacaataatgtacatagcttaattagtgctcttgaatattgagaaatgatgtgactaattaagataccttcttactttatatatatgacaaggagtgctatatcgtgaaattgaatgcaactattttcagacaatttcatgatatggtttgtacgcaaggcgtagcttcagactttcggtcaatgaggttatgccttatcccaattttcattttacactctagcatacaaagtagagatgctgaatcagcctagtacaagtggtccaatacttttatgtgctcatttgctagaatgaatctttttggttggtgatcataaacatagagagaggccaatatatatgagcacgcatgtgtatccactgtttgcttatttgttctatgtttcaatttctccaccatcagaaaccaacacatctggttcttctatcttttggactcatgacgtatgtaggtctaggatgcattgggagattggtatgtgcagtttaggatgtcgactgatgccgacactccgtgacaactactcccattgatagtggaagtcagaggcacaattttaaggaattctatcagataataggatcaactgcattgaagcagaactcaagaacatgcttactctttaattggatcatatatatcttttgtagatagtgtatgctgtggttgtaactattctattttttttttggccttgtggtccttgactttcactcactcactagctgtatcggttgataaagaacacaaaatagtagctaaccaaagatgcaccgtatcactccttggccattgcgcatgcacatgtagacaactagaccttttaggtaagatcaatacaagtacttttatagtactctgaagtcactacaaccaactctagatctgtttcctttatccacaaggtcttaacacctgagaacctacttatccgacattggtcgtgcaattgatatgttccctttgctaaaatctttcgaagacatgaataatctttttagggactgcgcctactctagaagagtctgggatttggtttcataaaaaaaaatccatctaccacgctgaggcagactcctctataaagaactcgatattcaaactaatctcgtcaagaccatcacagcaagcaaaaagaagtcttggagctctactcgcttcctggtgcaacatctagctagagaggaatagaaggactttccatggtgcaaattgcgatgagatggaaatagtcggccacattttagaggacttagaccaatgagctttagcttttaaacctccgtaaaagcggtgttattttccccatgtaacctctcaaaagttgtaacctcctctattctcccttttcccagaaccttttgtacttctgaacttttacttctcaatatatccggcagagctcctgccgtcgtcaatttcaaaagaaaaaaaaatattgagcactaaatccctttaggtccaccgaatcaaaattaggaaatacaaagctgccgcaaaagctggatagaggcaaataatttctattttgaatggtagaagtagaggattcataattgataaacggagatgtgaactgtgttagctcaaaaacatatccctaagatatagtaacgaaacatagatgatcatcttacaggtgaaaatcatctagaacttaatgtctttagtgctctactttctacccaatgtgacataagtgtcgcatgcatgcctaaatcatcctgcacctgcatagtgtcctgaaacaccaatcaggtttgtagatattatgaatcttaagcaattctcatcactataaaaacgtgaacctacatttcttcaaagaatcagatgaacacctactctcttgattctttaatagaacaatacaatttctaatggtaaggtaataatatatcctagtttgtctgatccataaattggctgcggctcaatggctcccctagtattagctctgtacacgtttacgcacacgttgtaaggataaggaagatcatttgatgaaggatcaacgatgaagttcttcgcagatgaactatcaccaattccctgatccgtcttaaaccataggcttgggaggcaccaggaaatactccatctgcttgacaaatagctcgtgtttttcttggctcattctatcatggtagttactctccatcggagaagaacctgcacgaaaatcttcagatgatccaccgagtgcgaaaactgattgccatagtgttcatggcaaccgctcatttggcgaaattgtatctgtgattcttcacctgtgcatttcacgcatgtggtgaatttcaatgtgcttacgtttttatgttgttccaatatttttcttctcacactccatacacaaagatgaacatttctagttgctgcagagatatacttccattggctaaaaacaaattatacttagtttgcacccctagacatgcattcaaggtcatttctagttgatgcagagactaggggatatacttccatttgctaaaaataaattatatttagttgcaccctagacattcaagtccagctagagccataacttggtccataaattgcccatagcccaattctgccccttgtatttattgtgcctttacgttttggagcagggagccctgaaacaacactcaggtatagcaccatttttttacaaatcggtccttttggaaaacttatttcagaactagaccctgctaaaatacttcaaccataaataggccacgctggcgcggaggttagatggatcagcaccagggacgttggcgctgaccccatgctaatgcggcggctgagccgattccctcaccagcgtggcagggctcaacgccaattactctaatgctgagctcttggacttagccactcgcgacggggccgccaaacatagctcctgtgttgagtggtgtcacaccctgaagttctcctcctaagcctaaaattgaatttataaatcaccctaagaaaatgccggtgcaaatcaagagaaaaccttaataaattaatgcaaataataataggaattggcatgtggaatttttcttgagttctacatgtcgaaatacgctaacaagatttttagtggaattttcagagctctcaaaataattttaaccaattaaaattgagcacatgcaattttaatcccaggaaaaatcctttttccttctttttcctttttctttcttttcttttctctttttcctttgaatgggccgccggcccattcctcctttttctccccctcctcccgctgggccggccgaaggccaaggcccagctaggccgcgcgggccggtcggccgcctcctctcacccgggtcgccgacaggtggggcccacctatcggacccgtctcccacctcgcgccgcgccgccgcgcccacgccttcgccttctccgggccacatcggccacgcccgcgcatgcgccgcaccttccgcgcccactcccctctctcttccacccgcgcctgcgcccgagatggccgggattcgattttcgaataccgcctctctctcctcccccactccccgcgttggccggcggaatcctgcccctaccggccacatccgggattcccctcccctatttaagctccgccgtcgccccctctctctttttccccatttcgccgaactccctcgtgccccccatcgctcccgcgccgtgcaaccacccgccgccgccgcttccgttactccggtcgccgctagccgccgctagggtcgccgccgcaccgcgccgtcgctgccgtcgggttcgcgaggccaaactccacctcgtccgccccttccccgtcgggattcgtcgccggaattcgcatcccctcgcgctccg

SEQ ID NO: 7004 - DNA, 2077 bp, Oryza sativa
ggccactctcggtgaggcatacctctctcctctattcccctccctctcctttctagccggcgcttagcgctgtcgccttcacgtcgcctttgcgccgacggctccgccgccggttgcggtcgccggcaacgcgtgcgcgcgcgccgtcgccatcgccgtggccggtcggccggccttgagccgagccgagccgggtcgccgccgcccgtccgatcagccccgggggcgatctgggccgtcggtcccgtggaccggcggtggaccacccgcgtggtcccggtccacggtggaccgcccccccttgagccgctgccgagtggggcccgcgtgccggcgccccttttccctctctcccgagccgctgaccggtgggccccgcatgtcggcgccgcgccccccttgatgacgtcagctctgggaattattgcgcaataaattatttaaggactttctgttatagtaataaacatagtgaatcttctaaaattcataactaattcatccgagctccgtttaagcccattcaagtctcagtaaatcaagaaaaatgcgtagaatccattaaaaatggttttgttctctgtttcagtagtcttatagcctgtttgtattgtttgctttgtatgtcgcctagattccggttcttccgacgctccggtgtacttcgagatagtcgccgaggttcttccagcagcagagcaaggcaagtcatgcctgtcacttgaacatgttgatcctatattgcaaatgctctattgtttttcttcaaatactgcatcgttttataatgttactatgggatgtttacctattgttacagccatgctattttggtaccctgctcctttgttagctcgggttataacatgaatagacgttggactaggagttgcttagccatgcttagttcaactagcacacaatgggaaaatctcatttaaaatatagactgtaggttcatatgataatgttggtttagtaccaccgctttggtgttggttaattaaaatgaatcacatagagggctatggatgcatggttttgcttgttgcacccatagcaattaaggaccgattcgcgggaaaccctggaagaatttatcgtgcttaccacaagccagcgtgggcaacggctgggcttgtagtgtagcttttctctagctgacgcatccaggcaagggtgggcgtgatggagtttggataggtcctgcgacggcctatgcggcttccggattcacgtaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttagtcttttgaaattggatagtataggtggatggttgggcctgtcgcaacgtggtatagcgttggacagtggatgattaatattgattaattattacgactgttttcttctttaaaacttctatttataaatgctcgctttatgcaaatgaaccactctagctctcctttgataattccctgcatcatacccctattccggtatgacttgctgagtacagtgggtagtactcagtcttgctctattttccccaaccccagagttcgagtgtgtgtcagatggaggtttctccgaggagtaggcttcgtccgtgccgtcgaggatgcctgtggagtggtgttcccgttgcagttctagtcaaggcttaggtcctgttgtctttcgtttttccactgcttttatgtaagacttttatgatgtttgtaagacgtggatctgaatgtcaacattgtcgtttgtgtaccccggccggtcctggacggggattttaatgcacattctgcttggaattctatttgggaatttctgggcgtgacaagtggctcggaggcgatgggtgttaagccact

SEQ ID NO: 7005 - DNA, 4254 bp, Oryza sativa
ggacttagcagctcgcccgcccaacacagctcctgtgttggactttgtcttgagggttcagcgccaatacacgtgttgctaaggggaatcggctcggccgccatgtggacaggggggttagcgccatcgtgcttggcgctgaccaacgcggttggcgctgagcccacgacctatttatggttataatttgcaaggtctagtttgaaaataagttttccaaaagggtctatttgtaaaaaaagagggtatagagcactataaaaaagtgaacctacacttctcaaaaggatccgatgaacactacattctctcgattcttcagcattacaatttccaatatatgctaaggtatcatcctagtttgccttgtccataattaaattgggcatggctcaattgtgcccatagtattagttttaaacgtttatgctctagagcacataatgaaaggataaggaagatctatgaagaatcaccacatgtacatcacaattcgccaatatatatattctatctgaaatcgtaggcttggggtgcgttggaaactactccatcagtttgaagagagaaaaggggtattcttggctcgttctgtcctggaagcctgctttggatgggagaagagcctgcatggaaatttccccgagatggatcgactgcaaaaactggctgccatactgatcatatggacatagaatcgcttcaggtcatggtcgagtaatatgcatcttcgatatgttatgtaccttgtcaaccttgtgcatttcttgcatttgggatcatcgaatgtccaatatatgcatcgattgatcttccaatgatattcggtacgcttccgataaagttaatcacagccatcattaggatgttcgtctcgccccattggacatccagagagttcggggctgtgatcatctcttaattggcagaacacttacagggtttacaatttcgaaatggggatttttgctggggcctccgaaattaccgaagtttcgggaattttggtacttttttttgctgaaattatatgaaaatttgacaaattttgaatgaatttgaataaactttgaccaaattcataaaaaattggaaaaaaaacgaatgttcagtaaacaatttaatttgcatcatgaacaaatgcatgtattaaagtggaaattgcagaccacaacctgctgctgttacatggatcatcaattcttgatatccacaattaaagatggccatgcttatcattaattgttggtaaaatacatagaccaaatgatatacttccattatctaaaaataaatcacacttcattaatttgcaccctagacataaaggtcagagagatacaaccttgtccataaatcaacaatggtcagattgtgtccctcgtagtactagtagtagataatttttacttcttggataattaaggaagattataggactaaggaatcattgttgagctgtatgtgcatcaccaattcatcacaagtctgtctgaaatcgtaggcttgggaggccctgggaactcctgcatgagccacagcagtagtatgaagaattcttggctcctcctgtcctgactgaacctcctgccacgcacaagaatctacaagaaaatttccagaaaacaccatggatgcaaacaatggtttgtataatgtgcaacattaaccccctgaaggcttcatcagtcgatttccagatgactaggtagccatcggctcctgcctatttcagggtgacagttgttcctgtgcatccaatgtgcatgcatgtcctgcgacagttgttctgtatatgtgatacactgctacatatgcgtttacgagtgcaaagcacaacttggtgtagttacttacatcatgaacatgcaatttggaaaaacagggtttgacaatttggctgccttgttgaacttagttttctagggctctcgttcctcttactccctccgtctcaaacatactttgatcattaatttatttcatattatgctatcaaacaactataaaattaatatcacacaaaagtatttaaaatacaaatcaagtgatataaaatatataatacttagcatagatattgctagtataattattagtcaaaatttactttcctagaaacaagggcaccctgtaatttgggggcggatggagtaaataacaattaacctgatgggtcaatcatagcatgcatataatgctagccacagagctactaacacattattacacgtgccaatcacacgaataggtgaaagaaaaacatataatttattttcacaaaaaagaaacatatacataattaatagcagctaaggcacatatataacttggtccataaattggcctttgcccaattgtgtccctgactagtagttgtacgtttatgctctagagcacacaatgcaaatacaatgaagatcttctcaggaaggaccatagatgaaactcttcacagataaactgcacccaattcatcagtcaaattaaaattaatcgtagtcttgaaaggcaccggggactgctgcatgggcctgaaaaatgcatctaggtattcttgcttccttctgtcctgtctagttccagaccaaagggagaagaaccagaaaatctccagatgaagaacctgatttagaaactagttgccaaagtgcggatggcgaaagcttctgccccagttctgcgccaacctgcatctccgattctgcagatttctttttctttttttttttgaggtgaacgacggcaagagctctgccggaatttcattagagtagagaaaaacagttcagagaatacaggggaagacatcgaaggaaaagaagggagaaaccggaaaaaaacaaagggaatccgaaaaagaaaagacaattaggggggttggaaagcagtgtgtctgagatcaaattcctcctttactattctcgcaacgcgatcctctgtgtaagagatgttttgaaaaattcttctgtttctttccaaccaaacgttccaccaagtggcgagaagagatcctttaaccctgaatttgaaaggtttggggtgtagttgattgagatcagcccaccaagctgcgttgtcatctgcaggctgtgcccccgagatgttttgccattggcacaccataagccaaacttttctgaagaaggggcaaacatttaagagatggttagtgtcttcaaacgcctctccacacaggctacaaatccaattgcaaggccagtgccggcgcaaaagattttgggccgtgagagttttttggtgaaggattagccatccaaagaagcgcatctttggttcagctgggcacctccaaatggaatgaaaatgaatcgaagagaaggacccttggaattgaaataaataagcactgtttgcagagtaggatcccgattcattcaggttccaaatgatgctgtcattggtttgcggcagaagctgaacattttgcagcaatatcccaagctagacaagatcgttgatttcttcaattgtagtcatttgccgaaaggaaaggagccaagaattgtttgtcaattccgttttaaccgatctctgtttgcgcttagctaggttgaaacacaagggtgcaatgtcttttggacatgcattttgcagccacttatcatgccaaaaatttattttttctccattacccacagttatcgtagtggcagcttgatagagtcttttgtcgcagtcatcgcaaggtaaatccattccaacccaaggcttgttgtcctctttccatttgaaccagagccatttgaaccagagcgcgagaaaatttctcaaggtctgtgtaacaccctgaaaattcgaccgacaaaatcaaaactctaaaaatacggattttcaaaaactttttaaactaattgcatcatgccgatcttattcgtctattttatctggatttgatctcgaagattattaatcgtgagtaaagaatagttaattaggaataaaccttaaaaacaaattggtaaaataaatacaaattaaaataaaggttaggtgggggtagaaataaataaaatattatcgcgaccatatttggattaattaaatttaaatgcgatggaataagaattaaccctaattaaaactcaaataaattatataaaaataaaatatgagtaatattaatctaggataaattcattagttaagatggcacaaatattgagtatacttcatttatgcaaaatttgggaattatagaatcaaatttaaataataaatgggccaaaaatc

SEQ ID NO: 7006 - DNA, 10834 bp, Oryza sativa
  unsure (1)..(10834): unsure at all n locations
ttccccaccccatctcacccttcctcccctctcccctctccactgcgccgccgttcccgtgccgccgcgccgccgttcccgcgccgccgtgccgtcactcctgtgccaccgtgccgccgctgctgtgccaccgtacgccaccgtcgccaccgccgtcgtcgccactgccaccgtcggtgagccgccctccttccccccctctcgcgtccaccgccgccaccgctcgggtaggagggagagccgagagagagagaaagagagaaggagccgagagagagagaggaaaagagagccgagagggagaggaagagagaaaagaaagaaaaagaaaagaagagaaaagaaaaaaagggagaaaaagaaaaaggaaaaataaatagaaagatttggaagaaaattagggaggttaatagtttaggaaatttaaaataattagaatttaattacagaataatcatggtcctagaattgcaaaatttaattattcttggtaatttctaaaagaaatcagttcacagtagtaatttagatataattaacaattagatgaagttttatagactattatagatcatttctggataatctttataagtaatcgattcacggtagaaattcggatttaatcgctaggaattttagacgtatattatatttaatcgtttagtcatagactaaattaaaacgtataatattataagataattttaggattacgtcagatatttagctcgtaatagaaatttctagcctattatatggatataatgctcgggaagagtaaattaaaaacttatgacaacaaaataattatacccgcaaaatagtttaaatcgaaattgggtttgccgtagttcgcagatagtaaagttaataaaaaggaatcgactttcgcattcgactttcatttggatttatttggatttttatttgaattctaaccgaattcaaatcaaattttgcacgtaactatagagcccgagggagttgcggatccaagcgaaggccaagacccgcaagactttgagcaaggcaagtcatcactattccttgaacatgttgatcccaattgcgaaattgttttatttacaaataaaattgcatgcaataatgaacatcccacttgtgattatgccatgccttgattattgtttacccttaaatctttgtaaccatgtttacgtatgagtcccgagtcaactatgacaattgcttagaaatgctattctagaatcatgcatactcatatttatcaaatgctatatgcttgggcaattacctttgggaaggtaattgagatgcggcatgtggagatatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatggagttaagcatgaaacgacccccgtacagccgcacttcttgtatgggtatagacctagcggattagatagccgagtggaggcagtatccctgcatagatggttcacccttgagtgaggcaggtgcgctacggtgggacagccgttgaggtagggccgagaggcgtgccctacatcggtgtcgccattggtaggactgccatgagtgtgtgtgagagagaacttaacttgaaccataatttaatatgtgtgagacttctctttcccgggagcgccagaactcctctcactgctagaaacatggacgcctagagtgcatgaggattgaagttcatggagcgggtactgccaatgcgaggttatcgaaaagctttgccgtgacgcgtctcatgtgttgggacgaggctcatgtgttgggcagtcgcggagtgtgggtaaagtgtatatccactgcagtgtgagtaaaccaaatctattcgaatagccgtgctcgcggttattgagcaccgggacatgtattacacttggctagactctaaattcttaacttgtgggggatgggatactgcatgatgaattttatgctgatggagtcacatcccgaaaggagggaaggtggacatcctcagaaaaccgtgacgattcaatgacgggaagctatccttgggatcacaatggatggtggacagaaccgtcattgtttaatatgaacactggtattaaaacttgatcagtctatgctaggtcttaggcttgtgaaaagaattacaaaacttgctttgcgcaaaagaaccatagccatcctttgaattcctctgtcatgtgcaccattgctgtggtggcttgctaagtacggttggtactcacccttgcaaatataaaattaatcagaagcgggagatgaagcctcggaggatccctatgcctactaccaggagggagatgaagatgatggcgctcagtaggtcttagtacggtcgttgcctgtggcaatggcatgccgctacctgaattccgctgccttatctatttctgcttttggatgtattccggaccgcacagtccgatgatttaagactgtgcctgcgggcttatgatgtaataattcgtactagactctcgtgtatgtgcacttgatatttcagctatgagtttgtgtgtaccagactacttgatccagggaaatggtactgtttacacgattgattcctgttataaaaacgggggtccacagtctggaattccaaggactcctaaaatttttggtctacagactgtaccccaatttaccaacctacttcccggatttgttttgtctgggtcttctcccttccataagaaggatctgcggtaacgatctattctgctgattacccatttgggagcttgaagggcagttagatgaaaggtcggcaatgcactcaacactgattgcacaagaattcttctcccttctgacatgaagtagcgttctttccagccagggagacgcgatccaatcttttcaattagaggcaagaaatccactttcctaagctttcgaaaatgtaaaggtaagcctaggtagcggcaggggaaggatttcaaagttccagggaaagaagtaatgacatgtgtcaagtcggtggtgtcgcaacggataggatagatttcagtcttgttcaggtttgtgtgaaggcctaaagcttgggcaaataaattaagaacccttttaactgcatcaatctcaatagggtcgggcttgacaaacaaagcgacgtcatcagcgtatagagagcatcgaaacctgctaaaacgccctccaattggagtgagcagggaggcctcttccgcaacttgaaagagtttgtgcaggggctccatagcgagatttcatagtgcacatttgacatactgagagttcctgtgtgtgccccaatgcttctgtacattcttcaggacagtgaattccaatgcacatgaataatacttgatgagtcatgttatcatcctcgaacgacatgttcaccaagcatatgccatacatgctcgtttcgtcttattagaaaaactagtacagatatgcaaaatacaagtcatgcttaatttacattttaattaataaaacaagtcacgataaaataaatgatgcttatggttttggttagaaaattttccttttaccactaatagcaaccatattctcattttcaccatccaaaactttgcactcctcttttatcattttttcattggggtgttgtttacacccaaatttggcacctagggataaaatagggaaaattgccaaagtttggaagtctgccggttttcctctatgagggctggtctgaccgctgtgtataggccggtcagaccggcggtgtgtggccggtctgaccggcagactccgagtccgggtctgttttcgtcgggtcgggtttccttgctcgggaaggcatgtttcgggtttcctttggattctatcccgagttgaacatggaggagggcctgtagagggcaagaccaacccctatataagggggtaaggccaagaccaacccctatataagggggtaaggccagttcattgtaacaaccaatctacaatcaatcaatcgaatcgtttttcatattgcttttagttttctcttattttgtccatctttatcgatttgcgccgtaaatcgtccgccgccgctgcgagagtgtgacacctctttgtaggtttgtcctgaaaaccttccgttttgcccacgagacaggtagttatctagaataggctccgctagccggtttagttatcaaaacccatattggtttagcttttgctagattgaggtggttggtgactctaggatcaccgcaaggcgtttaggtgctgcgatcgtgcttgtcaacttgtcacaaaaagttgccaacatgtgcattttaattttattgcaatgaaatcaatggcagttaacctctgatttgaatactaaaagaccattatgtcctttagatgttcctaaacaaaacaacacttaaaattctagcaaacaccataaaatatcagaaaaataaaccgtggatacttaaatatattaaacattcagaaaaatttaggcaggggaattaagtagttttatttttttcgataaaatgcaccatgggttctgaataatttggttcttaaaatgttcctcaaaataagtatatttgggaattatctggttttatttgttggaaaaatgcaccacggcctagaataatttggttcttaaaagttccacaacataagaataacatggaaattatgtacatgcccataaataatcttgaagaatattgggagcttacgattcttatatgcatggatttggaaatatttttcatctaaatatttcatttaagctactgtagaaaccttttgaaatttgcagtaagttttcaaggagtggcaaaagagtgtaaaatcttgatggtgagaaagggagaatattgtttcaaggaatgacaaaaataattttttcctatttttctaataaaatgaatggtcgaatgcatgtccaaaagttaaagcatcatatttttaaaaacagaggtagtctatatggttttagtcaataaacacatatattattccaattcacctcttcaatgcatagagtagagccatagagtacaacacaagtactagtggttcaatacttggggatgctcaattattattcggtcagagatcatatattagcaatgagcatggttgcatctcaccatttgcttctatcgttcctaggtatcagtttcatcatgctcagagactaactatttctcgcgccggtggatgtgctctctccttcatgtaaccccacaatatccaaaattgggctcgtggatacaaacagaaatgctgcgagacaaacactggacaagaaaatatctgtgtcttatgaacaatcacgaccaatttcacaaaataggagagcaactggagcaaagcacagcgaacagttacgtccatgctgtcgggtgaggaggcaatcatcttctcattgtgattggagtgtggtctacatcatttgatggctcaaaaacagcatacacttgattcaacaccttcttaagagtttgcttggaccttcttcctttgtacgtacttttaggcttatcatcattgaatttgtctctattgtcttatttcttggctctcccaagcttgggtcagtacgaatggatgtgatcaagctctctatactcaaagcaatgaactcaacctctgctttttctaaacctgacattgttcatagctcgagacaacttgttaatagccaaagccaagtcctcctccttgaattgctcaagttgatcatccgacatgatattaatagtagaaagagtagtagaatttgatggagtactaatatccaaagaagtcgaaggagaaaccaaaacactagatttagaattaactttacaagaaagaatattcaagtccagtgtccaaacccaccacctggtcaagtgaagcccagtctgttgcgtggaaccaccctgacgacacttttgcagagaggaccctatcttatatcgcagccattaatattgatcataacgttttgtactagagaggaccatgttttgatggaaatttagcagaaaaagacttactgtggatcgtaaaggactagggatgggaagcctagttcaattggaaatgttttgctctggagagaaaaacacgatgttgtttgcctgttgcattatcaaccagtgattgattggaaattggaaatgtttttgattttgttcaggagtatttggtctttaagtaagactgctttttctaatgacaaatcgattaactctaatccattttaaatatttttgttctatttaacgagtatatatcttaatggtgcacagtctagcactaccaatccacagtagtgctcatagcccaaattggtacacttgttttgtttggaaatttcgaaatgagacatgtagaactgtagagtacaagtactgagtggtgcaatacttgcagttgcaggtgcttaattacaacatagaatccttttggtcagagatcgtaaatgcatctatcatatatgaaaaattgatcatggtttatgcatctcactatttgcttctatcattcctaggttgatcacttccatataattcttggtgacaaactattatttgctccgatggatgtaaaaaacctgtaggcatcataagcattgggaggtcaatctgtgcgatgggtcactctgagggatgcctgccacaccaaaattgggcccatgtttacggttgagcaaaaatgctctcaaacagacactgtacaagcaatggcagaatcagcgaggaaaatcagcaaagattcaacaggatggaagagcacctggtgcaaagtgggatccacaactatatcatcaacctaggcttcttgatttagatcagcttggtgctctctaagaaactattagagtttgtgtcaaatatgtgtatgtagtcggttatagtttaggacttggagttgtactaggtataggattatagtaagagtcagactctatcctaggatctctcataaatagagaggcatgcctgctgtaaccgcatggcgacttagcatagcgagagggagcggctgccggcggcgaccggccgtgagtcgttgtaactctaatacactgtgtatgctggatcggggagaagcgcccgtaatcagtgccccggagatgtaggcctcggctgcactccgttatcaaatatcgtgcctcggtgtcgtcttcatgtttagatctcctatggtgtttcttccgcgttttgtttctaatgtgatttcggggccggttttataacagaaacttcctaatcatctgaagaaactttgatcagtgatctgctgtctatcatatataaaaagggatttatctcagtgaaaaaaattagtgtaaatttccctcagggaacaattttatatgacttttacaacacattattttagtcagtaagcttatgtcttcttttacaccgcaatttacagggaagaactatagagatagagtacaaaaagatgcagtggttcaatatttgcagcttctccattgctggtttgaatctttttagtaactcaattcttaggtttccatgtctaacgtttgactgttcatcttatttaaaaaaaatatgaaaaaaatttaaaaagataagtcatgcataaagtattattcatgttttatcatctaacaataatgaaaatactaatcataaaaaaatttcatataagacggacggtcaaacggtctttttgggatagagggagtacattctaaaccctgtggaagagaacatatatgagctatagtgagcatttttgtatatgttaacatagttttaagacattcagtaaagggacctatattgacattcagcttttttttatctttaaaatctgatggatgtaagaacctctgtagcaagtcacatttctagtaatggaaatggagtcatccttgcccttgctctaaaaaaaaaaagaggtgatcaagacacctaattacttgacatgcttccgtgaccgactatctgcgtcgtcagaaaagtgctatatcatgcaatttaatgtaacttgtaattgatgcagagaactatctcctatgacttccatgagagagagttccagacttccaatcaattagcttacgctttatgttccaattttttgtgaattctataatgaaattggggattcaacaactgattgatctacccctaaaatataaagggacccaaatataaatgtgtacaaaagagatgcaaaaatactaaactacccctaatatcttaacacccccactcaaatacaatgtgtatacaatcatattgcatttggagtgtaaactaaacatgagaacacaaactaaatattagcctatctccaaagtcttgatgatgtcgtcgaagtgtgccaattcttggatgataaagaagaaaagatgtatccccttctcaatgaagcgcaccttggagccttcacaaactgtttttcggccctcggtaccttgaagccttcacgaaccgttcttcggctcttcattgattcgaagatgttgttgatgatgatgatgacaatggaccttcacaaactgttcttcggaccttcacggattgatgatgatgccaactttgatgggaagctagtgatgtgatgaaccaactccgatggggagttggtgatgatgatgcgatgatgatgaggaccagctccgacagtgagctagagaagtgatagaataccatgacctcgatgaattgaaaatatgtaatggacttggatggaatgtagatgactaactaccaaaagacgctagcaaatgacataggatgtgatattagcagcagaatagatgctatagcactacaacactgtggcagatggcagcgacaagcaagcacaataactgaatgtctatgtgatggagcacaagctcgaagacatgaaaacaaatcatcaattttgacagattctgcaactaaaattaagtggtaatcaatggagctaacatagcaggagattagtactaaacgaactactcaagacgtacaaaaggttgtgacattgccacgaagaagttggcgactgtgattggaatgcagcagctgagcagcagattagcaacaaagagctatcggtgatgacggattgcacaaaaggggaaaggggaacaggaccaagataggaaaaattaaatgatccatagatgggtttctagctttctgctgctttgctcacgaaggactctcccgaagcctcatgcggctgggcgacaagcagacaaccccaacggccacgctgctgaggatgacgaccagcgtagttggggacgacgaaccgcgtgacggagaacgtccatgtggacaaccaacgacaagcttaccccagcaatggagatgagcagcgacgacctcggtgcaaggacgcccggccaaaactgcagccgttgcggacgacggcggcggcttgccgccgatggctaggacaagtcccgtgacctgaagaacggtggggacgagcggcgtggataagcgacgcgacgggcgtggcagcgagagtggatggtggagaagcgggcacggcgccgcgacggacggcggctgcgaccggcgaacgggaacgcggtgacggcgatgagccgcgcgcgggcttgctgctaggagacgaagatgacgactgactgctgctgctggatgaagacgccgagcgatggtggacgaggatgaatgacgacaacgatggctcgccggcgatttggcagctagggtttgggaagaggctctgatatcatgtgaattctagaatgaaattggggattcaacaactcattgatctacccctaaaggggaaatataaatgtgtacaaaagagatgcgaaaatactaaactacccctaatatcttaactttttttttcttctcacactccatacacaaagatagtcatttctagttgatgcagagactaggggatatacttccattggctaaaaacgaattatacttagtttgcaacctagatattaaaggccagctagagccataacctagtccataaattggccatggcccaattatgccctttttggagcagatcaccttgaaacagcactcaggtgtactaccaaattataaatcttgagcaattagcagcactataaaaaggtgaacctacacttctcgatcaaaaggatcagacgaacactttgctccctcgaggcctcgattcttcagcattacagtttccaatgccaaggtatcatcctactttgtcctgtccatataattgaattggtcatggctcaattgtgcccatattattagttttgcacgtatctgctctcgagcacacaatgaaaggataaggaagagctatgaaggatcatcaatgaagctcttcacagatgaaccacatgtacatcaccaattcaccaatatattctatctgaaaccgtaggcttgggatgcatcagaaactactccatcagtttgaaagcaagggaaggtattcttggctcgttctgtcccagaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7007 - DNA, 476 bp, Oryza sativa
ctgcagggccgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcgggggccaccacattctgcggattgtaggtggtgtacatggacttcatttcctcacccttgaggaaataggaggggcggcccgttagcaacgcagcgtaatctataaatagggatcaaatgaaaggtggagataatccaggtgttagataaatacaat

SEQ ID NO: 7008 - DNA, 2813 bp, Oryza sativa
tagtacaaatgttttatcaagaaaatataccgcctgcaaaaaaaaaaaatcttcggaaggaacccaaagtgaatgatttgagatcacgcaatactcatttcattctgttgggtggctaattagttatagatgctttgtgccttcgttgacacactcatatgccaatcaagcaaataaacaagtttatttccaagtccaaataggaatgcacacatataggaaatttagcattcggccggtggtcttcacgttagatgatgccattcaattaaccagggacgacctttcaaatagagtcatcgcctcattggtgtagttacgtaccctttgcatgtttctagttacacactcagtaatccgtttttaacgaaaaggccggatttcacacccaatcgattgaactatttttattaatgccacacaatgtctgaaaatgacacccattgattgtgttgttagtagcactgtggactaaaataagatataaacagtcatgtcccgtgagtacgtaccatccgcttaattgccgtgaatagtggttaaatgtatacaaaactctatcatgtttgcacaggatatgattaatcaaccaaccacattttcttgttaggttatataggggcatgtcattgactaattaagatgtgttaaagtaatcaccaaaacagcatttgatatagtaggtgtggcggtatattaatcctttttgtcttcattaaaatttgatggattttatacaaaaccaaatttgacaactagataggtagaacatacatgtacatgcttgcatgtcggtgcaaacaaaaaaaaacaaacaaacaaaggcgtgcagatgaggaggtatcatccatcctagggtgacaaaccggtaaagagaaaaagggcatcctttctagtgcaagaaaaggtgatgttaaaatgattgggtcgcagctcaaatgataagaacaaagagaagcgtttggaagcggcacaagtatgcaaaactaaattattaatagcttaatatgccgcctgatagcgacatcatgatgtgctagtttcttttgatctgttgcgtatattattgtttttttatctctctatctcttttcattttattatattagtgtaaccgcacagaacagaggaaaaaaaaaacctgtaaagttgcggggattccagggaccttttccagtgcagcacggctgaaacaaataaaaagataggaaaataattaaaaaaaagggttccctccaacgtcgggatgagctctgtgtgtcgtgttctgtggtgtcagtgtcgcacaaagctgcaatgctaacttagttatatatgcatgcatggctgctgtgtgcaccaagaatttaccaaaagaagcctcaccaacgtgtatttcaaattaccctttaaaggccctgccgcagggatacctgggactttttaatatcccaaatgtttaaaaaaaactctaattaactactttattatgtaaaaaaaatatcaaagttaaagctgattgcaatagttcaactggaacatatacctagctattgtgataaaaaaattctagagtagattatattacaacatgttgtatataaatttgcgaattaattaggaaaacaaagcacctgatggattacttgaacaattctttttagccaggggtgtgaccatttctttaagaaaattaaataatgtgagctctgtcaaccaatgaaagggtttaataagccaaccaaagtctggcatgactattcaaccagttaaaaagggaaatgcgtccaaatggccccttcaaatatatgtaaacaatggtccagccggcggctcccattgtgcacgccggtgatccgcggcgatcgatgatggtccaaacggaaacccatacattatcatggtccggtacgtgttgctgaagagacgatctgaaattagacatctttttcccttgtcctcttcaagcttggatgcatagaagagatacctaattaagcagatccatcgatccttgagagataaaccacatgtatatctagttagcttgtgttgtccatctggaccaccaagtcatcaggtttggttagccacaaaaccttgcgtaaatccatccgatcgggtcacatgccaaggcgtgagcctgaagctcgttgaatcattagtacttgcccctgaaaaaacagtttcgatctaatcggcagatcagaggctggatgcatgcttggattccttccctgtcttttaacaaagacgaattaaaacccagtatgttaacagactccgtgagagttaatgacagattagcactgcccttattcgatgaaaaggaaccttctttcttcagagaaaagcttgaactggctttagcctgtgcaaggggtagacacatttctgttacagcaacaatccaagattgttgtgtccagaatgaagctgtcaatggctccagatgttaatcctgacactgttttcccctttccataatcccttgtgtggtgtgcatctgcacaaagctagctaaatggtgctcttccattaactttttagcagcacctacccacaagtgaagctaggaccaactgttgacaacaatacttcaacgaccacaatgaaagatagccggccaatttggttgtccctgtgagcacttgtacgccataatacaggttccttgatgccgtcagattatagatgcatgtactcaaatacgcatcatctgtaaacaggaaaagaccgtgagtgtaactgaagatagcaatcttgtaaaaaaaaaagtgtaataatacgtcacagatttcaaatactgatatcagattgataccacttgattg

SEQ ID NO: 7009 - DNA, 1466 bp, Oryza sativa
tcggggctcatccaccacctttccctcgggcgccctcctcctcggcctggttgtgcttggggtcttatcgagacctacaatatcttcaaggtgttgaagttgcagctcacgacctttggcatctccttctagctatatccatcgtgaactcctgcgccatcaacatctttgagaaggtcgtccaaactaacaagaaaacctacattcagccatagttattaggaccggattggcggtccgaccgaaaaaaatgggaaccaggggctcagccgatccgatccagtttaaaaattggagtgcaatcaacccggaaaaaatcggttgaatcgccggtttttggaaagaaccagtgaaaaatcaggcaaatagaccgctaaagaaccgagcgctcgtgggaacatgtgtgaaaaggccgaacactggctgaaacgtggggatagagaagaaaataggcggcttgagggatttgaactctcaacctcccctttagactcaatcatccccaccactgagctatgcatgcttatcaattgatttgaaccgtgttggaccggtggttcaaccgatcagaccaatcaaaccgtgtctggtccgatcctaataactatgcattcagcaatggtaacgatcacggctgccctggacgtgcgggtaaaaaaacactgagcacagtgaccgcctatgaataaggctcaaacgtcttgggggggcgggctcaggcccgagcatgccctctgccccaagctctcctcagaaggctctgtcctatttatgggtattggtgggcctatagggctaacattaaccgacacaccgcttaaaccgcagggtagagcaactcggtgtacagctcgtccgcatgctgagaaacatgatgcttcatgaagccccttacatggccacatcaaccaaagaaatagaggggaggtaacatggcatgccctcatcatccgtagtttaggtccacctcggtactttagaaaggctgacatgtggccctgtgacagttgggaaaacactttcttacctcctgctccactagttagccgacagctgagacagtcacgtccggctagcttgtttgtagggacatcgacaacactaagcatacctaattcaatagagtgggtctcactcctgcatacatgcattggcattgtggactccccttcatgtataaaaagaggatggggcaattgcatcggtgcccccactttcaaacccatttgctgttttatcatcactttttagggtttacagttttaccctcactctttgaatctgaaccagccagttacccccacttctaatagaaggtgtcacggtgttagttgtacaacaaaaggacatgtataccctctgcatccaacaacatcgtgcaggggaggacctggagcaagggacggggaggagggcggcgtctgcgccgacgtcgacgtccagcaagatggggtcgtcgccggcca

SEQ ID NO: 7010 - DNA, 6126 bp, Oryza sativa
ggtaaaacagtaaataaatatttcataaaaagaaatttctatttctctttgtatatttttaacccaaaaccgtgggacccatctaacggggttaaaagtgagggcaaacggtgggttcgtgttcaaaaagatagggcaaaaatgcaaactttaaaaagtaggggtaaaacagcagttgaggttcaaagtgagggtatagatgcaattatcccaaagaggatccatgccaccgagaagaaggatccctgagtttccagcaatctagcatacactaagattttccactccacgcactgtgaacatgatcatcaccatcatctaccaaagaacacaagagtaaagtattacgcttccgagcggcccaaaccggtctaaaaatgcttgcctctcccacttttatccttcgagcgtcgcctcatttttgcgcaccgctccctggccgaatcttcaaagggggagtacacgcttacccgctagaggagttccacgctccgacaaccacattaccatcgatccctaaaaaagagcacaaatcaaccactctgagatagatagaaggtgcatgagcgatgttctggtactctctactggtagtattattctaccagtattattaggggtaaattaataatttaataataccctaattagttatgttttcttttctaactaaatatatctatgattatctattacgatgacattactcatattgcatagaaaaaaatgtttagtcgctgataaatgatgattatacccctccgcacctttttttttataataatgcccctccgcgttttttactaccactagttactattgtagtataaatagatttgaacccttcgatcaaatgaaatcaatagttcatattgttttctacttagtagtagagaacatcgtaatggagctcaaggtgcgtagggtacctcatgtccataacaccaacaaataaaaatggtgcaaataccattgagtatttgagtatatttcttcgatgctttctggtacttatatggattgtgttagattacatgtttgttcagcttcaaataccactataaatctataatcactgttgtcgaacttttatacttttttataatgtaaagtatgatgggccattggagcgaggggtacacttccttaataattaagatgttaaactccagctccaaatagtagggaaacatcactgaatctgccttcaagtctattatactccatttatcatcaaaagatccatatcatatccttgtatttcttaatgaaaggagaactaattaggtcgcatgcgccagccattcacacaagagcttaacgaaaagaaaaaaaaggtggagaacaactcacagaatcctcttattctatttatgtttgtgctgtaatctccgctctttgctcgctgacttgcattatcttgcaaaaagcaactctagatatgcgcgtccaaatcaacaactatacaatcagtggctagctagctgctagctagctagtgatcgatgcaagttgatactaggattaagtatactattacccggtttgatcgatcaatcagctcatgatcaacactaaaccgtatcgatcggcgtcacatctcacatgtacttccccagttgccggttgccccctgcatcgatcctctttcgtgttgcctgccgcctgccgcctgccgctttcagctctgtgatgttggaaaactattctaaactctcaaagatgacatcctctcgttatttatatatcatctaaatagttataaaaaatattaaaaaaataataagatagattaatatatgataaattactccacaaatatgcaagataaaatttaacttgtacaggttgcaatgaaaaaaaataaatttaactaaatatatgttaactaaccatagtttaatttatgtattttctataatttatagattttaacttgtatgtttatggagttatatatcacatattaatctatttatttaattttttataactatttaaattacatgtaaataataatgtaaataataaggggaagttggctcgaaagttttagagtccactctcgtgatgttgccactcgtacgtgagctagcttagctatatattgcgcacatgtgcagcaaccaaacctagctgctacgagcaaggcaaagcagagccgtcagttgcggtcagtttccctgtcacctccaggcgtccaggaacatacacacacatcaaggtagtggtggccatggccgcgtgcaggtgcagcagccgcctctccctgcagctgcctcctccgtgcttgctcatcgtcctcgtcgccggtaagtgtatcgtatcttgcatgcatgcgtacgtgtgtgtgatgtgtgtcactgtggctgacacggcggctgggatgtgttgttgttgttggttttggtgcagcggcggcgatggtggcggcggcggcgacaggggcgagggcggcgtgggtggactacccgtcgggggtgccgtgcggggagacgatcccggtggagcagtgcgacccgggcgacgcggcggcgaacagcgcgtgcatggacgtgtgccactacggcggatgccggcgcggcggcgagtgcgtctccctcggcttcggccgcggccggggatgccactgcaagtgctagcagctgaactgagctgagctgatctctgatctgaactgaactgatatgctaatcaggttgagcaaagtagtagaagcagtaattaggagagaataaattaatgagcgctaagctgctgtttgtagatgctcgcttagctactgtcccgttgctggctgccttgctagttttcccgcccttttttgttcctctgttttttcctgatcttcgtgttttgcatgagttggtagcacattaggtttgcttttgtccgcgctgcctctctgtacaaaagcctaaggcgtgagctttgaaaaatgaaatcgccaggtgccttttgttttcttgcacctgtcttttgcctcctttttacaacaagctcgtgctaccaagtaccagttggatctaaacaaacaggagaaaataatcactggattgtacttgcggatccggagtgttcttttggttgccagaagcatgtgtacttccgttacaatgtttgtggtcaagagtttcataatccatgttctagagacaggaattctctaggacgcatcaactattcgaaggtgtgtatgattctccaggacgaaataaagtaagcaccattctgttcttcgggaccaacattgtcacacaccatccactctctgagactcggtatcaaatattcgcttgctaaagcaagatacttcctccgtttcagtaatatgaatagatttattaacattaatatgaatattgaaaatattagaataacttatattgtgaaacggagagtagtactactacaagatgtgcgcattcctgtgagaatataacaggcaagtaaagaaagcccacccaaccaccaaattgcttatcctccaaacgacaacaatacacatcagtaactctatcttcacaagatgatcatcatcatctagctcatgtggcagacaacacgtacaaatacaactcatacatcaccacaattcacgaagaacaagttacaagggaggggatagaaaggtacatgagcagttctgcactacagattgtccatcttttttttcctgttgaaaaatcctatactgtactgagaacacaaacaccgcaggacacaagtcttattcacactttgtaaacactacaaggctcaagctgatcaaggacatcacattcggggtgctgtccctttaatgggggcgatgaacatcaagtggccggcatcagggacctcaaaacaaccacacaaacagggacctccaaacaaccgcgcacactgggggtggcagccactgtgttgtttcgaatgcaagtacaccgattcgagattactctatagtagttgtattagatatcagcaaggtaaaaaggagaaaccacgagatgtactacacaacaagctgcagtccagactccggataggcttttacatttggatagacatcacctcaccaggcacttttgctcgtcaagcacacgatgcacacctctgaagttgggtgtcagcaaggctgttctgacttctgactttagctatgatcaagcacacgatgtacacctctgaagcaaggtgccagcaaagctgttctgacctcttgactgtagctatgaatctgtgggcgtggacaaaaataatccacacctttgccgattgtacatgaacaggatatcgggcaaacttgagaactgtgcagactttggagtcatgtatttacagctactgtacaggatttttggctggcctgccgattaatcgacattgctgaggcagcaaactgcatcgaacttgccccttgacatgcaatagttcaccatcaataccacatccatcatgtgtgttgggcccagccttgagcctcacagacttaacctggaaaagttaatatgtccgtgaactaagtaaattaaagaaaagagttttaacatgaaaacttctggataacaataaaaatatcatgacaggttcaataaaaaccagaaaattctaacgtaatatatgccaatcccgactttataggtttacccttttttttctctcatctatgattccaatttccagaacagattgtgaatggcatgtgaaaggtaaattttttcattacacacctacaattgaaccaagttgtgcagtgaatccaggagatttgcaataaaaaagaaaataaaaaatccaataatcacatgacatgcacaaaaagattttaaaacaacagtttctaagaatgaacgaaaaccttaatatttgaccaagagaaccaatcgtattaccttcagatattccacattgggaagagaaatatgctttccaaactgcaaaagcaccaaaaatttcagtaacctcagcctcccacttccaccaaccaacagtaggtccaggcaattgtcatcgtattcagccttaggagcaataacctgagagcttaaactctgcacagtcttgcatgaatggttgcataccagtacaccaagataccgccccttcctaactgtccatctttcatctaagcttgggactagttccttagtcagaccaagttcaatatcatccaatggaccaggtaagtcaatgggagtctctggttcccagttaggttgattatcccatttaggctcatcatcccacttgggtcctgaatcccacacaggcccaggatctgaaattgtggaggaggcgtcttctttgtcatgtgttgtggtaccacgagaggaatttgcatcatttgtagcacccgagcctggccatgccttttctgtccttgatttcgatttggatctacgccagttgggagtcgatgaaacatgagcctgaggatggatcacttcttctggttctttgaaagtacttgttctccctaatgataggcgctttgattttgggtcaagtgcacgaacaagttcagagggttcattattagcatgtggactcgaaacctctagatctccacctgacattattcctgtagacatgattgaatcaatgctagataaacttgaggcacgaggtagacattctactcgcgacctcggaactacatcatcatagaggtttgatgcatcaactttatcttgcccttccacaattttatgctcaccaccaccaccatctgatattggaagatactccaattcaaagttatactttggcaagcacaagaatttcagaaaaccggctacaaagtaacggagaggaccaaaacgcttctggtatctctctgagagttcaagaactgcaatagaaacaaatagtcagattttctgcttccatttcaaaaaagaattaatattgatccaacaggaaaagaaaatggtctgaaatgtcaattatgtggttaccatcactaacaaaaccaaaatatgagactgttgtgccaaaatggatagtcccactttgaatccattcaacggcaaaaacatcaatgggtgtaaaacctccctgcaagcaatgaacagtttaacaaacattgatgtgaaacaaaaaagaaaaaaatgctgacacaaaattgtgagggcaataatt

SEQ ID NO: 7011 - DNA, 9066 bp, Oryza sativa
aaacacccccttagtctaggatacttcttgtaaacgatggaattacttcctagtagtatttgcgatctcaattttggccttttgtcctcgattcatccagaaggatcaactggaccacacgcttagttttcaaatagtggagtacaatttgcatgtacagagattcaaaacaagaaaaggggagcatgtacaggaagtgcgagtctaaaaaatgtactgaattcgaacaggacagagtgacaaggagagggaatggcttgaaatggcaatgaaaaggccaggtcaaattggcaatcacaccggccagaaaacctagtcaaaacgtcattgaaaaagagaaaaaaaactgaggcgttcaacctgttcatgcacgagccgttcgttcggttcattcaccttttcacagcggtcgctagctgacggcatgtcggctcgcttgtgttactactacttgattaattgacagctgcatgccataaaacccaattacaattagcagtggtatattttttttcagataaggacaattagaagtagtagtaaaagaccaattctttctttgttaattacgcgtatcaatggatggccttttccatgtgcagcagctgcagtggtatgatcactgtcaatttatgggccggggttgagcagtatatttgacttcaaaagatgggaggccattttaatcaatcacctgttctaacaacctttaactagacgtgtttggtttaatttcaccgttatttctagaatgaggtttgtgtccggttgttgatacggcgcacgagtttgaacagtgacatgagagttgaagtactgctggtggtaaatgctaccaaaattagtccgacgtgaccaattcaattattacttctctagtttctacacttttgtgccattggtcaaagaagtaatactcgtggatgcacacactataaagatatatatcattctcaatgttccggtatattctttagatagcacttttaagaaaaaaaactttttaatcacaaataaaaatatctataaatttcaagcattaatttaatgagaatgatactggtacattctgtagttttatgatactctactttaaatctgtaattttgtaatatattttgtgttaaacctatagttttctgatatatcatctttaatctataattttgtgctaatttggtcaatatatctataactttgtgaaattacttttttatataagaaaatggtgaaaagtggcacattatggggttgggttttaatatgcatgtgatgtgaatggttcgacttctctggtttggttgaacttttgggtgagtttcatttttttttgtgagaaaagctttggatgaacttattgttgcatacaacttaattagtaaataatatcagtaaacatttcactagtcaaatttatgatatatcggactacaaaatgcagaacaaaacatcaactttgttttttagcatgggtgcgacggatgaaagtgaaacaacgttagaaaactgggagtataactgttgctaacaagtggacagcgtacggacgaaagggtcagcagtggtcaaattaaccgattactgtagctagccgtcaaaccaccccaaatttgaccgccgaaaaatctaaccattccctctgaccaccatgcatgtacgtaaatacgtgcacacaccatccccgaaacacatccaaaagccgaccttttcatcgaaatgaatagcgatcggtcgagtgagacgcgcgcgctacagtgcaagtacttcgtagcttttttcttaccgtcggttactgtggtatacgtataccgggcacatactggtactactgagttggagtataattttacatattgttttcatactatattcactgttaccgtgcttatcttaatttggctagggtaaggatttgcattcttgatgaaaaccgatctggatttcacataatccagacttctctaacgaggtaaaaaaacaaaaatcgctttttcatgttaaattcaaaaaattcaagctggactataaattttcgacaaaaaattatcgatttcatctctttttcatttttatcaatgtctttggtgaattccaaagatacacctcgtgagcggtttttatccagtatcaggatcgtgaaccctattccctctcccccgattgtccccggtaataaggcaaactaagagcaggtacaatagcaggctataagctagctataaacatatttaaaggagataaaagagtagagagaagagcagtgggctatagatttgtagccagctgtagcacggactcctagacacaatgtgtatatgacaggtggaaccaggtattaatagtatagtatgtaactattgtatgaattggctactaaattgactatagataatttataatccctccgtttcataatgtaaatcattctagcattttctatattcatattgatgttaaatgaatctagacatatatatctatttatattcattaacattaatatgaatgtagaaaatgctaaaatgatttacattgtaaaacggaggaagtagccggtagttggctacactattaaacttgctctaaccgagcgcaaagcctggaagaaaaaaaaaacaccgagccatcgctcggtccgcatccgcgcgcaagtgtgggagcagccgcggccgcccgcccgcccgcccgcgcgcgcgcgtgtgccgcatgggcaaattttccctctcacccgcacgtatgcacgcatgcgcgcggcgtttgcgtgtggttgcgtcgcgggagacggcgccccgcgcccgatcgatcgatcgaacgagcccacgcgccgcgtgcgcgtgagccctcgcacgcaacacatgaagctagtcgatcgatcgagccgccgtttcgttagccgacacgcttcgctcgatcggcagctggcggctcgcggaaaaggcgagacgaaatcacgctgcaacttgccgccggatatgcacgcattgcatgcgtatccggtcaaaactcaacggggatccacagctagtttatttcaagtctggactacttggttcatcacatcgaccaatctcggtcagcctcacagttgatttatcgctggtcgtatactctgctctctttttttttcaaccctaaaatgcacgcactcgtgtgaaatgaaatgaaatgatacacgagatcgatgtatcgatcggtatcttgttgccagaagctaacgagatgatatgtacgccagcagggtttacattaccatcggtaaccgcgcggttatcggtcttaacgtgggggtacggtaataaaaaaactgcgataacctccttaaattcaaataaaattttaaaataatttaaatttttaataaattttacatggtttcgtacggtttgtcacggttatcggggtaactgtgcttaccgccagggcgcggtaaccctgacccccggtgttttgggaaaccctgctagaaacaggttgggaatctcaacatccgataaacgagatcgatatatcggtcggtatcatccggtgctgcacgttgcaaactcaaactacgggagtcaaaaagtttcgttgcgaaagtgagcagatgcagcaccacatctgtgtatactccagttgcttcctcagcataaacatctctcattctttgacgggaaagcaactagttagcaagcatacatataaacatctctcactctcacgggcattgggatgcacacgcagtagaccaagcagcgacccgactctgatttttgtactagtagcgcctgtagacagcaacgtataatagtacgacgtatgttgccatttgtaatacactaagctgcagcccaccgcgcatattattcccccggacaagttgctacttaacaaaatgacagggaaggaataacatactttgcatatgtacacaaaagggtgttcctgttcatggaacaagagctcgtactgccgctgcagcggcaacccctgtcgtgtggtggcgctcggctaataaaccaatccccaatcccccgagcgaatagaatttgtgattaattcttcggtgtccctctctcctctggtttgatgtgaaatcctctgtcacgttgccaattggaaagaggtagctgtacgtagccgaagtccccgaggcggtttggtggtggtgtggtgtggttggtcaatgcgcgcggccgcgttcgagtgcgtgcaccgtgcgccgccgcggggtgggtgattgggtggctatggttactcagtgttcagttccattcaaactcccaaaaatttcatcacatcaaatatttaaatatatacatagagtattaaatatggatagaaaaaaaaaccaattagaaagtttgcatgtaaattacgagacgaatcttttgagcctaattgcaacatgatttgataatgtgatgctacagtaaatatttactaatgacgaattaattaaacttaataaattcgtctcgcagtttacaggtgaaatttataatttgttttattattagtctatgtttaatactttaaacgtgtgtatgtatatttaaaaagttttaggacacgaactaatcactgccggcttttgcaggcgcgagatgcgcgcgccgccggatgaaaggtgtggtgtgggtgtgtgggtggtcggagggaaagctgcaaaagccggcaggagcactgcggtgcgggcggagatggacgtggtacgtcatgctgctggccacagtggtgcatgcctagacctgcggcttcctgggccactcgtactagctcctggggagagtagcttaagccagatagtgggtaatcagtggaagtgctagaccttggccattccaaataaggagattcggttaactaagtgctttttactctagtattataaaaactaaatatattgttaccggtattttgttacctcatccgtatttgagttcgttttaaagttcgttcgcttttaaaaatacagatccgtatttaagtcggattttaaattcatttgtttttagaaataaaaaagaatcatataagaaatctctttaaaatactccctccatccacaaaagttagaaatatttcacatttgagtttttccaaataagttattcctatttgtagtctttatgcattcaagacttaaataaagagataaattaaatgtttgattagaacccaaggagtcatataaatactcattggttgcatgctttcattcactcgttgaatttgtaacatccaagatgatttaatttctccttggtcttgatgacaaaagtaataggtataacttttgtggatggagggagtaactcgcaagctaacttgagatgaaagtcggattcctaattgcagctcatgattttctaaaaaaaaatatctaagcgaattcttacagtgaatttcatcatagctaaaccgtataataataataagattaaaatagcattcacctgttgcaacacacggatattttttttatctttttaaaaatataaaatatttgtatttgatcggttcttaaatttgaagcagagtatcacgtcgatttggatagcttcacatagaattttcagctcctcaaacagttcatattgttacctaggttctgacaatctatagttgtagtcagaagctgaaaaacaaaattctccgtattctcgaagttggctaccaaccagcagattattagaatcttaaggtccccaaacagaaccgatcatctagattcatgcacttataaaatataaggactaaaatcttggtttaatgtatcacgagatgtataaagtacaaacaatgtagctcgggtgctgacatggttgtccacaataacgagaattttgtatttacacctattcaatacaatatgtcccaaaatccggctttcatcactcccaagttgactcctaacacacatgtgggagaggtggcgaagagatgacgattagagtggcatctattgtcggagataggaggtccccgaaaaccgaggtaagatggcaccatagtgaaagggtgatcccacgaggggggaaggctaatgcgcgtacgcgccagcaaatttagctggcgcacacggcagttggccccctccccggtttcagcgtgcttttctttctcacattcctttttacgattttagtgcccagatccgggcacgtttttcctttttttggtttctttctattgttttttaattcttcagacacctctttacaaatgtagagttgaaagtatttaattttgacttgaaagttttcaaattttgtgttgaaagtttttatatttgagttgaatgttttcaaattttgagttgaaagtttttaaatttgacttgaaagttttcaaatctaggttgaaagttttcaaatttgggttgaaagttttaaatttgacttgaaagttttcaaatctgggttgaaagtttttaaatttgacttgaaagttttcaaatttgggctgaaagtttatcaaatttgagatgaaaagttgaaagttttcaaaatttgacttttaaaaattcaaatttcaagttgaaagttttcaaatttgggttgaaagttttcaaatttgtgttgaaagttttcagaatttgacttcacgcataaatttcttttcaatctgttacttaaaaaaaaatcttatcttcattatctaaaactaatggatttttttacatgctaaaactaacggattagttactagacgcgctatggaaaaaatcccgaaaaaaatctaaccgcgccgacgcgcggtgccgcgcatacgcgtgggtcttgtgggccggaagtacacgtcggcgacgcatatgcgccaattaggaattatgtcccacgagccatgcacgtgtgatcgtcgccgtgaaggcaaacaatggaacatcatattgcacgaggattacggcgaaaataacaccacactgaacttacaatattaaccctctctatgtgacgtggtttttctcggttctagggactatccaccaatgacagtcgcagctatcctcgttaccatttcttcgcctcctctcccactggcatggtgggagttgatttgggaggggaatattgtactggaggggctgaatgtaaaatttccactggatggccaaattagtttctaagtttgtgttatctgtactttgagctgagtgatacattaaatcaaaattaaagacatagatgtgcattttaaaatccataaatgtagatagtactctactccaaatttaaagactagccattattttactattagaaaaaaatagctactctaattttttcaaatataagcatgtctgaccgttaatatagataatatattttggaacgttcgtacggagtacgtgatagaaatgtgatagcaagggagcaaggagtgtccatgcctgtgcaacatgcggatgagcttcggtagaaaaaaataataatgaaatttaccaaaatttcgcataaaattgctaaaaactcattgtgctcccatagacaattagctgcttcaacacatggatgaaggcacaatggaatatatctggtggaggagcggagcaaatatgagtatttagaattcccacaattttattatctgtatataaaatctgcttcagtttttgtgcgaattgtctacagagctttcggtttaatcgcgtcatactgcaatgcaataaaataaatttgatatgtcctcatcatgagccgtccaattttggatactctcagtttctcaaacgtgtcgaattgctcagcagtacatgtacagtaatatatatattgtagaagtgaataagctaaacgagggggaataattaatttgattgtgatttagcatgcttaattgaattgaccacacgttgcaacttaacacgtacgcacgtataccatttatatatcttttgctactttctttaaagcaaaccaaaagaaattagaaaacgacgagactgaataaagttaaatttatgagaacaaatcaccacgcatatgaacaaaaaaaatggaagatgatatgggatgatagagcagattaaataggaaaaaaacggaagatcagaatatgggatgacaaagtggggtggttatttaatctgatgaatttgaagtgacttattttattttcatgcaaaatattcctgttattagttattactaaccaatatccaatctaagaagacttctcatctagaggttactgccatcattcacaatctcttggatctgatcgagttgagttattaaggtaaactgccattgacgtgcatgcatcccatcagaaagtgacactgcatcacacctaagtggatgagttaaaaagagggtgaagcaactagaaaaaaaaacccaatttaagccacacagttatggattaacacgccgccaatatggtcaggaaagttgggcatctacttgcaaaaatgtggggcccggatttgattaatgaaaatgtgattagatggtgatatgagagttttgagcaactaaatttatctaagcatgcatcctaccacttctttttttcttgctacataaagaatatacatgatagtgtatattatggtatcaggatagagtatagaccgaactattttggtacaagtctacatgtaaatgtgagtttcatatatagttaggtatgagttctacgagttcaacccagataggttaagaaaacgtcgattttctttgacccaacataaggtgattttgacggcacgtgtctacatgatgttggtagttcaatgaaaaatgacctagcttaattacagccaccagtttgagagtaaaatcttgtcctcaataatgagaaaaagtatcccatttgaacacatattattggtcaattaatattatagatatatgattttacattttccatggaaaataatttcataatagattattcatatgatgttaaactatataaatatttagaaataaatggttaaagttttatattataaatgggtgcccctcttttctttcaagagctacaagtacataaaagttattgtataattctagtatagttacaatctaattatattgcgattgcactatagttatgtttgaaagttttttactg

SEQ ID NO: 7012 - DNA, 10814 bp, Oryza sativa
actttataaccaagtaaatacacatatatcttcgatctattagaatcatatatactggatcgttgaattgaattataatttaccacgtctaggatgaataattgttgaacaatccggcggctaaaaggtccaacaaggagagttggaggttggaacagcctgtcacaacaggttttttgtacgcagttgttaccaacttcaacgccgacgacgacgtcgtgtggccaatcttcacctgtcaccgctggctcctgatggccggcgacgacgatagatgagagccaaatgaataagtaaacatctcatcaacaaaagccctaattaacatgctaattaagaggctatgaagccctagctgggtagtacttattttatttgtgcaagataggattagccttggtagttttagttaattaaagggggtgatttggggatggatggattgtgcttttacatccctcaaggcatcatcaatcattatccttcctccggctcccggcagatgatgaggtgtgatgcaggtgggatcgtgtgccacctggaggggaagattcctctttctctcaccctaaacttcagcgtttttcttagcctttgagcaagtttaatagtatagctaactgctagctctaatttatctatagccaatctaatagcttattcataaaatagttacatactacactattaatacctggtcccacctgtcatacacaccgtgtcttggagtccgtgctacagctggctacaaatctgtagcccgctgctcttctctctcctcatttatctcctcaaaatacgtttgcagctggctatagcctgctattgtacctgctcttagtggtggtggtgctagtgctacacgcacttgatgctgtaccaggataaataacacgcaatgcatgagcatcatgcccaccctaaaaggcagaaaattaacctcctctcttcctatgtatattgccatgtttaccgtgtattcatctatataattaaggtataggatgtgtgcgtaaaattgtttcattttgcattcatgtagataggtaaagctggtaccacgtctaattagttatgtgcttgttttccataaagatttttttttatttgcaccccttccttagagaattaaggtgccaaaaatgaagaatgtgattgaaggtacacaaaaaaggataagtgcttcccctgttggtattgcaccgtgaagtatcaggctcaaacgttcggctacaaaaacttctccttaaagatagttttggtcttactgtcaacagctagctagagttatgtcacaaacgtatgcatacacaaaccgacatacaaaccaatggtcaaaccagagaagcatcccatggtttccattacatacataataacttctttcatttatttgttgtgtgaagtaatacaccaatgatgaattctactacaaaagaaatagtgaaatcaatgacaactcatttttttttaccaaaacaactcaaagttttacgtgtatagtagaattaaatttatatatagttgtgtaaatttctacattgtgaattaagggaaggtaattcaatgaagttgtcagtcaaatttctactacattggtttatggagacatagtatttttttataggcaatatggagatatggattgatagtgtaaatccaaaaatgccgcttgaagacatgacgtagagatacctacatttgtacacattatttaatgagtactacaccattcaccatctatatattttattatatatgaatgcatgatatactacatgatgcatgcatttgcaagaaaaatcacattgaaagtatgggcaactcttacttcctaactgtacatgcacatccctatttatcacgaatagagtagatacatatgcacgaataaatatacagtgagatcacaggcgttactcgaactcttgtttcgaagggagcatggaaaaaccattttgaaattcccaattcttgtacctacttgttcatttacatcaggctcaatatttatttgaatttctaactgttgaggctaatggagaaaataccagtaaacaatatagaagtgatgcactgttgtgaccatagcaaagctcaaattcaactcccttttgggcccaattctaaaattaatctcccatgtgaaacgaaatgccaatcccggtcttgcccatacattaacttaagccggggcataataattggggtggttaacttaatttaatcaccaagattttttgcctaatcattaaaaaaaagggccacatggccatttattacctggaaagggagggattaacccacaacatgccaatgcatggccatttttatactcctctgcccctgaaccattggcacgcggataccaccaacgcggtgacatgacacgtgggcccatgcgcatgtgggccccacatgtcagtggcgtaagcgtgtgggccacctagtggggttgggtctgggagtgggggggtgttgggggggggggggggtccgcgttaatcgccgggcacgttctgcacttctttcgctctccggaagggcccacattacagctgttataatgtggtcttgtctgcctcctcctctcactcctactactactcctttaattattatttttttgtttttctccaattctcctaactaattttgttcccacatgtaaacttttttttttggttttttggggatttaattttgcctttgtaatgatttttttggctgttgctgatgctgctgcaaagtagtaaaaccaatcttggtgtaattgtttttctgctgccccttggatcctccaatggtccttggtttagtactggtcatcagtgcaaacaattgcttctaactcagatgaattttatatttttcatctcaaaagaaaaggtattgatgagagtagaaatggtgaggtaaaataaaaagggtaattttgaggataatttatgactaaatttccagtgtgaaaaatactcctccagcttagtacagtagatcatgaatcacagaatccaatatattcccccatggggattgaggtagaggagtttttgtagaggtatttgtgctcctctcccttttattacaagcctccacctttctctctcatcccacagtttcctacccctcctttcttcttcaccagtttgtctctctctctctctctctctctctctctctctctctctgtcctttcggttttaactagcattaggcaggtggttaggaggggaggtaaagctcaaagctccctcccctgacagcgcagcatcttgtttgttttatctcccacatcatctccctcatcatcatcatcatctcctcttcttgcaagcacccacaacaacacaaactctctttcttcatctttctctctcctcctcctctctttgttgtactctactcaacatttctcaactttcacttcttcttcttcttcttcctttctctcttcacagctatcatattctcctcctgcttgctgctgctgctgctggctgtttctctctcatccatccaccctattatttattcaaggctaagtgatggtatcttaattcttttttcctctctgcctcctcttcttcctcctcctctctctctcccttgctgttgcaggagtataatttttatttttgccaggcttcttcctgtactggtgtttccttgtttcctccctttcttgggcttcttcttcttcctcatcttcttttttttttgggttttctctctcctgccatccttttcacctctactagctctcctgatgtactgatcattccatcacctccattccccagtggtaacactcgtgggggaggaggaggaggaggaggtagtagcatgcagcagcagcagccagggggaggagggggaggggtgcaacaattcggcgcggtggcgccggagatgtcgccattctcgccggcgggaggaggcggcggggggcggatctccatggcggaggccgcgtcgcccatcagcagccggccgccgccggcgcagcagcagttcgacgagctcggcgtaagccgcggaggcggaggcggaggtgggtttgacgccgaggcgctggcggcggcggcggtcggcgaggagggagccagcggcggcgcgggggggaaccggtggccgcggcaggagacgctggcgctgctcaagatccggtcggacatggacgccgcgttccgggacgccaccctcaagggcccgctctgggaggaggtctccaggtaaaaaattcaacgccatgagcccccctcaagaattgctccgccgtcgatctcgccgccatggctgaattctcgtcggcgaaatgctgcatgaaatctcggcggcctccagaagcagtagcctggtgtgatttttggttaggctcagttaattaattaccggctaaaataaacacctccttttcactttttttcccttaaccatcgttcacgagcacagtgactttttttccattttaaaataatacgggtatcactctccttcctcacctttccaaagaatttttttttcatggccatctcttatcaagatggtggtacaatacaacacacgcccatacgcttcagatccgaaaggcatcaattccaattttgcaagcagaattggccataaaaatgcattcttttgcacaagcacaggagaagaaaaaaagatggaatttttactccccccctgcagcattctctctagtctcttcttgggatttgattcatcctagtttagctagctattgctgcatgtatgcacacaccttcctttctttatcttttccgatgggtgcccaaatcgagtaaaattctactccatgcatgcaactttcctgtgagggttacagcttaatttccttcaaattttggctcgccattgacgagctcgagcttaagcttcttcttcttcgtgttgtttttaatggcggcgtggtggtgggttgggtgcaggaagctggcggaggagggttaccggaggagcgcgaagaagtgcaaggagaagttcgagaacgtgcacaagtattacaagcgcaccaaggagagccgcgcggggcgcaacgacggcaagacgtaccgcttcttcacgcagctcgaggcgctgcacggcaccgccgccggcgtcgtggcagcgccatcgccggtgacgtcgctggccccgccgccggcgacggctgtgggggtgtccggcggggtgcgcgcccccgccgagccgccgcccgcggtggtgatggggaacgtgatgagcttctcgacgtcgaacacggaggagtattccgacgaggaggactccgacgacgaggggaccgaggacatgggcggcggcggcggtgatgagagggggaagaggaagaggttgtcggagggtggcgcccccgcgggcgtcggtggcggcggcggatgatgaggagggagcggaaagatgatgaggttcttcgaggggttgataaagcaggtgatggagcggcaggaggcgatgcagcagcggtttctggaggccatcgagaagcgggagcaggaccggatgatccgcgaggaggcgtggcggcggcaggagatggcgcgcctcgcccgcgagcaggagatcctcgcgcaggagcgcgccatggcggcgtcgcgcgacgccgccgtcgtgtccttcatacagaagatcaccgggcagaccatcccaatgccgcccatcatcgccgcccccgccatcaccgtcatgcccccaccggcgccatcccagcagcctcagccgccgccaccgccgtctcaccccacccccatcacctccgtcgcgccagctccgccgccgccgccaccagcagcagcagcagcagcagcatcccagccatcgccgcaggccaccaagtcgccattgccggcgacgccgcagacgcaaagcagcatggacattgtcatgacggccgccgaggcgcacgacgcggggtacgacgggtccggcggcggcggggggcagccgtcgtcgtcgcggtggcccaaggcggaggtgcacgcgctgatccagctgcggagcaacctggacaaccggtaccaggaggccgggccgaagggcccgctgtgggaggagatctccgccggcatgcggcggctgggctacagccggagctccaagaggtgcaaggagaagtgggagaacatcaacaagtacttcaagaaggtcaaggagagcaacaagaagcgccccgaggactccaagacctgcccctacttccaccagctcgacgccctctaccgcaacaaggcggctctcaactcctcctcctcctccgccgccgccgccgcaccggccctcccgccgccggagcacgcggagccggcggtgacagtcgccgcgccgatctcgcagacaccgccgccgccgccgccacagcccgtgacgacgaccaagaacggcaacggcaccagcagtacaaacggcgcgaacggcgaaggaggaggaggcggctccgggggcatgcaaatgcaggcgagcaacggcagcgtcgtcgccggcaacaagttcttcaccggcgcggcggcgaagaaggtaagctaagctacgtgcatccatccgtgtgcatttccccgtgtggccgtagcgaattggcgcgtacacatgtggtacgctgctgttcgtttttggtgatccaatgctgattgcgtaacgctgcgcatttaaagccagaggacattatgaaggagatgatggagcagaggccgcagcagccggcggcggcgaacaacgccttcaaccgaacggacggcggcggtggcggcggcggcgtggacagcgacaacatggacgaggacgacgaggatgactacgacgacgatgacgacgacgacgacgacgacgtcgacggcaacaagatgcagtacgagatccagttccagcatcagcaccaccaccagcagccgccgcagcaccgccaccagcagagcgtcgtcagaccgaacgccgccgcctccgcggccgccggcggcaacccgcccggcaccgccgcccccgccacggcggcggccgcaacgacgaccaccggatctttcttggcaatggtccagtgatccatccatccatccggtgactctctctccttcctacacatgcatacctccatgcgcgtcaatggcttcttcttcttcttcctcctccatctcttgtaccatttgtatctacctacctgtcgcctcctccatggctcgtccatatctcaacaccatcaaaaagctcaaaaacctaaaacctcaagaattctcttcctcctccggcatatttctccattgattcctcatgcaagctagcagctatacatctccatgccaagaaagaaaaattcgcccatttcaagctgcatgcatgcccatcgatcgttcgtcgctggatgttcctagcaagaaaaagctagtagcatcgatccatttcttgattcgttcttgtgttaattacagtggtctctcccatctcgcgtctcctcttagctagtgttaaaagcaaaaaaaaaggaattggtggcgtggtaatttattgatttgttgtggtaaatttaataaggaccctccattcgtgagggttcacggagagggtttaaaacttggtgcggtgaaaaacggcacagaggagcggtaataacacctcgctctcgcggttaaaaaaaaaggaagacaagggtatatatgcaaaatgttgcggtggttgtggttgttacaaattattacacctcggtaaaaatttgtttggctatgtgtactactgctcgatctactgtggcatgttgcaagggcgcggtgaaaaaaaaatcgaaggtgaaaaattaaagatgtgctcatcaagtgaagtggcagtgaaaaagcaagagagctggtgctggtgtatgccggaatttttcccatttctcttttttttctcttttctctccttcttttatatgttttgttttgttttttctaattacctaaactgtccattatgtattacctgagtttttttttcttcctttcccaaactgttgttaccgaagttttacagtgtatactcgcgacatattatatgttacattcttgctattcttataccagcattctttctaaataagtgtgatgctctttgtctactttatttatttttagagaaaagaaggattagaggcagatgcaacgatttaaattacatgtgcagctctggttatactctaggatccaatgcttaatttattgtaaactttttagttttagatcccataaggatcgatctcgatctttcaaatattaatataaattgctatgccacgattagtataagcatggggagatagccctcacatgccaaagattagtatagcacaaggaaggcttgatatatagggtataaaatttaaagcaagtaattatcaaattataaccgaggtaaactcattaaaataactaggtagcatccaagctagatgtcacggtatgttgtcatatgcatgcatgcatgtaaataaaaaaaatgcctgcaaaaatttaggtagatcaaaagataaaattcggtatgatcttgatcaacttaaattgccagcacaaaatcaactagtagaaggatcttgtgtagatcgccctatcatgacaacttcgagtgctagctaagagagcatgtgctacaaagtgacacttgattaattatcacttgcacaaattcttgctacttaaaccacacttttatacacactatgctactgtatactactcccagtagcactagtcctgtaattaaaattgtgctcctagtacgtgagataccctaccactgtagttttaggcttggatgcctcggagttagagccagcaggggggggggggggggtgcctagctatagtgagtatggctgatcctttggcaagcatacaaaattagttttggggtcaggctggcttggctgtggctggggatccctataaaaacggttgaagtgtggggtaatgtgtctgccataaaaggttaaaaagaatggagctgtgggattgatgcctcctgtttaaattatggaaaaacgtgaaggtgcagggcgcgcgctcgttcaccttcttgccattcgtagctctagctctactccctcggtcccaaaacaaaaaatacttaaaagaaaatataactttttctcctaatacaacgaatttgaatagagggttgtccaaattcattgtaccaaaaagaatcacatctagactgagggttgtccaaattcgttgtatcagaaagggtcacatctcatactatgttaagttttttttggacggagggagtatgtagtagtagcagcatcatcagttctaaggttgtaccagaaagggtcacatctcatatgttaagtttttttttggacggagggagtatgtagtagtagcagcatcatcagttctaaggtgggaataataattttaggatttttgatatgaaatggaatagtttcatattctaaatacaggagttcgatctcaggattttaaagaatttttgttagagaggtaaaaattttcgtattctaagagggattcggagagggatggagctaattctaagatggtggctcgcgtacgtgccatgtacctaggagtacattatatttgtggatttgaatgcaacatttccactattttcttttgtgaagggaaacactaggagggccgtataatacactgtcaagatagtgcactatgcatacacgttgcaataatttagtgataaatctatccattatcttaaaagaagagtgataaatttattatataagtttatcgtgtttgataatgtttgctatcttatgacaatagatttacatgagctacatctacactctaattccctagtacacactattcatgcatcttttctcacactcttcatagcttcttgggcaattggcatgagaagggagagcttggctctacactctactttcttctggctgcaggctgaatgttgcacatgggatggtgagaaagttaaaaaagagggagagataggaaattaggaacagacatgtccaggaggagcccacacaatgccaccttgcttcctacttgtgctcccttagcttttgttcctttatttttttaccactggctttttatcttgtcatggtggtagtaactattaagtcatatgtccaatgcgtaggagggccaattcatcatctgccaacctgttgagatctgcgtgtgtaaattcagtgtacaatcatgtggcaatagcatccgcatatgtataactatctagaccagtaacaagtgtaacaaacagttagaaaatgctagacaaaccaaattctaaaggcattttgcacacaaacctcaaaatctgaaacaatattccaagtccaagaaaaatttccttttcttacctggatactagggtggtgtttggttggagggactaaagtggagctaaactttagtcccagggactaaatttaatccctagttcccaaacaccccctaggtaatctgcaacagggccatccactgagagtttgtgcatggaaaaggcaggccctcatgcacagaggtggctgcagaagattcttttggtgagagagaagagtgaaccaatgctacttcaacgtactaccagtagtacgttttattcaggaaaaagatggcaaagtgcacagggtaataaggtgaaaaagagagaaaaaaaagaagaaaatagtactggcttaggcacattgagaattcactgttcccggcagcatgtgcggtgactccacggttcacgaggcggtgttacttgagggctggaaactgggcggtatactgaagggcgaaaaaaaaaaactggagaaa

SEQ ID NO: 7013 - DNA, 1644 bp, Oryza sativa
actaactataaactatatgtaattatgtcacatccacctactaccagacgtgatttacagacattttttagatggaagcttaactatataagtttgtgtcatccaaagtacacaagcacatgctaaatgttagcatgaggttgacacaatgctaactgccattgcaacaacagagaaaaaacagactagttaacaacagctgctgcatgcatacctagtgaatgattcacattgatcaaccgatgatccatattaggagtatatatatatatatatttatcatcatggaatgaacagttcaggagagaataaagggttcctagctggtgagctaaaagggggaattgcatgaacaacccaactgcattgctgctgtgatcatcaaccaacctataattattcatcctaacatgcagaaacatcaattctgcgttgatccataatggagtttaattagaggaagcatggcacatgccaaacacttgtcattggggcaatgctgtggtcatatccagcagcatgagggacatcctcgacatacttggtcacttccatcgataggtcaacccatcaaacggtactttcaaatatatttatatcaagaatgttattatcagcattgccaattactctagcaatctcccacatgcaaatgcacagtgttactttggaacagtcattctcagagattgcgtatgtggcttggtttaatcatcgttgttaaccggtaatcgagtgatctatcagcaatgcaagcagccaagctggcagtaggtggtagtagtagtagtagatacatgttgattgatcgagaggccaataagaccttgcatttcgcagagcataattggtacctagttgcagggttaacgtgctactgctctgttagttgcaatgcactcaaagcgattaaccattctatatattaattaatttctccaagaacaacaagatcgaagagatagtgccatttgccattggtctaccatggaggaggataagattgtgcattagctcacatgctctggacctcaccttatccatggcgaatccatcattgccgccatgatcgagagagatgagaggccgggagatggtgttgttggacatgtgtgatgtgatgatctctgcacccctgtctgtcctgtcgagtgtcgatcaccactgaaagctggagtaggctgcatgcatggatggatggtccccatttcgttgcaacttttcaagaacattcgacagcaatcactatacttgtactgccagtggtagtacattaaccacgtcgatcgactgctaattaagcattgttcctgcctgccattgtctcgacgactgttcagagccgtcctactctaccagctgtttagctaagctgattgtagtttttggcttcgttcgagtccagcgttcaaaatttcggtcctatcggtccctttatatgatattatattggccgaaatttttattttaaaacgtttcatgaattttaacaatatttattcaaatttgactaaatttttgaaaatattgctatctcgacacccttaatacaaataccgaaaacgaatgattaagccctagtcgagtctgccactcgtcaattagctcgagctcgattgactcgaagctttaggtggtgtttgg

SEQ ID NO: 7014 - DNA, 10616 bp, Oryza sativa
  unsure (1)..(10616): unsure at all n locations
cggccggccggccggcgacaagcagcgccatgtgagatgatggctgatgtaggagaacaccctcgtgacaataaaaccacagaagtctggctccatgcatgttaatttgctactgctgcagtagtggtttcatgaatgcgacttggatggatggatggatagatccataccctgttctgagcagagaccggacgtgccaagtcataacatgtttgaacaacgtatattctttgactccacaggtccactagtacagtgttgtaccgtatcatttcatctgcagggatattgctgtagaaccttttttctttaaccaaaatacaatgttaacatatttaattacatctgcaatcgtacataatttaggccctatttgagattgctttaagtgaagatgaagtgtacgcacgtaaaaaaaactttagcatgttattaattaagttttaattaatttaaacttaaaaatgaatttatatgatattttaaatcaatctatgtatataaatttttcgcatgaaatatagtgtttgacagtttaaaaaacgtgctaacaaagaccgatgtaaaatctgtatcttaattgaaacagtaccttaaacgccaatcaattcgcaaatgcgtcggtgagccaagcttgattcggcagaaccgcaaaaacagatgaaattcgagcaaaagctatactactagtacgaatcttggcaaaaatgcagtatgaatcgtccttctccagttcctccagtccgtgtcatcgtgctcctggagtccttgctagctactgtagtagtatagctgtcatggcaggtggggccctccacccagcacgccgcaaggttggaccgccagcctggcgccccatcccaccatccctccccgatccgatcgccgatctcagccgcccgcaccaaattcaaatcccccgcgccccgccacgtcaccccccccccacacgccacgtcggacagaatccggtacacgcgggcccgtcacgtgactgctcgccgccgccgccgccaacgacgcaagcaacgcgaccggtgggtggcgcgagtcgctggtgataataccacgggatgggggagaacgcgtcgcgagtgtgtacaagaaatcccagcacgaattgtcttttgtacgcatctaacaactaccagtactactactacctgtatgtatatatacacatcaatacgcataatgcacagtgcattagtgcacgatcgatgattgattgcattgtgggggaggtatgaataagtgtaccggtagtaggccgtatagcacgacgcagagcaacatacggcaacaccaggagtacgtacgatgccgtgggttattacgtactcccccgtcccaaaaagaaaacaacctgtgacgaatctagacaactcttatccagattcgttgtattaagaggggataaatttagattggtttttttatggagagagtagaaaacgaaaagaaattagtatcactacagagccaacggcctagatatatgctctctacattccaaattgatctgcatataattttttttatgttattcctaaattatctacatatttgtgttcatttattaagtctattcgttatttgtgcattggagtaaatggacattgatgcatgcatccatgcacacaagtatttataacccacatgcaatatcttgatttgctattggctaagaaatagtagggatggtgtatacattgagtttgttgctagagtaaatatagtatgagagagttactccgtattagtttttcttggtctcgatgtacctataaaatatatagatcaatttgaaatgtagggagtactgtctccgtccattttgggatgggggaagtatctagctcgccgtcgttctttcgttcgttcgtctcgatggccgtcgggccctcccccgcgtgccaatgatgccacgccatgtgatcgttcgccgcgctcgcgcgcacgcctttacacggtttacaccagcaaagccagcagccacgcacgctggcgcgagccgctcgtccacggcgtcgcgcgacgcagaccgggcgcgggctagcgaagacatcagacatggcacatgcatcccgtggatagctagctaagataggggggctgttgctgctggcatggatcgcaaaaggttgggcgcctttgcgagtttgcttcgctttggtctcacctttgatctgcctttggagcagcctactactagtacgctttatacccagttgtagtactcctccgatcgatctgattcgatgctcctgagagtgcttttctttgctggtttatgatgactgatgagaggggaggggttgatgtgtgtcgaggtgccatttcaccagcaggttaatctcggagcaaacgagcccatgagcgatgcaaatccttattaatcctacattacctctatgtactaccagtactcagtactgatgatcacacgctgcactgttttattttactcctgcgcagacgtcggcacatgttttataacagtttttccttaaccaaaaggctcgcaactggcgtagcttttcagaatttttttagaaaaacgatccataccatacgagcactggtacgccagcagctagctactcctagctctgacatgttctgcaggctttctgagccatacgcgagatgacgcaaggcaagggcatgtgtcgtcaggacaaggacgcccccctctccaataatctatcgctgcacccagctgcaatcattggccgcccggcgcagggtatcgatgcagacatgtacagtggagtatcatcatggccctgcacctgcaccactactactcctactgccagtctaccactgaccgactactgtacaactctcctcggaaagacaagcctcacaactcacaagtcacaagcttgtttttttttttgagacaaaggcggcatgccattcattgattaagcaacatcatcacaaagtatgtcccggatataatccggtattacagaacggtacacagtacaggtagacagctcggcattccgagctagagaatgagccgccaaattggacaaccggttaacatgcataaaagagcataaaacaaaggtggacgccaacttcttgatatcttcaatcacgcatcccacccctgagcgatcccttcctgaagtttggatgcgtctgattacagtgagacaatcagatgccatgacaatgtgttccaggccctcttcctttgctagacccagtgcccgcctaattgccagcgcttctgcaagctcaggtagcaccacatcgctgatcatctccgagcaagcaaccaggcatttccctgtattatcacgaatcaaagccccgacccccatggtcctggacgagctgaaaatcgcagcatcagaattgatcatccatacgctggccggcggtggctgccatctaggtatggcttgagtgtttccaccccgctggccatccaccgtcttcgtattgtgctttagaatcatgtcgacataagacaaaattttgatgacaacacgttgggggtgcactgtgccattgttgttctttgtattgttccttgcttcccagatgtgccaaaaggtgacagccaaaagggtgtttgcatggctggatccccgtttcaggaaatcaaagatccattgcctcatggttgagaacccatttcttcctagtttgacagcgcacttacccttgatttcctcccagatttgagcagcaaaggggcagaacaggaagacatgttccactgtgtcatctctgttgcaaaaaacacagccatcagtagaggggatatgccgtcgtcgaagttgaaacccagtcgctaagcattcatgagcagcacgccagagagtaattttcatctttcccggcgcattgattttccacaagcccttccaatccttttggctttcaagcagtctcgacgccattcctcgcccactgttgctctgatcagcaaagaaagcttctgatcgcgccagattgtaagccgaacgcacagagtataaacccagtttgtcatgtggccaagaagcgaagtcagcatcaccatgtctactaataggaatctgtagaatctccttagcaatgtccacagggaagagggatcttatcaaatctccatcccaacatctggcatcctcgttcatcaggcagctaacagtggcatctgttgggaagggagaaagcgttgtcaccaattgaggtcgaaacccaggtatccaattatctgaaaagattttgatggttttcccatcaccgactccccacctcactccttttgccagcagttctctcccaaacagcaagcttcgccaagtgaaagacggcgatttcggttgagcagcctcccagaaggacgagttagggaagtatcttcccttcaaaaccctcgagcacaaggaatcaggatcagtaagcagcctccagcactgtcttcctaacattgcttggttgaaagtagtgaactccctaaagcccattcccccaagaaatttaggagtagaaagccagctccaagatttccagtgcatttttttcttaccatcctcaaagccccaccaatgatcggcaatacaagtcttcatcttttcacagattgagacagggatgcggaaacaactcataacataatttggaattgcttgggccactgctttcagcattgtctccataccggcccttgacagcggccggtcagtccatccattaacccttttccaaattctttctggcagaaacttgaagaaatttgtggtagcaagcccaatttcagtaggcatcccaaggtaagagtcttgcaagacttcattatcgacttgtaagcagcttttcaccgatatcttgaccgcatcaggacatcgtttgccaaaaaagattgaagatttgtgcaggttaattttctgtcccgacgcactgcaatatgatcgcagcgtgtttttgagtgcttggacattcctgctgtcagccttagcaaagaaaatgctatcatccgcaaacaacaagtgggagatagggggtccatgcctgccatttttaattccttgtagctcacccgctacctccttcttgtgtagcaaacatgacagtccttctgtgcacaaaaggaacaggtaggggctgattgggtccccctgtcgaatgccccttgaagggaccaccggcttagtcagctctccattaattttgacggcgtatctcactgaggagacacaacgcatcacagtgttgatccaatcctgggaaaaaccaagtttcgataagcaacccgaaagataagcccactcaactctatcatatgccttcatcatatcaatcttgagtgcaaaaaaaggatttttgttgtgttgtttacggatggtatgcaaacattcatatgccactagggcactgtcagtgatgaggcgacccggcacgaaggcactttggaactcagacacaatatctgggagaaaaggcttcagccggttcgcaagaacttttgaagcaatcttgtacaggacattgcataaactgattgggcgaaattttgagaggtgactcgcattgtttaccttgggaatgaggacaacaaccgagtcacaaagaccttccgggatctcctctcctaacaagaaacctctcaccgcattacagatgtgttcctctaggataccccaatgtgtttggtagaacaaagctgggaatccatccggccccggagcctttgttgatcccatttggaacagtgctgtcttgatctcctcattagtgtactgtttgcccaattccccattgataaagtcgcctactttatttgggatagcatccaagacttcctccattgaatcacagggctccgaggaaaacagattctcatagaaaacttcagccatgcgcttgatcccttcttgggaaatacatctagagccatcatcacgaaccagctccttgattctattagtccgccttctcgccgatgccctggcatggaagaaagcagtgttgcggtccccttcacggagccaatccactcgggacctctgacgcgccataatctcctctttctcgaaaagttcacagagttgttgctcaattaacttctcttcctgaatcaccacgtcattaactggtgactgtcgcagggatttcagcttcctctccatcttgaggattttcctgcgcacagacccaaaggaagccttactccagtccttcaaagacactgcgacttgttgcaagacactccaaactcccctcagccccacgcatccagcagaagagatcctccaagaattttctaccacctccctgtaatcctccgcccgcaaccaagccggctcaaacctgaatccctgctgaatgggaattctcctttgaccgtggttccttctcgacaagtcaatagagatggcgtagtggtctgaggatgttgttatcacattttccaccaggcagtcctcaaagtatctcgagaactcgccatttgcgacagcacgatcaagccggaccttgctattactgttagcatcctgcttattggaccatgtaaatttgggaccaacaaatcctaggtcaataagaccacaatcatccaagcaacttctgaagtgttgcatatgtggctctgatctctctcgcatccccaagtgctcatcgaggcataaaacctcgttgaagtcgccacaacacagccacggccccctccactgatcatgcaaccggcgaaggaggttccagaaaaaatgtcgaagctcacgtttgggttcaccgtacacaaaggaaattcgccaaggaggcaactcctccgtagagaccagcacatcaatgaaatgggagttgaaccccctaagagaaaccgtgtaggctgtagtccaaaacagggctaagcctccactaaggccctcgcagctcacagcaaaggagccggagaaaccaagtgaccacatcaaatttcttgcctgtttgtccctcatcttcgtttcagacaagaagacaagggagggtctcaaagacttcactaaccagcgaagttcacccactgtcgcagccgaccccaagccacgacagttccgaccccaagtcacaagcttgtttggttccatgggcagggacttatatttttttagagagggtccctctctcccaaacatctctttaggtcttagcaccgtatacaatacgactagggtcttgtttggtttcatgggctaatgtaagaatttaaacatgtgggctaattttgatctaaaatgaattagcccccctcaaaacattagcccctccaagagatgctaatggagctaattttgtgtgaggactataaaaaccagctctctctctccttctctcccctctctttctactctctctctctccaccttttagccttgaattaactcatggatccaaacatgccaccctagactaatatttagcctaccaatttatgactaaacattggctcttaaaattagccctgggctaatctttccaacaggcatagtacaatactcgtacgtatcatatgcactatcgtgcgtacgagtactcttggcgtgtcacggtcaacatagatctcactgttggcgttattgtgacaatgcacaacttttttgacgtaggggcactgtactactagtagaaatactagcgttgcccaagagattgttcacgtgccacacacatgcggcgcacccgtcgatcgaatcgaggggagtgcacggcttttgagttgtgaccacgcgtttggtcgggcctgggctgaaatcgtgaaagtttgtcgggccggatcgcgggatcgaggcggatggaggcgcgcgcggccttcgaaacgggacgaattctcgccgaccgcgtttgggccgcctgcccggatttgcagaccgttttgctcgtctgggctttcactatgttttgggccgcaaatttctggcctaatgttttcctcgtccagactccagcgacgaacgaacagtggagttgcgaacttgcgatcaagctacagcagcagcttgtctgattttattcgataaccaaaacaaaggggtttatgcatgagtagtacatacgaacgtagcggaattcacgatgccagcatcaccatggctaagaagcaaaaaaaaaaaaagtatgagcgcttcgactgttcgacacgattaagatagtgtccagcgacgtacgtgcatgcatccgtacgtaacggcatatacgtagcattattattctaggtcgtcctcctgggcacgaggcgcgcgcggagcggcttggccatgacggtggtgaactcccgcttctcggcgaactccacctcgtcgccggccacctccttccactcgaactccctcaccatgttggccacgaagtactccaggtggtgcatggcgaagctgagccccgcgcagatcctccgcccgacgccgaacggcatcatgcggatccccttgctgcccgtcacgtccaccccctcgccgtcgccgccggggaggaaccgctccgggatgaactccattggcttcgcccactcccgctcgtccctcccgatctcggccaccatgaagttcaccgtcgcgcccttggggatgaggtagccgccgacctccacgtcctccgccgccctgtgcggcagcacgaagtgccccggcgggtgcttccggaggccctccagcaccaccgccctcaggtacggcatgccgtggacgtcctcctcggtgacctccggctggtcgtcgccggtcttggacttgatctcgtcgtggagctttgactggatggatgggttcttgaccagctcggccatgatccactgcagcgcggtggacgtcgtgtccgtgccggcgttgaggaactcggagcagagcttgatgatctcgtcgtcggtgagcgcgcggttgccgtcctcggggagcttgatgtcgagcagcgtgtcgacgtacgagtgctccaacgtggtctctttgttcgtcgtcttcgtcgtctcgccgccgtgtttcttgtactcccggcgcgcgttgatcagtggcatgaagagctccctctgccggcggcggagggcgtagatcttctcgaggcggccgcggaagaggtgcttggtgatcgccgggaagtaggcgaagacggccatctggctcgtgatgtagatgagcaggtcgcgctgggcgtcctcgacggcgcgcaccgtggcctcgtcgaggcgctcgccgaagcacatattcacgaggaggcagaacatggcgtactggagcgtgtccacgacgtcgtggggtgcctggccggacgccgccagcttgtcgacgatgacgcggtgcacccagtagcgcgccggcgcgaacaggcgggcgcgcgacgggtgcagcgtctcggagacgaggttgcggcggaggaggcgccacacgggcccgtacccggcgcgcgtgatgatgttgtcgttctcgccgaggagcctgctcgccggcacgccggggcggtcggccagcgcggcgccgccctcgacgagcgccgcgtgcgcgaggcggcggtcggcgacgaagacggacactcgcgtccccatgcgcagcgacacgatggggccgtaccgagcgatcagcctctggaggagcagctccggctcgacgtcggtcagcgccttggtcagcagcacgacgctgccgagcaacggcaccgccggcgggccgggcgggaggcggcggccgcgcttgccgccattgccgcggaacagaatgaacgggacgacggcggcggcgaggattgcaccgaggatcaagtacaagttgtccatggtgaaccggagcttagctagctagtagctcaccacgtacgaacactacgagctactgagtgtgtgtttgtttgtcatggctagctctcactctcggcgccaatttatagagatctctggccgatcgatcggagacgaagagaacggacggacggttagaaattattttctacacttacctgccatactgctatgtatgacacctactttagacagttatataaaaaaatcataaaatttgataatatagactataataatataagacgctatacaaatatgcaagtctaaattcgatctacacatgaagaaacaataataataaattttatctgcattgtacgggtactatttattatttgatttttataattttttatattatagataaaagagtaaagtgcattggcggtccttaaacttgtagggttgtgtcgtataggtcactaaactctcaaaatatatatacaggtcccagaacttgtcaaagtgtatcatctaggtcccaaattgacacatcacctctagtatcctacgtggcgatgatgtggcatgccacatggatgtgacgtgccatttttttttcttcttcgttttcttctcattcttcttttttttccctttcttctgctcgggtcacagagaaaggagtagaaagggaaaaaaagataagaaaaaaagaaaaaggaaaaatcttaaacgagacccatttgttagtcaaaatgatgacacgtcatttcgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7015 - DNA, 1718 bp, Oryza sativa
  unsure (1)..(1718): unsure at all n locations
aannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccatgcacacaaatatttataactcacatgcaatatcttgatttgctattggctaggagatagtggggatggtgcatatatctagtttgttgctagagaaaatatagtatgagagagttattagcttttcttggtcttggtgtacctatgaaatatgtagatcaatttggaatggagtgagtatgtcacatctaacgtcagattgtttttatggaatagagggattactagctacacatgctctgaatcagtcagcggaaagagtataaaaaacaaacctaatatcgaatattgtaatactacaaatccagatatacatttatatccagatatacatttattgaaatttatagtagtagaatgtgtaataggaagtatttgatatcaggtttttttttacagagtgaatactagctacacatgctctgaatcagtcagcgggaagagcatgcatgagcagtgtgcgcacaactgtgcagcggcacgatgatggccaaggagaaagtggagcttaacgttgttggttccaattaattactaattcctctctggtttaatttgaaaagagcagggagccaattgattttgcgctagctgagtccgtctgcatgtgtaactgtgtactccctccgtccaaaaaaaaaaaggcaaaccctaaattttcataccaatgtttaactgttcgtcttatatgaattttttttataattagtatttcattacgcgtgacttatctttttaattttttttcatatttttttaaataagacggatgatcaaatgttggacacggaaaccagagtttgtcttctttttttagacggaaggagtatggttgtagctagcttttactgcggtggtcgtagagagggtttgatttccaaaaggtgttcacgaggtcgggtttccggccgatcgatcgacagcaaaactagctagggttgcccggtatgtacattgatgtgatacggccgtgtaggtcactatagtgacctaaccatacatgtccatatcacaggctagatctgatctctcatgctttgcttacgattaaggaatatatttcagtacttccttcgtttttaaatatacgatatattaacttttagatagacgatgtttgaccatttaccttattcaacaatttagtaatataaaaaaatataaacaatgcttaaaatatatgcaatgataatataagtacaacaagataataatacttgcataagttttttaaaataaaatgaattgttgcatgttcaaaagtcaatagcatcatatatttaaaaaggaagataataactcatttctactaggacgttgtgtggtaagtagaatatcccgtgatgacctaggggttcactaaggagttgaagagttatgatcactttagtctcatatattgatgactacacactttttttttgggggagggggg

SEQ ID NO: 7016 - DNA, 4520 bp, Oryza sativa
  unsure (1)..(4520): unsure at all n locations
taccctaacaaatcagacttctcatcttcaattctgttgtcgtgtgtgcctgccttctctggatccttgatggcatcatcaatatccttttgctttaagaattttgaattgcttgtctccaggaatacaggagaagggttatggtctgctgcagttggagaacgcctgctacttgtgcgacgcagcactttatggattagccctcttggtgaagtaagattctgctcatgatgatcagacttctgaatttccatcttttaagggagcccagtacatgcataacattgggagatgctagatgctatagaaacatgccaataatggcatcactcttataagctcatggaacaccaacttatggctgtgtgcttgcaaaacatatgtaacagaacatcaagcaggtaataatggaacagatctgcgcctaatgattgctgtgccaacatcagtanccaatganagcctcaatgaatgagtagcagctactgagtgttcagttaaatcatcctatacatttataagaaattgcctacctaatatgatagtttagctagggatgcaagtggaccagatcaggctgacccattgaccccttctagttcatttgagtgcaaataatactaaatggaccaccaataggtgggagtgatccctagaccattaccatagtacttgaggaataaattataacagatcctacaggtgaatttttctaggtccaccatagccaggagctaccctgcatcaataattcatctctatttgaactatgccagacatacaaatatcgatgtatgaagctgaaacactcaacaccaaccttttaatcaaggacagagatcaagccaagtcaaaccacacagaccaaaagggaaaaaagtatttagaaagctacatagaacaattaatttatagtgccactttgtaaccaacaaaaactattttaaaatgaaaggttccgttgttggcctgtcaaaggtgatgacagaaacttaatgcatatacatatgcatgccattaggtgataataacatgagtaaaacgcatggtcattcaacatgtttaggtgtgtcatataggtcactacttccaaaatgcacatttaggtcactaatgtgagttaaatgagtcatgttctcatctaactatccatgtaagcataccttacacatgacatgccacctaagactgaaaaaattacttctgaaaatgtgcagacctagcaatgtaattgagtggaacaaaaacatagtgaaaataaaagctgctagggtttgatggcaactgagaacttgaactcgtcaaaataggcacatgaaataatttagtttcactaattccgtgtattgccaattagtagtgctctgacaaaggaaaaaatacacaaagagttttctacacatttctagatgcaattttttaatcctatgtggcatgccatgtgtacaaggtatgctcatgtggatagttagatgggtaaatgactcacttaactcacattagtgacttaaatgtgcattttctaagtagagtaaccaatatgacacctaaacaagttgggtgaccctccatgcattttactcattaaacatttttttgacaacctttatagaatttatttataaatatacgcatcataggtccatacaaataaagagtagtaggcattacttatcattttaagagatcccacagtgaacaatagaatttacgatttcatgaagtgggcattcatagcaaactcaactatatgttttatactcaatgaacaaaggaatcaaagggacatctcatgttgttacttttcatacagcatatgaatctgtcttatagtaaacttactcaatggtgcaaaccttactcttatagagttacagtaagatgtctgaaggtgaactacagatgtcggtgtaacttccatcaatcattagggaaattaacttccattctatacaaaattgtacagatatacatgagttattccgattatgaaacaactacacctatagcatctacatgatccttggtttgtgaaaaaacacaagtgatggacactaaatgttcctaaatcttgtgggttaggaacaaatattgctcaaggaaagctatctgctgcattgcccaatgaaaaaacaacaataaaaactatagtacatgaagcacatgaggcgtatcaactggattcatcacccgtccaggacgggaatgaagaaaccagttcagaaatgactcttaaggatctgcaaccaatggatagtggccaaggaaaagactaataagcaaccgaagagaacatcatgttaggtacaaccttggcacagaaaaactgcgtctacctaaccacagaaatcagaaggcaaaagcatcccacagccacagcccacaggactcgcaccacagccctgggcgaaacgccgccgcccaaaccgaattcgcgcgccttccagagcaggcacgccgaggaggaggaggagggcactcaccgatcggatcgagccggacggaggccgaggccacccgaagcctccccaccgccgcgggcgctccggcccaccggaaaatccccgcgccaccgagctcgattcggcggcgaaaccctagcttggtcgaagcaaacggagagagagagagagagacggagcgcgtaaccggtggaggaaggaaggaagaggaggggggaaatttattaattaacggagagagacagcaaggcaacgacgacgaggaggacgaaggtatagtggggggagctgctttggtttgcttttaatccccgattagactgtggggattagctgctaatcgtgccatttcctgcgtgctaattatggcacgtagcgtgtcttccacgaagagacgcaggaaaggaaaagggggcggacgcctgctttctctttggattttatcggcacgacccccgcggccgcacgatgggaatttccgacagcttttttatttgggtagattcgtgttattataatttttgtggttttgttattataatttttgtggtttggggaaaaaaaacattcttactgtttagtactctgtactgtttttgagtggttatttcgattcatgtcattataatttcacctttattaaaaatacgctaatttttagatcatattaccctcatattcttccttcatcctctactctctttcatattcatcttctccaccgctagatctgacggagctgatgtcgttgaatggtagctctaagcagtatgtggtgggaatagggcagcgttgttttccctcgttggttgaccctgctcattgacctatttgcatgttcacacctcgaagcccacaaccctcacctgcacgaggagcttcccaactcacagtcccaaaccccaagaaggcactcacctttgagctctcccgcgatatgggttaggatgtgctcttgccgctacctaggaaggaggaaggtgaagtgggataggtgtcagagctcgcggttggacgcgacaaatgggaggatgggagaatggtgtggccagtgagggaggggatgggaagagaagagggccctcccatcgtggagcttgtcgcactactctgcaccgttttcactacatggaactcgtcggtccgagtccctgatctaccacttgttggcaccgggagaagcaagggcaatggtatgagcttgtcggcttgcgccttcatgatccactccgccatacgccatagtgcgccgaggagcttgcgggagaagggagaggtacggtagcagcagaaaggggatcgaggggagaccggccctcggtccgtgagatgatggggactcgtcatccgtgccatcgccaaggctcgcttcgttaatttcatcaggttggccgcctcaatcttgagaaatgaactagagatgaaaagtggatgaggagaatgaaaagggtaatatggtccaaaaattttagagaaatatagtaaaagggtaaagagtggcatattttgaataacaacttcaaaactgtaaaataataacatggatccaattaacccggtatggccgcggtacactagcgtgtacggtgaccccacctgtcggcctccatcgctgacgcgagttcatcgacctgggtgtgttctgcatctgcacatccacagctcggccaatctttggaaaatcataatttagggaatttgggcttttatgatgtgcaacataagtgagcccatcttattcttcagacttactgttgggccactcatcttaccttcacgtcccatactgccatctaactaaaggaataagttcacttgaagtcccttaatttgtcgccgagtcttaaatttgtccctgcaccacaatattagatagaagcatctttcaactaaaaaactactgacttcgatagttgatggatgcaacatatctgatattgcggtttatggatgaattttagacttgacgatgacttagaaacctaaagtgaacttattcctaaactaaatgggcttgctttgtaagttttactgagatctgggtgttgggcttcgtaa

SEQ ID NO: 7017 - DNA, 12051 bp, Oryza sativa
  unsure (1)..(12051): unsure at all n locations
atatatatatatatatatatatatatatatatatatatatatatatatatatatatatatatatatatatatataaaagtatgtatgtatgtatgtatatatgtatagattcattaatatccatatgaatgtgggtaatgctagaaagtcttataatatgaaacggagggagtatgtggtgagcgcgtttgcccatcagacttttcattataaattgtgtgtccattccacaccgcttcagatagattttggagggattcggttcaggtgcagtagctagtgtgatattgtgactgcaagttacacagtcacaccagcaccactagatttgaaacatatggcccagatgcattagaatactgtagcaaagtactgtagcgttgctgcaagaactagtgctgattcactgtagcaaacgatttggatcattggatcaagaaatagagggatcagattatgcgcagtagcaataacaactgcactggatctcaatccatttttgagatatctaggagttttgtgcattttcattgttgatcaaaatccaaagtcttttattctactaccctcgagaaggaggagatgtaaattagatctattggatcaatagacccgatgaactccgagaaaatccattgttaaatggcctataaaacgaaaatatgacatcgtgtaccgagggatattaagtttagagtaacaccaataaactatttttttctcgatccgcaactaatgttgatggtattgttgtaattccatctatgccttcccagactacattagaaaatactcgttttagaccttctcagaagaatctttttacctgtgacccttaaatggcgtattaactttttattagtttggtgttaaagcctcttttaaatggtgcatatgagccttaggatacatatccaaacattttaggtacatgcaaaaaagtagttaggtgttgtatgctttagagcaagtctaatagtatagctcactactagctccaaatcatgtacagccaatatagtagccaattcatataatagttgcttactatatactattaatgcatagtctcacctgtaatatatacgttatgtttttgagtccatgctgtagctagctacagatctgtagcccgctactcttctctctcttctttatctctttaaaatatatttatagctagtttatagcttgctattgtacctgctcttacatgagttttggcatctatcctatgtgaatggctagaattacagcctacagcccccaatgctccaagaatttgagtcacaattattttcccttttctcctctccatgtggtttgtgcaaaggcaactattttgtccttcttgtggtgatgtttggacacgtggcatacttgaatagaggaataaagtttatcaagatatggatgctatggtcctcaaataaaagataggaattcctcacaaaaaacaggagaacaaaaatagacatggttggctgacattaaacctccaaattgaaaaataccgccaaaaaagaagccatggatgaagcagattatactatcaaactgctcatacgccttttgcacatttgtttcagatgacacttgtatcaccattaaagcagtattgaccaaacaaaaacaggccttatttagattcaatttttttttccaaaaatgtcacatcgaatgtttgaacacatgcacagagcattaaatgtggacgaaaaaaaaccaattgcacagtttgcatgtaaattacgagacaaatcttttgagcctaattacgtcattatttgacaatgtaatgctacagtaaatatttactaatgacggattaattagacttaataaattcgtcttgtagtttacaggcggaatctataatttattttattattagattatatttaatactttaaatataaatatgtatccgaatatacttaaaaaaattagccaagaaactaaacatggccacagttaagcagagtataggagtacagttaagcagagtataggagtaatcacaacataggaacaatgattgatgggatggatcacagaatatgttctacaaggtcccaaaagaatgaaaatgaaattcctttgatcacaagttctaaacacatggcaggacattagtaagcatcctaatagcttaatgtatagatcgccacacaaagatattcttttttaaaaaagcatatgatgcacatacactacaagtcaaaactatttcgtagaacagtggtctaccactaaacactcaaagcccaccatcctcctccacgtgcaggtttcaaaccgctaacatgggtgagtgaatctgtattcaaattcaaataaatatatttaaaataccccacaccgaacgaagatttactcccatttacacctaattaggtggtggttggatccaggaacttaactttagtctctatagttagacactaatttagagtattaaatataggctacttacaaaactaattacataaatgaaagctaatttacgagacaatttttttaagcctaattaatccataattagggaatatttactgtagcatcacataggctaatcatagattaattaggcttaaatgattcgtctcgcgaattagtccaagattatggatgggttttattaatagtctacgtttaatatttataattagtgtccaaacattcgatgtgatagggacttaaaagttttagtcccatctaaacagggtcttattcttttaacggtagacgacacatccatcatcagcgaaacacccatgataactccgtcaatcataatatatgctggatcagtttttcataagtattcataggtgtagagtgtgcgtgtgtatgtttacatgggtaagtgtgcgtgtgttgtgaacctctgtttataccgtgtttttttttaaaaaaaatgaaaattcgaatgtggcttgttggtattacaaccgcaggtgagtgagaccacccaccggttcgtgtctccgcaccgcccatccctaaaacatcgccacgtccccgccaccccccttcaatgtccgtcgccaccggcggcggcgtcgtcctctcgcgtgcccaatgcgcaagccccaccacgccgcgcagcctccgccgccgccgccgctcccgctcccgctcccgctcccgccgcggaactgcccgctcgcgaccgcggtcctggcgctcctctccgtgctcctcgccacggcgctgtgggtcctcctcgtgctgtccccggcgtcccacgcgaggggcccagccgcggggctgtcggatgcggcggacgcggaggcgtttgcggtggcgggcggaggaggcggaggcggcggggagggcgcggaggccccgctgtcgctcggccacatcgtgttcgggatcgcgggctccgcgcacctctggccgcgccgccgggagtacgtccggatgtggtgggacccggccgccatgcgcgggcacgtgtggctcgacgccggggcgcccacggcgccggggccgagcgcgtccggggaggggtccctcctcccgccgatccgggtgtcggaggacacgtcgcggttccggtacacgaaccccacgggccacccctcgggcctccggatcgcgcgcatcgccgccgaggccgtgcggctcgtgggcggcggcggcgggggcgcgcggtgggtggtgctcgtggacgacgacaccgtggtgtccgcggacaacctggtggccgtgctcgggaagtacgactggagggagatggtgtacgtcggcgcgccgtcggagagccactcggcgaacacctacttcagccacagtatggcgttcgggggcggcggcgtcgcgctcagcctccccctcgccacggcgctcgcgcggacgctcgacgtctgcatcgagaggtaccccaagctgtacggaagtgacgatcgcctccatgcttgcatcaccgagctcggagtgcccctctcccgcgagtacggattccatcaggtatgagcttatttttcaacattttgtggccattcaacagaaatgtgggttgggtattaacagcgcttagattattgagtggtcttatgaaatgttattcgcctcagcaattggagcacttattctgttctgctttgtacgatctgctgatagactagttaccagtgacacagtgacttgaattcagggactatccactctctcctgatcccatgcatgaatttagtgcgaaatagcatgctgtctatgctcacggaaattcgggggattgctaatgaactagcccaatttagaatttgcgttagatcttgggaggcatgcatattgatccactctttggaaccttaccatttctgtgatgcttgattcattatggcagaaaggaagtgtagcctgtctgctgttgtgccaacctagctggctgttatatgttcaatcagaatacatgaacaatagtagtagggtcttgccagagtggttatgttagattgatagtgaaaggaagtttggtagtacttgaatgttacctttctttgggctcttttatggccagcagaagtttttgcaagaacttgcctgcttgctttatagtactattgtaatttctgtcaaataggtaccagcatgctgcatgtgtttgaaaatatgataataagtgattagcaagttcttttttctgtttgcacattaacaagtcatatttacttttttttattaatcgtgtgtatggagaactaaactctactctcttaatcttacttttgtccctttgcattgtaatcagtgggatatcagaggcaatgcccatggtatattggctgctcatccaattgctcctttcatcagtatccaccatctggagcttgtcgatcctatataccctggtttgaactctcttgagagtttggagctctttacaaaggctatgaaaacagaacccatgagcttcttgcagcgctcgatttgttatgataaaaggcagaagtatacatttgcagtctctttgggttatgttgttcaagtgtacccctatgttcttcttcctcgtgaattggagcgatccgagcggacttacattgcatataataggatgagtcagcgaactgaatttgattttgacactaaggatattcagaaatcattgtgcaagaaacctatattatttttcttgaaggatgtttggaaggatggaaacataactaggggttcttatatacgtgcaagtgttcgggatgacctaaaaaacaaagtgttttgcttcaggtcaccccctttacctgacatagacgagattcaagtttctgcatccccattaagcaaaagatggcatctggtttgttctaatattcctaacaatatatcatatcttgtttctacatttacattggctaattgtcgtacccctgatataggcaccaagaaggttatgcagtgcgcttaaaggatctattaatggcactttgtttatgtttgttcggcaatgtggacgggggacatttggctcagcttctgattctctacaattgatggcgaactgagttgttgattttctgtaccaccccctaaatactcgtagtgtggtatatatcatagttaagagatatatcactcgtatgtctactagccgaaaagtaagggctggtttggtttgagacctaaattaggcttaccaatatttgataatttcaatagtgtttagtgtctatttggtttgaagctaaattttgacatgcctaagaaaatatgtcatttcaataatgaacttaggctattttagcttcaatccaaacacaactttgccttaataaaattagtcatgccaaaacttactaaaatttgcactgacaaaatttggtaatgtctatttgaccacaaaccaaaccaaccctaaaacttccaatttaaaaaaccgtggttaaatcttattaaacattagtgcatgttttaattgacccttcttgataaatcgaggacgaatccgaaaatgagctcgtaattaagtaagaagcacaagaagcacctccgcccaaattaaacgttatggtatcaaattatcacggtcataagatctcgcatgcacgtctgccagtgtgaaaggaaacacctccaatttccgcaacaatagttaaacctaaatacaaaagattctgcacgcatacacgacttgccggtggaaaaggaacacacccaatttccgcaaccatggttaaacctaaataaaaggattcctcacgcaagcttgcaagtggaaaagcaaatacccctattttttgcaaccatggttaaatctaaacaaaacaagtttacaaggttaaccaaggtgaaggtgtaacctagagtcacagtcaccctctccatctctctctcctttttgagcccccagcacagcaatgatgccaccgggagacgagcaaaagaactaaactcaaggggatttcactgtcaaagtgtcaaagcacacggcagtgtcagcactgttaagtgcccagctttgcctaactgtctcctcacgcacacatgtggctctcccctcgccaagtcgcacgcgcgcgcgcgcggcttccttccacgccgcgcgcggaagtgctcggcgtttccgttccccgtcaggttgcagccatgcacgagaaagggacgcccgcggccgagctattggctgtttgctttctctcgttgtcacgacctgcttgaaacagattatccactgaattatgatagtaaataattaaatattttaataactgataacttaggataagtgatgttgtgcagtaaaaggattattcttttcttttagaaaaaaaggaatttttagagaaattagatgaatagcctgcgtcccaatagtgaattatctatatacaattataagttgcgatttctcccgttttcacgaccaaaactacaacagattattgaccaaattattatagcagattaactatacaattataaatataaattaaatatagtaagcggataacttataacaagcgatatgatataaacaattaaaaatgttctctatttttttagaagatgagtttttagagacgtgaaatgagtaacccgtaacaataactgtgaagtagccgaaaagaacggggtcgtggaggcgagacagagaggtgatgaaggggatggagagacgcacgcaggccacagggagggacagatcagagaagaggagaattacagatgctgactcttgacagtagtgacttggctggcacctggttacagagacgcgtccatgcaaacggctggtgcattctggagaagcagatcggatcagatcagatcagatcaagcatcaaacactgtgatggccaaattttacctgtccattgctagctacatctacaggatccatctcatctcagcatgcagcaatgtttgatccctatgcacgcaatgttcctttctttcattcttcttttcattctttttttctgcatgagaaaaatgtacggagatggacaccatgttaccatatttgacatgcagcatctgatcttctgaaaggcttaaatcgtccagcactggaaactacacttgcaaaaactttcatggaagataagatacggtagtgcaaagtcacatgtgaagttaattcagttagttaagagttagagccagcactgtcctgcttgcttctttctaacagtgcggctggttattaaagtgccattagtaagggcacggccacatctgcatatattcagcttcggcgccggcggcctcacgtaaccatcagtgtccgtagtggccgcagctttcagcacccaaaaaaaaaattcagatatctgcaacctcgtcagtgtcagaattcagacacggctctgcaggctttgcagtagtacggttcagagataggatcagtaccgggagaaatccactgcgtgaaatatctcggttcttcacgtaatctggagtgaggaattccagtcaatttactgcttccagtgcgagtatatggttttttttttttagaaaaaactagtagagtactgtacggagtatgttttttcagctttcaggagtcaaagatgaacagcggatgagatgttggtgattgctactgataacgaataaaatgactcgtggtaattaagtggtagtagtacagaaggactcgtaaaataaggatggggattaggtgaagatgggtaggtagttttaactccaagcttttgatgcacattttggattggtttgtattacacgcaagcaaactctgcacaattattggctaaaccactctgctgaatccgtgtttctgaaattacacgtactgtagcacactgacattctggaggagtataggagtatctctgtgtgatctgatgattgatgtacgtaatgggtcagtgagaggtggatgaagctgaggaaataaatggcatcagcgtgtaagtacacggcaattagttaggagatgtgaaaagggcagcagaagtggatgaatttgcagaaggtacaaatagtcagatgccaccttctgatgagcagttgagcacacaagatcaataattgggtttttacccaatgggagaagcaaacagagttgcagacggacacggccacactaggcagctcatctgacgtgtaattttggcctcttaacagagagcatcatcgaggtcttggagagttgaacacttggacgtttcgacgttaagctcaaagctcacttatgagaaacagagaaagagctttctacgtaattttgacctcttttctacgccaaattgggggcagagagatagagagctcgtgccatgggagaaattttgcagtcggttttctgaacttagtcaacttatcctgtgatctgtgaacgaatgatcaaagtgacaagtggctggtttagttattgagaaacatttttcattcccatagtttcgcctacagcagattttaaaccgtaaggtttattatatatagtataagtaaagcgttttatatatgtttttagtgatttaaaagctctaaactaaaaataaacaacgacgaaaaaaattgaaaatcaacccttaaattaagtctgataattttaaattttaattacggctgataagctgaagagcaaaacggtgaagttgtttggaataggtccacgtacgtgccaccgcagctcggcgactcccatgctcggcgtagctttgcttacggcggcgcgtgccagccatgcaccgggcgggatgacgcgaaaacgaaggcaatttgcatgcgcttttcctttgcggcacgcatcgtctctttgttcatcctcacacacacgcacgcacgctgcctgccagcgatatgatgttagttccaaccgcctagccttcacacaaaacatgtttcagatagcgtgcaaccgaactgctcgccttactgcacagttggtctcacctttcccacaattcccactgtactgttttgtatatcggttgcaaaatgttgggatcgatgagatggaatgatggatcgcatttcgcagaaagaaaaattagaaatggattagtagaaggcaaaaggactcctttctagaggttagatcatgcatgcaggtaggtttttcttaaatcctggtaataattgagcaatttcattagaattcattaggagcaaagatgatgctgttgctggtcagagccagagatgtcaaaccaaattttaaccacacaactatactaccctggctgcacgccactgaagacatttctccttttctcttttttacattggaattggttacctactggggcaaaacacagtagaaagagggtaggaaaagattgaggaagcaagttaggtagagagttgacaaaacatgggctggatgaacaccaaaagacaaagtaacagcctgcaagtccacggaataaatacaaggaatttttcacactgaatctgaaagtcagagacactcgtgtggtccttgatctgaaattaggttttgctcgcaacagtaatgagtaacagttaatatgggcctatatcacgtaaatgcatgatcaggaaaaaaaaatactgtgtcaaccagactatagtagttggtaaaactgctgtacttcacctatagagaccaggctcttatattcaagagaagaaataagaggacattttttggtggaagctgacaaaagaattttggttcacggaattcgaaacttaacagagttgatattagaggagagcacctcagtcccagtgtgatagttttgcctttcacataccacttattataaggcgtaacgctgattagcaaatataaactaattttatatataacttctacatatatatattttagcgacttaaaagctaatgttgaaaataaactacgataaaaagcatcaaaatcaattttaaatttaagttttaaaatttaaattttagctacgtccgataagctttgcgaagatatgaaatatcaaaatcaacatgcaaaatgcgttgacagatgaccccatgatggaacatttaagctagctttgcgaggatatgaaatgtcccacgagaccatgcgaccatacgccgaatctgatctccagtcttaaactacaaaaagtcagcgcctaacagttgacagttggaaagcatagttgttagtacatcaaaatttatatttggactttacaaatgcaccaaggaaagaatagggccaatgatcaagtagtgggaagatgtttaacctccttcccacctattcaaatcctcttatgttcatatcatttcgataatggatgccaaagctcatggacaattaagaaaaaggcccactagggtgctaacttaactctaattactgtctcagggagcacatggcaaagctcaaaccacatgggctaagatgggcctcaagggcttgggccctgattggaccatgtactagcgcagtacgtagtgttgcctttgcacagcacaagagttgctacacaagttgtaataagaggatcgcaatttgcagagtaaacagaaaagcagcgatgcagtatctgaacaaacctgttacttgagaattaggagtagtcaagtaccatgttttgtgcccttgacaagtaaccaccaaccacttgagccattagcaacgggtaaaatatggttgatagtcccacctcaggggaaaaaataagaggaaaaatattgttgatactcaggaaacatcatgtactgaaaataccacgaacagaactagnaggttaaatatctgcttgccgacggtgagaggcacatcacagacatacacattttatttccctttttgataaggaagatgaatcacttccacacagcatataagtccagatgttattttagcagcaacaagatacagcatagcagttcatatgttaatttagcagcaaacagtgtaccataagtacatacgggagattcgtagaataatgagcagcaagactggattgaaccgtgactaaatcagggaagtcaattgaaaaggaaaaacacgttagaaattcgacttacacgagaacagcaaggatatactacagaaaggatatggcatatagcttaaggtaattgatctggaaaaggtacatgtgcatttgcggatttgccccatttaaatcctcaactttagacatgccccaataaaggtaacatgtttagctgtggtaagactttgatagtataaagcagatatcaaaaggagtaggactaaaatggacacaaaagtaaatttaggcgtcatagcagataacggctttcagaatgaactggaaaggaataaagattgaatggaatctctttcatggttatggcgcttcacagttcacactgatttacagttctaaacaaggtatcgggaaaggtttacagccctccaatacaatgctaatggagtgctgttcttacctgatttagtgatttcacatttcgactgagaatccatcaaggttagtacacgggtctcaaagaatgaagccggaaagttgtttcagtcagactaatgcagcttatcaaagggtgacactccggtcacccagtcttcgtccacaagtatcgtacaaccacgagtagcttggagattccacaaaaaaagccaccagtatttctttt

SEQ ID NO: 7018 - DNA, 6747 bp, Oryza sativa
tggcttgctgcaaacgcaagaattgtaacatttcgaactggatataatgcatttgcattaacgggaatcgtcgcactggatatgagcagagagctcgtggctttgaattattgagagagatgaagagaggatttcttggcgagctaagctaaggagagcgcgcatgatccaaccaaacattccagccaagcagctcaagtcttttcttttcttttctgattccaaacaagagaagagaatgccttttactttagcatccacttgagttgtcgcgctccatgctctatctcatactactactcttccatccaactctacctagctagcttagctagctcttatcttgctactgtctcaactgctgcacaaataattcttcagtaaccaaccatttttttttatcgctgccattttgccgccatcctttcttcaggatcgcagcattttgctgtcattatttcttcgggattgaagttccatctacatgaaagatgagttgcaaatagtgtgatgatcaattatcagttgcacagctcatctggttggatttttttgttgattgttcagagtttcagcatttgagacatggtccatgatctgccgacatcacgtgaaacgagtgatttttttttaccacctgcaactgaggtaacatttgggagatgtaaagggccagatagattttgaccgaccaatctcgtcttaacatatagtactacattttttttactgcgattagatctgaaattattttactgcacctggttaccacgcacagtaaaagcttcattttgactcagaacagtctgccatcccaaatctacagccgttgacagttaactgaactttcactagttcaatcactcaacttataaaactgccgtcagatatttttttccagtctcacacttaattaactgagtaactaatctgtcctaacccatggatgtacactggatcaagcagaggggaattaatggtctaaacaaaggatgaggctatgagcacccaccaaccatacaaatcctatccctgcacaaccccctctcattttccccctctcctcctgagccaaacaattccctatcccctcatctcactgcagctttccactatactaccaccaccactgagctgccactactcatccagctaactaggagaaggaaaaaagaagaacacagatactttggtaacaagcaagaaattggcacagaaatggctctgaggctgtgggctagctcagctgccaatgccctcaagatctcatgcagtggagccaccagggctgcacctgcctactcaatctccagatacttctccactggtatagctagcttgagtagtagaattcatatcaaataaattttctgttgccttttgcaacaaagcatgtggttgttacaatgttctggttcctgtacagtcttgcattgtgccatgctatccttgcacccagttataaattgctgtggcttccttttttcttttctttcttttttacattctatattgctacattgactggtccatgctgtagttatacaccggagacatactaaatgattgaaaagggaagggaataaaatttagaaattccagttgttgaaaagagttgagtatacttgttgtaactatggtccctgttgatttaagccatggtgatgatttcatgctggtattgcagttcttgatgggttgaagtacagctcctctcatgagtgggtcaagaatgatggctctgtggccacaattggaattacagaccatgctcaggtgagccaaccaaaggagaaaatattccatgcctttcatgtgcaacaagattagttaaagcttaatgcatttctaaacagggcctaagtgtcaatttgctgttgtattctaaactacgtggcatgctacaaaatcaaatattctgccctctgctgcaacaactaacaacccttttcctgatatgtcacagaacattttcctttactacttttaagaaatatgatgaagtacctttgctgtaactttttttttcaaactaaatagaacatgtcttttgttactttaataagaaacaagataaaggaactaacttccactgcagaatgctagccagttactttttagtgctacacagtaatgatggcaattatttgaaaacaaaagtaacagtaagatggggggtaaaaaataatttgattggacctgactagatatatatttttttagataatgaatttttattaatccggtctctgtattcatgagggatatacatagccatgactagatatgtatgtatactcgcagggccatctgggagaggtggtgttcgtggagctgccggaggcgggggcgaaggtgagccaaggaggtgcattcggcaacgtggagagtgtgaaggccaccagcgacatcaactcccccatctccggtgaggtcgtcgaggttaacgacaagctctctgagacacccggcctggtatgtactcccaccgtctcaaagagagtataacctccgttaaaaaaaatcaacttttgaaaataaatctaaacatacatttgtgcatattcattctcagaagttactttttttaacatagggcatattaacaataacgctgtaaaattacatgtgtctcttttttttttcaagactggtagcatgtccctgtttaaaggtgttagtttaattaaccggaatgtctctttgttaatttaattcattagtactctccacaaactagaattacaaattcttttttgcgagacaattttcaaaccctaatgctactgccaatggtggtgacagattaactcaagcccgtacgaggacgggtggatgatcaaggtgaagccgagcagcccgtcggagctggacgccctgctggacccggccaagtacaccaagcactgcgaggaggaagacgctcactaggctcttcctctctgttttttttcttcccattttgtcactccgacctaatttctccctgttgcaacaactgctctgtatccgtatacgattaataactgaatcttcaggctttgccatgtgttcagttggttctctgaacttctggtgggtctatctatttatctatgcttaattagtcacttcaagccagtggtctgtggaaaaaaaaaacaatgaaaaaaaaattggccatctatctgctcaggagcaaattataacggcttatctatgtattagaaaaggaaacagcaagttcttgacatgtacaaatcggtacgtgttaatttctagttttagaaatattaaataaaaaactaaattaaggatgcatgacaagttaacttggtacttgttgattttaaaatacttaaaaaaaattaattttaagtactgtaacttagtaatacttagtacttactattaattcttaatttaaaaatatttaattatgaaacatagaaagtaaccgaagattgaacatattgttagtagagtgacattcacagttgacttccaataacacatcaaaatttaggatgcatataggagtactaaactaaacgtacagccaatgcaaacgcaccgagaaaattcagatttcatcacaccatgacaccacaccggcgtttctaacaagtttgtaaataaaaaaaaaaactaaaataataataacaataaaattagtacgtgtaagattcaaatcggaattaaccgggggaggggtgcgtgtgcgtcgcgggcgaaagagatgggaggccggttttccgagggaggttgttgggcgtgccgtcgccgacggggacgcgccaccggtgccggtgcgcgcgcgggcgccgtcgcgtcgcgtcccccgtgaccgcctccgggcggcaccggcagcggcggcgtcacgggagcggcgcgcgggcgcgtcaacgtcgtccgcgacgtgggtgtgttttgctttgctcggctcggcgtgaggagagcagaggcatcggcgcgtggttggtttgggggcaaggcagagcgcgggcgcgtccacatcgggttcaggtcaaatcccctaatcatttcgctaatttgaccggaattattatcagcaaacacctctatacaccgtggtgtaactggttctcgtttttatttcaaactaattactccctccgtccatagtataagttgttttaattttctttctaatcaaacttctttacatttaaccaaacttatagaaaaaaaagagaaatatttatgatgccaaattagtttcactatatataaccttgattgatagtatatttgtcttgtgttggaaatgttattgtgtttctttataaatttgatcaaacctaaaaactttgactaaagccgtgtttagttccaaaataattcttcaaactttcaacttttccatcacatcaaaactttcctacacacacaaattttcaacttttccgtcacatcgttccaatttcaaccaaacttttaattttggtgtgaactaaacacagcctaagaaaaaaaaacttatattatgaaattgagggagtatgtgccagtgtgttgcaacgggaacaagagataaaaaaacttgtaatttagtttcttttatatcggatttggaaataaaaatgaaattcggttttgtttatgctggtttttcacgggcttttctggagctgtttttctagggaaagagtagaacgactgtgcttttaaagtagttaagaaatgaagtcaggctgtttgaaccaataagcggtagaaacacggaaaaattagcataaaattatttataggtaaatattgtatatttatattgttctcagtttaaaagtcactgctgggaaataaatttcaatgagaagtccccaaattcaactgtaaaattgcgttttagattttatttatttatttttatagtcgcacatttttttagtttgctaatacatggaaatcgtcaaatgaattgggcaagtctgatggaatgcaggggaaatataatcagattagagtaggtagcagattatcaaatgtttgcaagttctttcgattttggcccgaaggtaaccagtacgtactagaggagtacaaatgtagaatacggttgtttgacttggagatacttcagcattatggagtagaatactgctcctactatagctggtcagagggcagcgaagactgagttgtcagtgagaaaagggaagcgaatatatgcgttcagttcagactttcagagacgctctttgaaatcctgggcgccatgatccaatcaattattagcactcttcggtacagcggaataaagttgtgttttaagttcataatgctgtatttattcttgatcatggactatacttaccagatttattgtttagtacatctaaactcttattactgaaccctgctgtcaatagtagtagcagtacagaatcaagttgaacatagaatatatacatagtctcttggaattcaaactctggtcgaaatctaaatcaatcatcaacaatatgaacagaaacaggaggcactcggtgaactttacacgaacaaacgaaagaataaaaaccaaaatctctttggaatcgtaaaatggacgatccattttcataatcacctcaccctcccaaatcgctgccattttttttttgcaccacaatgtgatcgaaattcctccattagcacacacaaaccccaccttttgatgctccaaatcttttccaaatcataccactactactttttttctcctttttttgattcttttttttttgaggtgctcgcccactaccccgctttgttctaagctccacccagtaggaggggtccacgtgtgcaggtgacgccagatgacgtcatcgtcgtcatcgcaagttacagctcaccaaaagccccccagatctaagcgcctaggattcgacacgcctcgtgtgaatcacagcttcccgtggccgtcggatctcctcgcgacggccgagatggagccgtgcgcgccctgctccagcgcgcgcaccacgtcggccatcgatggccggaggctcgggttctcgccgacgcacgacgccgccagcgacgccacggcggaggcctcgccggcgtcgtaggcgctgcccagcctctcgtcgaccagcatgcgggcgtcgcaggcggcgcaggaggcgggcctgaggcgcggcgcgaggacggcggtgaggaggcggccctcggcggcgcagaaggcctccatgccggtgaggagctcgaggaggaggacgccgaagctgtacacgtcgctcttcttggtcaccatgccggagcggatgtagtgcgggtcgacgtaccccggcgagccgagcatggtgtgcgcggaggaccgggggcggacggcagcggagaaccccatccgcgccgacccgaagtcgcagagcttggcggacatggcctcgtcgaggagcacgttcgacgccttgacgtcgccgtgcaccaccgcgggctcgcaccggtcgtgcaggtactccagcgcccgcgccacctgcagcgccaccgacgcgcgccgcgcccacggcatcgtccccgcggccttcccgccgccgtgcagccgctcgtgcaggttcccgttcggcgcgaactccagcaccagcacgccttcctttgcaaggacaaaaaaaaaccaaagaattcttcagcacgacgcggtggcacacaacctgctcgagcaaacgcccgcggcgaggctcgcgcgagaacgggagcacccaacccaccttgcggctcgcagaaggcgaggaggcggacgatgtgaggatggcggac

SEQ ID NO: 7019 - DNA, 11997 bp, Oryza sativa
gggatcagcacatttgtatattggaatattttactttgttattcacaattttggagttcattaaacaactgggtgtcgaacccacaaaaccttcaaatcattttcagtgacgctgctaacctagaatggttatcacatgagggctgttaatgcttacttctcaaaacctatgtacttctatgaacactagaccatgtttgtcttccactttctgaagccatcctctccttgcatgtcactataaaatgctcatttgtcaactacaggttctgatgcattaataaattcattttgtaggttctcaatggtctcctttgtagagatgatcaaaatgtggctgtatctgttccaattggaataatacaacaagggtcccataactcacttttttgaaaagtattgggtgttaaagatccgatttctgcagcaatgtcaattgtcagggtaaacatcattatattgtttcaggatttatggttttctatatacgtgtcacatgatttattgattcagtactaggcatcaaagaaattaaatgttattgatgatgctggatatgataccagctcttgagttactagctatcatgactctttactctttgttgccaaccatgtgttcacactgctttgctctagttggaccctggggatgtggaattgatcctttcccccctcctcctcctccccaaatcccccgccgccgctgccgccgccgcagtccgcgtcatcgtcgcaccccctgtcaccggcggccgaggccgccatgttcccgccgcagccgcagcacaagaacctgtatctttgccacatcctcgcgctcgatctcagctcgcgttgctccttctctgcttcttgcacccacgagaagaagaagaagaagaagaggaggaggagaggaaaggcgagaggaggaagaagaagaagaaaggaggagactttgtgtggcgtttggggctctgtattgtagccttatatattgctgcgtgtggggatttcagatttggtgggggtgtaaactgcaaaaaaaaatgcaaagacaaattaggatgagatgttgagatgaactggtgactgattaaaaaattgattattatgcaggagcagaaagcagagcctgggggtgagtgactggcatgtggggcccaccttactcactcactcattcactcactcgccagtgttaggttacaacaaatacacttgttaaacatgtacaggaaatccgttttgagctcaccttcttattccattattccaacatccctggaatccaatagattacactgaaattgaaacaattatggccctttttggatgggctaattattggattttagataaatcgatcactcataatgtgagctataggtacatgtatacgtggtagcttaggtagctccattggattagattacagctgaaacgccattatatgtgacacaggacagttatatttccttcaagatccaggatgtctcacaaccaccattgatcgtctaggtgaggtacgaaatgatgcatgcaatgcaaaagctttttcatcccatttattaatttgccgctgctacactgatcactgatcagctagctcaaaaccagagagatctagctgattaaccacccagccatgcattagctggtaattaaactgtgcaattaccagcagtacacttacactgacgacacaaatcctctctttctataaagttacagccacaagctcaacatgcgtgaagctaagatgagccattcgatctctctcatgcttaatctcaaccgttcatgttctatgcaattatattccctattaattactcaacttatttagtacctactttattgctaattgttcttgcttatttatttaataaaatttccatcctccttaaaaaatggagatatggagggtagagacgcctctccatttttttttaaagaaaaatatgtaagcgtgttggggattgaatagggacctctgggttgaaaccacacgtcccttctcactaaactattaagtgcatccaaaattttttttattcttatataagtgtccgcagcaatggatggggtttcatcgagtgacagtaatgacaaccaccatgtgatggagcttgggggtccgaggaggcgacagagatatgaccgggatggatttggttggtggcgtcggcttggtcgatccggccggtcgccgtgcatggcccggccggccggtggcggtggcggtggtcaagggggaggtgtggagctaggagacgacgacggctggtgtggtggccatcacggtgggcgcagcgatcgatcgatcgatctgagcggagtcgccgcgattaatgtgggtttttggttgcttctgatgatctgtcagcgacggattttgtggccgcgttagcgagcttattagcagaatgctttgatttgtccttgaatgcatgcatatgcatctaagaaatcatggggtgtgatactgagatgagtctgtgatgctaattaggctgcttgctgctggaagcttgcagattgcaatgctcgagtgttgttggcgaagtgaagctggcaggctcgaattaagctcgcatacgagtgtgctagatgctggaatgaaaactgtcgaaaacgatatcatgtctatggaaaatggttctcggttggtcgagaatttcatatactcaatttgatggcgatatcagtacaatgttgattccagaaatcataaaaatcaaagttctatatatatagggatagaataaaaacaattggaaatggtactacttttacaaaaattgtgatactcggtcgatcaggaatttccgccaccatgttccccttgtagtagtatctaggactcctgctgatgcagacgaaaatgcagtccttggtggtaaaagaaatatctctgttctctgaagtcacaaggttacatcagcaaaagcaacattttgcttgtaaaccctgactaaaatgtcagtatatagttatgcatcagtacttacttgccttctgctgttactactacagttactactacccgtctaacctttcggtgtttcagatttgcgagttaataaagctgagcatagatgaacagcttttcaaaaggagagagaggggcatgcattgcacacatcggattcctgaagctcacaggaaagagagctagtatctctcttcacgatcgatcgcgttcactgaactcaacacatctgcatgggctgcgtacggggagcggttttaaaaggtgaaatttattgcttccaagctactgttcttgctacgagcagctagccatcctgttcttgctgccctctctttaatctttatggatcgaaccgtcttaattcttcttcttcttctgatcttcccctcttttgcaatgcaagggcatctcgccgtttggatgatccaacaagacaagacactgaaaatgtgacaagtgtaggagtcactggggtcaagcaagagtaagtgtgcttctacgtacagctgcacctgaaaaagtgagcaattgatctctcgtaatgaacacttctggtttactgaagctcaattcagagaaaagttcagaaaacatatatgtgaataaaaacagtgggaggagaggactggtgatcatttgactcggtttgggaccgtcggatgatggctcgttgcatgatctggaccgtccaccttgcgccgatatcacgaaaccatcaaggttcaacagtgcattggcttgtcagcattagagagaaaaaaacatccggtggcacgcagcaatcagcagcgtttggttcttgggagggtgctgctatgctacggatgctgcagcaagaaaagaaacctgtactgggaacaaaaagtcgctgaggctaagtcatcaggaacagtagcagcatcagcagcagcttgggccttactactaattgagtaggccaatgagcaatcatttggtgctgattcggatggctcactgaccacaaaacaaagcactaatctgcactgtgttgcaaaatggagtacgtccaaatgctctttaaggacaaagtgatggtcacagtgaagcatcttgatgagtgaattttgggacgccatagactttttcactctgaaacagctactagctgagatatataattgcaagtgctaccagtagaagtgtagaacacagaacagtgttcctggtgatggatgatgacagaattgcatgcctacaaagaaaatagtttcagtcagtgtcctgaatcactgaaaatatggctttctttgattcccagattgtctgtgaatccttttcagagatttagtcatcactatgttcaactctcgtgagaaagatgcaaacaaaagaatttgcatccgagattaggtccaagtattaatttaagcagttacacccagcgtcccggacaagaaattcagagctttcttcagcaggttactgtcatttttcacggctacctgatttggtcactgattgctgtcctgcaacagtgatctgcaaggtgacgaaagaaactagctccgaaagcaacggcagaagcgagtttacatgtcacattttggtgactttccacggcgaattgcaccgtgtggatcacatgtgctaaactaaactgtcttgtgctctactgctagtccctgaatcgtattagagttcagactcacgcgtcagttcgtttgcctttgattttgtggcttgtagataaacaatatactaatgtagagattctgatatgagtgatggagagagtatgtcaacaacctgaatgcgtgaaagctgctagataattattgacaatgtaccgtaaagcgctcgagttcttgcttccacaactaggcaacagttttttttaataaaacttgtaagagaaacaaaacaaagagcctttcattccatgtgtaatgtgttcatttaggtcacaatttttctctcttgtgattcacatctcactgacaccaagaacttaacccctcacctctcagttttgtaccatctttatttatcatctgaatattaattaattggtgccttcaggatcttgcagttcttgggaattaatcatagctatctaggaataggacagctgtttgtttatgaaaaaaggcttgatcttgatgctgtttcatcgtctgatcatacatcgcagcgcctttcggatgtgtacttgtgtagtacactataaaatcgtatcgtcgccgcgatcacatcacgatatattggattgaagatttggagtccgtccatggagagagcagcacagggatacacatcctggggtccaatgtagaagacgacgtcctaacatagtgtgcactttggttcagtccaattgacacgaagaacacacaattaacaccaacagtgcagtctcctgctgggccatgcgtggctgaactctgatggcttccaaattccatcacattcccaaaatcgcaccgccaccaccaatcaatcatgaacacgacagattaattagagtttaaatacttaaaactataggcatctttgagcgatgtgatgtgactcaaatttatttgctcaagacgagagcgtgaagcaagcaagaagcttcacgagtcattcagaagaagaaaaaaatcgaactttttaaggcagaaaaagatgtgtgcaacaggagctactagctagaggagtactagagaatcaatcagacaagaacaatcttcctaaaccgtgcgtgcggctactaaatatataatttagagacaataaatatgccatgtcttttgcttgccgtaccaccaattcaatcgtttggtgcaatggatatatggatattcagaggggaaaaataataattttgggggagttttgcagtgtgcttggaagctacgtgcgaggagcgaatgagcaaaatggacatcagaactgacaagactgtgttcatctaacttccaagctcaacagcttcgcaacgagccataaaatagtactacccatggggtcctatactcctattcaaatgcactgattggaacagcagctttgaaactatgcgtgattctaaacttttcatcagttgaaatagtctttaaaaaaaggttttagtaggatcacaattttgcatctggttgcgtcattgactggaagagattgcaatttttgcaactcccctggagttgcatgggcgcacgaattacagatcgttcgtgtggaggattcagcgatagaaatcctgttcgtcgaaccaccggacagcgtcgccggcgcgagcaaatttgtcggctgaatcgtcgtcggacgctgcaatccataagctatatcttctacgatcctgtacttgaatttgtttatcgcaccggtactgaaaacgtgtccttgttctccaaatattattatttggagagaatcccttatatgccactctaaattaaccggctcctttatatgccactttaaattggcttctcccttttatgccaccggttcaagtttctcctcccttttatgccattaccgtcagtccaccgtcagttgaccgttaactttattgtaaaaagactcatttgcccttaataataggtattttagtactaatatagctatactggatacaacatatgaaaattgattttttatgcatcacatgcaattttagccattaccatcacaaataaattttcaatgtaagcatgaaacatgcagttttccaacaatatttttaatataaagagcatttttcactggttctgataaaattttgttcatccaaaaaggatttaaaataaattagttatgatttttttgaagtttacacattttttagttgagagggcatattggtcatttatgaaaaaactaacctttgactaacagtcaactaacactatagtggtgggagtggcataaaagggtggaaaaacttgaactagtggcatataagagagaagccaattttaaatggcatataagggaactggttaaattctagtggcatataagagattctctctattatttgcacgctgctgcgattagctgattagctccagtttatgtgtccgaaactctgaataatattaatcgtagaagagatgtactattttctgttcttgttgcttgaacctactaactgggacaagcgtcttggtttggcatccaaatagagaagtacagaaacgaagctacgtgcaggcagctcagagtgtggtgcaaccctttgtctaatggctctgaaacttctgatggggacttgtgcttggttggagtgcaacacatttacagattaaaccaatcctaattataatacatttttgtgctagctatacacagttctctagcacttacctgatcaaatatactagtagtatacaatatatagtagtagaaaactagaacgatttgtacgttgacccagacagagagagatgccgggcagtgtgtgcaggaatcaagaggcaggagggatgttccttgtaaggcagcaaccagcatagtttagctttggtcatctgtcctaaatgggatttgtcggctaaatcacaggcgtttatccccttccgtcgtctatgcacaacactacacgctcgtgcaaaagcaggatagcttgacttgaagctgtggcacttcctctggcattgcttcagatgttcttctctgcttttcttttctggaactagctgggtatcgtagcttgtgttcagagacaagtacaggacgtgtatacgtatacatcatctatggccagtgatggcaacattgtaactccctttttcttcgagacaaccacgtacttgtgtaatgactatgttatattctaacatttgttgacaactttgtaaaatctaaatatagtataattgtagcataattacactgtagtttacatgcaactataatataatacaagttatactttagttaaacgtaagttacaatataattatactatatttattcttgacaagttttttgttcgatgatggatgtaatagcaaaatcgaggttaaatccttgaacagcggggcaggccgaaagaagcccagcaataccatgctccttgttcgatgggcccaaactccagcctgcatcaccatgtaacggcccatttatgtaaggcccaaaaactagtagaagtgttcaaaggcccataaagctagcccggaaacagcccatgaacagagcgaattattattactctctctgtcccgtaatataagggattttagatttttacttgcaacgtttgaccactcgtcttatttaaaaaaatttaaaattattatttattttatttgtgacttactttattatctacagtaatttaagcacaacttttcattttttatatttgtaaaaaaaattgaataagacaagtggttaaacgttgcaatcaaaaactcaaaatcccttatattgtgacggagggagtattagttttcaattaaaaaaaaaggaatactgttcgtcctcgtcttcttccacctcagcgacctaatcccatcgccgtcccgtcgcggagctcaactgccactcccattcctccacagttccgtaccttcccggccttctccttcctccctttcggctcgggatcgggaagcttcccgcggcaatgcaacgagtgctccgcgcggcggcggcggggattggccacgcgtcgggccaccgcgcgccgaggtggggcgcggcggcggcggcggcgaggtggctgagcgggggcagggaggcgatgagctacgacgtggtggtcgtgggggctgggcccgcggggctcgccgcggccatccggctgaagcagctctgccgcgacgccgacaccgacctctccgtctgcgtcctcgagaagggctccgaagtcggtgcgtgtcttcctccggaatcggttcccccttcggtccggttgcttgcgtcttagcacgccagtgcgcgatggcgttactctactcctgctcgtgtaatttggcgtttgtttgattttgcttgctctcgctgcaggtgcgcatgtattgtcggggaacgtgttcgagccacgagcgttggatgaactcatcccgaagtggaggcaagaggatgtatgcccttctctgctctaaactggatatgctatataagtatgttttagttggccattctgctgtctagactctagaccaagtgcaaattaactatggttgatcccttcatcagaagcctgaggttcatttgatcatgggaaatcatggatattttggtgtatgaggatgtttcagctccctaattttgctttgcgtagggcaaatgcacagaaataaacgatatataataataataattatttatttattttttttttgggggggggggggggcgaaatttaattagttgatgctcagtaacagtttcaaactaacaattgcatcatgagatgtcccaaattcccaatgaataagacctggtccttttgatatggcagttccttgaataatgatagcaaaatacacttcagtaacaaagtaaatttagttctaagtacataaggcattgatatttatgtgcctactgtgtgtttgatagaccccaataagagtccccgtctcatctgacaagttctggctgttgacaaagaataaggcatggacacttccatctcctttcgataacaagggaaactatgtgataaggtgctgagattttcttctaattattagcttcatctatgcaaagttctagtatatttcacttattcgacagtatctgattttagaaacaatgcttaatattgtccagcttgagccaaatggtgcgatggatggcctccaaagctgaagaattgggtgttgaagtatatccaggttttgctgcgagtgaggtaccaccatttttcagttgtggaactcttctgtcaaagggctaatattaatctgtctgaattcttctctaacagatcctttatgatgaaaatcaaatagttacaggcgttgcaaccaatgatgttggtattgctaaagatggttccaaaagggaaacttttcaacctggtgttgaactaagaggcgagtaaccatccttattgagtgcataatgttgagataatcaattgctccttttttttccgttgtttgtataggcagataatagtgattttgttttccctattgtttgtctttaaaaccttttcagtctgttgacgttgttctttctgtaaaattggtacccatttgttccaagctggtggttccactcacgtgtctattctcatggtcagctacttagaaaatgcagggcgaatgacactgttggccgagggttgccgaggttcattatcagaggtcagcataaatctagttttatgaaattcatatgttcttttttatatatatatttcatttggtgctaacacttatcatgttattcttccctctttctctttccagaaaataataaggaaccacaagctcagagagagtgggcaaggccagcatcagacatatgctcttggaattaaggaggtaccttgatattcagtaataccactttcagtttccaaatgccttgttctcaaatcttatcaaaccaactcatatatctcgtgaggaaaacaagatcctttgtgtgtgtgtgtgtgtgtgtatgtgtgaaaatcgtctgacttaaatcagtcccataccacattatacatgcaatatatgcaaactataggtaacactcttttatgttaacattttcaaaatcacccatgcacaaacacttcaaaaatattttctaataaagaacttatggttatttttgaggaattccattagatgctttcgtttgttccttatagaactatgatttactagctttatcttcaaaacatctccattcttttccttaaaatgacttacagacgagttagcagtgccacttgaaactaattggaagctttcttaggtttgggagatcgaggaaggaaagcacaagccaggttctgtgattcatactgtagggtggcctttggactcgaaaacatatggaggatcatttatgtatcaccttgatgatagacaggtagttcttctgttatttgctacaatatccctttatgagttctcttttcttttgcaaatatatgttcagtgaagtctgtcatctgtgtaaagatgtaaaaatgtatttatcttacatgatagatgcatccttctccacaacctaagttcacagcttacagattataatttgggtttaaaggaggaaccattaattcatcccttatcataaggccttttgtttgcagagtggataaatgtataacttgctcagttttttccccggaaattttgattactttatcgcttagtggtgtttactttatctctgctctgatatttcagttagcgataggtctggttgttgccttgaactatcaaaatcctttcatgagcccatacgatgaattccaggttagtcaaatttctatgggtatgttcttttatgatggtagtgtactagtatagtcctgaactcctgatggtcgattttttttcttctaagcattatgcaatcatattttatatttcagaaattcaagcaacaccctgctgtcaggacaattttggatggtggaacagttcttcagtatggtgctcgtacgttgaatgaaggtggttttcaagtaagtggcatgtcaaagaaatgaaaattttgttgtaaatagattcatatgatatgtaaactctgcgcataactatattgggcatctgccggtttatgacattacaagcattttacatcaaaatcaattcacctggtgtttccggttaactggtacatgaactttgagacacagcattgttatagtgttcttgttatgctatatgtttcgacactgtagcttttacctccgtcattcagtcaggtctcctgtattttgttttctttagttgttagcaatagttactgatagggtgctgataatgttcatgtaaaatttcagtcaataccaaatccagttttccctggaggtgcaattattggatgctctgcagggttccttaatgttcacaaaataaaaggaactcatacagccat

SEQ ID NO: 7020 - DNA, 9139 bp, Oryza sativa
catgtactaaagggttggatgtgtacaacaggtatgctggctgcagaagcaactttcaaaactcttgttgaaggatcttcgatggaactctattgggagaatctcaagaagtcatggatatgggaagagctttatagagctcggaattacagaccagtatgtgattatgtttgttacagacttcctgaacatttattttgtctaattaagtattccgtcatacaagcttttgaagtgaggatatgcagtttctgttttttcctttctgaagctattgagcagacagatttatttatattctgttacaggcatttgaatatggatttattccaggcattgccttgtctgcactggaacggtgaggcccaactaatttgttaatattacttaatattctatacttcttttgggatgaagtcaatactctacttggttcgctgacgtttgttgttattgttcaatttttagatacgtattcaaaggaaagtccccctttaccttaaagcacgggatacctgaccatgaagcaacagatgtgagtttcaagtactgctggtgctcatctaatatagacattctttgttagcataaatgaaaagcacattgtttcattttttcactactgacattaaccaaacacattcttgtgaacagatggccagtttgcactcgcctattcaatatccgaaaccagatggtcaaatatcctttgacgtaccaacttctttatacaggtaagatatgcagcaagaatgatgacgtccatcactctttagacatcactctttagaattctttctttcaaagtttcaagttatgttcacaatttttagaagcaatagtgctttcctgtgaattggtttagagctttttcttaatagtcacatgtagtatagtggcggcagattcatcaaatttagtgggtgaatggctatcgttctccatttttttttcatgaactgaaatgtaatgtggagtgatttacatgcatattctgtacactgatcatgtatgatctcatttatacaggagcagcacaaaccatgagcatgatcaacctcctcatctccgtttgagggatcctacagtaccggagagagtaaatcttcctctgtatgctggaccagagtcacattattgtccagctcgagtttacgagtaaggaaattggcctttcttacttgaatgaaagataacctacaattaagtactgaatgcccaaacaaggattgctaatcacttctgccatacatgttctcatgcaggtatgtcaccgacgagaaaggtgaccagaagcttcacataaatgctcaaaattgtcttcattgcaaggtatttgcctccatgttgattcagttgtccatggacatttgcatcttttgtttcctgtaactgaatgaaatgttgacggtatctgcaggcttgtgacatcaaagatccaaagcaaaacatcgaatggaccgttccagaaggtggaggcggtccagggtacacagtaatgtagacgatagcaaaatactgcctgataccatgaaaacattaaccgaaaggcaataaattatcatcatgtatagaggacatcatgaaataatgtatggtatatttcttctggtcaatgtgaattcaacctatacttgtcaattggtcgttccaaagtataccaaaggaaaaaaggaaatacatgacaaaatcacagacagactacatcaggactagataatttcacagtgacttttgttcagtgtagtttcaaaatattcttgttttgaagaaatttaaatgccgtcaaagttgcaacatattttcctgttacaaaccataaaatgcagtggtgcgatgcgatggcccacaaggcccacttcgctggccacgtccaactctgtcggtccggactggattgcgaattacttttggcccatttgttgggatgcaacacgtgcggcctatatagtaattgggccgaaaagggagtgcgggctacgtgcggcccgtacttgttactccggaaatggaattgagagtttttgctccatcgatcagcgcggcgactcgattggaagccggtgggcggcggcgacatccaccggccgcggagaagacgattggcctccgccgccgctatctttcatttgctcctcagtcttcagctgcaacacgctcttcctctgctgtccggatgcctcaactccactcttcaaggtttcaaggtttgaggtactttatcgatgaacataatgtgttttagcctcaaagatgcaaccagctcacaatgatcaattcctctattgaagtttacatgtggtatttctgaatggaaatttacacacgttgtttggaaccacatttcaggaattcaagcaactcatcagattccaaccattctcaggcaggaaccaatgtactgatccattctggctgtgctttctgtgatccatacggcattttgcaacgaattcagtattcagcttacagccaagacatgtgcacatgcattacagtgggctcaaaacagcaaacccaacgtttcagtacacagttgctgactactgacaccaattgctgctggttccaagcttcagagttcagagagaccagatactttgctttcagatcacaagttcacaacatgttgagaaaggcattgatcaatgggataaattgttcagcaatccatccagcatgatgctttgcttgcatccttggactgaatacttaagagatagctaaagtttagcccctctctcccaaacacccccttatgttttttgtgaaggactaaagtttaggtgatgtttggatccagggacttaactttattctctatatttagacactaatttagagtattaaatatagactacttacaaaactaattacataaataaaagctaatttgcgagataaattttttaagcctaattaatccataattagataatatttactgtagcatcacataggctaatcacggattaattaggctcaatagattcgtctcgtgaattagttcaagattatggatggattttattaatagtctacgtttaatatttataattagtgtccaaacatccgatgtgataatgacttatttagtccctcccacccaaacaccacctcagtcagctttggattctcttatcaagagagaaaattcaggcgaccagaatacagtgatcaccagaacactgcagtgatcactgagatctaatagtagtactgtattgtgtacactacacgtgattaggagtacaatgtacggatgacaggacacattttaagctggtcttgtccaatctccaaagaacatgcatctgtgatctgtcactgagctttaatttaattagtagtaacagatatataaaacgaaggtatctcttcagattatctgtatcggctgtacggaacattctgaggttcagatcaccaaatgaaaatccaatctcctgaatcggttgaatgcagacatcaacatatgaacataatgctacctgcaaactgatgaaatgggcacaaaatcttcactgcaaaaggaaaatgatcacatttcattccctcacgggacactcgagacccaacctgatttctcaattccagcattagagaaggctagccagtatgatcagtattcagaaacagcaaaaacaggtacatggtcaattgatcaaaggccaaaagaattaaaattcctgaacattgaggactcatagatagattgatttgccgctacacaaaagcgtactactaccaatactagagctatccactcatagcctaccacccaaccccaacccaataaacaacagatttgaaccaattcgatgcaaaattgcaacgcaatgcggcacaatgaattcaattggattcgattcaattcccctcctcgtctttctccttctcgccgttggccatgacgatctgctgctgcttctgcttctccttgtcggccttgagctcgtcggcctccttgatccagagctcggcgaagtcgcagttcctgtacctctcgaaccacggcccgccggaggtgtagtggatggccttgggctgcgtggacgggtcggcggggtcgaccttgttgtggccgacgaggaagttccaggcgaaggggatctcgccgatctcgtcgtcatcgagccaggcgaatcggtggaggaaggcgccggtctgggtgctgacggcgtccggggtgagcgcggcgacgttcttggggtggccgcagttgtagagcaccatggacgaccagttcttgcgcgggtacacggtctggatggcgccgtccatcttggtcgcctcggcgggggcgtactcgtgcttgacgcagccgacggcgaggcggtggtcggggtcggagaaggggaggcaggcaaggagcccggcgatgtcggcgaggtagaggaagtcgcagtcgacgaagagcgcccacccgcggtagccggcgaggtagggtgtgaggaagcgggtgaaggagaactcggtgctctcggtgggcccccgctcccgccagtagagccccgccgcgcggagatccggctgccggatggggcggacgtcgacggggatggaggcgtggcggagcaggctgcggcggcacacctcgtacgcctcgtcctcccgcgggtcgtagccgacgaacacccggaacggctcctccgccgacggcgacgagaccgtcatggatctggcggaatgggggctctcgggccttaatgggcggcgagattggattgggaaggcgaggtggtactaaagatggcaaatgaagaggaggaagaaggtggtgatgaccttggatttctcatgggtttcctgtgcgctaaatataaggcaccgcctgcatagggtcactgccacacatcgtagggtgactgcctcgtgggccatgtggtgcgggtcggcgacgtggacccacctgtcagcgagtgtggcggtgaaggataatgggttgacgcgacgacagctgtggggaggagcccgggatcgcggtaacagcggcggtgaagtctgtggactttggaccgtgggttgcgtcggtgacgggagcgggcgatgcggccgcggagatgtcggttggattgcatcggattggatgccatggcagcatgggccgcacgcccgcacgggacggagtgcggccaccgcgtggaatccatggcgcggccggtacggagtgggccgcgtgcggcgtgccccgtgatgcgcccgagctggacggccatgtgcgtcggtgaaggctgtcgcgtcgtgtgactcgcgtcgtcgtcgtgtcaacctctgacttgccgaatggaaaatgtctattgtaactcccttaaatataggccgtatttctcgatcgtaaagctgctggatacaacaactctactaaccgttaaaaccggaaaaaaaaacttataagacactactccatctgtctctataaatataagggatattggttgaaaataacacatcctaatataacgaatcattataccaggatatattatatccgactaaaatctcttatatttagatacggagggagtatttagaatggcattagctaacgtggcaaattaaccacggtcaaaaacaccaagccaacaaggatgttaggatatcaagtggaactcacatgtcattctcgcttaccctccttcctttctccttcctccctcctccccatatctctctcctcttcccgcaatactatcttagaaatctttttcaactctcttaatagttagaggggttattatatctgattttatggttaaaagacgaattagatccaacctaagaaaaattagacattttccgcagcgaattgatgcccgctagtcgcatggatagatctagcccgcttatcctaatggatgcggcccacggcctcccgtagttggttcccgtgacatttcggcctttttcccccacgccgaagatccatctacacgggctccttcaccactgaggccaatcaacggtaaccggacgggcccatctacacgggctgcttctccagctgagcttcttgctgttgggcccgtgacgaagcacacggcccgctgaagcctctgctcgtggggacggacggagcgaggcgagcgccttcgccgtgccgcgtcgcgcggagcggcggccggccgaacaagccggccggcggggcgcggcgtgcgtgcacccactctcggcacggcggtgagctcctcctcctaactcggctactcccttcaaccgccgcgtcggctccgctccggccgccgaccccttctgcaccgttgggttcggggggttgccgggttgggggaaggcggctcctcctcgccggcgctgctcggttcgattcggagggggaggagaccagccgcgagcactgtagtggcgatgtgacgccccttcccttaccagtaaccagtactcactttgtgcctctgtttatctattattcagtttcactagatgttaatttgagaggtagggcgctaggcctgtaaaattttacccaataaggtcagttgatattttttttattcacttcatgtagtgattaaccctaacacgatcctagttgatggctgggcatgggcagaactgcacaagtagtgcttggagttggcaagggaattttatagagggattctgcgaaatcgagtgaaaggaatagttatgtttgcatcgtactttgattggtacaatcggctctctcttcaaagtttttatcgattattacccccttattgcagtgcctcacttggtcatagctatcttttgttcatttattagataagtgatgtcccagcattgtcgtttcagacattctgtaagtattccactgtctacctctccaatacacaatcacttgattttgagttctctatggttcccggcagttgacttcacagatctagtagtgctatgctttacacttacagctgctgtgcaatagatttttgttttggctcctactattgtgaactcaacgaaatagtttccatcaaatagaaagtgaaatacaggggtcaaataatttcaagggaaataaaagatattggagttcagtactttttgcagtaacaataacctgtcagggttgcatgacagaagtcatattccctgaagggctgaatggggagatgaatcttccctgattttcatatactcttaggctttataataatgatagcctctgaataaacccttcaaaatgttaagtttgactaggatagtgattgacagcatcgatgtaagtgaatgattattttgtttttgaacaatctttcatgcatcacatccagcttgcactgtcatcatgtaaacgttatttaggtcagtagtcaagttgttaagggcatgtaagtttgtttcattattgtttaaagtaggctttagcatatactgcaagttatgtctggtgaagcaataataatttatttgatgtgacgtgtgtaaaatatgataaggaggattaccgtgtgaaactcaagctaacatagttttttcagtttgttttatactttatatgtgggacccaaactagtaatattgaacttatttctacatgcttcaatacataacaactctatacaacaatgacttccatatatttattattcatttgtaagccagttagtcctaaaagaaacaaggaaatatgtggagctattttgatcactgattcctctgattctgttctttttcctttttttctttaccccctgtgggtaattatatatataagaattgatgatatgtgattcgatgacttatttggaataatcctttgagtttcatctgttctattgatatctatactacatcagtttctgtccaaatgtttatttcaggtgaagaatcttacactggcatttgctgttcgagtagctgcgtgactcttatcagaactccggcatatcaattgatgaggcccaacttggtgagaatcttcctattttgggctatgcggtaataatctaaagatttcctttaatggttaatatgtaagcggcagactccttatctaacttctagtttacaatatctctatcaaagttgtggcaattgtaagtatggtctgtgaaaatgacccctcaaaggccaacccacttgtatggctggaaagttacagaaatttttatgctcatatgttcctatcagtcaacagtaacgtttcaatatattgggattctttattgcagttcctactgtagcgtgcaattccttatgggctctaaagcctcccctgtgattatctaattaaccacctggcccgctagcccgaatacttttgtcatatcttagtagatgatattatgacacacctccaagattgggctgacaacgaaagatagtgtagatggacatgaaagtaaaatgataaaacatgtccttttcgaaagaactgggactccaccaatttcgaatatttatcttctacagtagctgtgactaactgagctgaagtactgtatatggtacagatgctcattataaagatccccttaatctcacaattaagcgttaggcatttttagcatctgtatattaaattgcatgaatttctttatccttagcttggttcctgtttataacaagactatttagtccatgcaataattcataaaagtttgcaatcagattcacctcatgaattgattttatagtggtagagatattgctatacaatgcttagaacagagcactgttccaatgcagaagtctagggtacagaggagttgggaaaagaaaggtggtgataattgttctgtataggaatggggtcccatggcaatgttaactataggagaggaggggaggaagggttggttatgaggccatgtgcaacgggagggcacaagtggggaacaggggttgcacgggataacatgggagccatgtctctccatgttgcctagtgagtatttgtgtatagctttcgttcttggctggactcctctggcatgggaataactatcaacaactcacaattcccccacttctactttacattacttacccttttcctaccaatattagaaaccaaaagaaatggaagctttactattttttccttttccgttttacttttatagatccgatttcaattggcggtcatccctgtaggggacatgggaagagaattcattccctcatatgtgat

SEQ ID NO: 7021 - DNA, 705 bp, Oryza sativa
  unsure (1)..(705): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnntcggcacggccagcttcaacgacagcagcctctccacctcctccttccccagcctcctcaccaccttcttcctcttcttcccgtcctccttctcgcgcggccgatacgccagcaacacctcctcatgatcatcctctgtcgtcgtcgtcttcttcttcttcgccgccgacaccagctcgaaatggggccgccgcttctccccatcggcgcaccccctcatcatcgccatataaaatcaaaggtatttttgattattattctgtgatgaacaattagacattggagattattggttttgttatttggaatttattcacgaagtggttttggagatgattggattcacaggtaatcgcaggattttattatttcatgtgaccggtcagaccgggctgtgtatgccggtcagaccggcggtgatcgagcggtcggaccggccagcccacggtctgaccggccgacactgtgtcggtttcggtttcgggttgtttgtttggatatccgtgattatttcatgattatgacttctcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7022 - DNA, 661 bp, Oryza sativa
gcccttatattattttgtcttccgctgttgttctctgatagttgttggcctacctggccctaatgtaagtgtttaactcttttagcctaaattcattcgtgatatgttgtgatccaactatgtatgtgtgtaccaactactgatccagggattggtacggataaacacagaagatttccgattttcaaaatcgggggtctacaggaggatagaggctgacatgtgggtccacggtttttattatttttccaggatcgaatgccatgtaagtgccacgtcaatgtcacgtgggacaaagacctagttaaaggagccacatatgcgccacgtcagcccaaactgcctggggatctcgtttgcaccggttttgacagttcagggacctggttgtatctgatttttgggttgaagaacgaaaaatcggattcggtgtaaagttaagggacctcaaatgaacttatttccaacaaatggtgagggtgtgggattgcagaagtagaagtaggaagatccatccgggtatggtctagtgggctggacttgtccgagtcagattacatccgagttagaggattccaaaaattaagcccagcccagaggtggtgatagagtcgagtcgaaccaaccaaaagaaagaagaagaagcaaagccccaaaatcg

SEQ ID NO: 7023 - DNA, 686 bp, Oryza sativa
  unsure (1)..(686): unsure at all n locations
nnnnnnnnnnnnnnnnnnnnnnnnnnnnnnncctaagacctatcatagactgatcaaattttagttccagtgttcacattaaacaacgacggttctgtccaccatccattgtgatcccaaggatagcttcccgccattgagtcgtcatggttttctgaggacgtccaccttccctcctctcaggaagtggctccatcagcataaaaatcaccatgcaatatcccatcccacacaagttaagaatttagagtctagccaagtgtaatacatgtcccggtgctcaataaccgcgagcacggctattcgaatagatttggtttactcacactgcagtggatgtacactttacccgtactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagggaagtctcacacacatattaaattatggttcaagttaagttctctctctcacacactcatggcagtcctaccaatggcgacaccgatgtagggcannnnnnnnnnnnnnnnnnnnnnnnnnnnnnnnnnnnnnnnnnnnnnnnnnnnnnnnnnnnnnnnnnn

SEQ ID NO: 7024 - DNA, 1942 bp, Oryza sativa
  unsure (1)..(1942): unsure at all n locations
nnnnnnnnnnnnnnnnnnnnnnnnnnnnnnnnnnnnnnnnnnnnnnnnnnnnnnnnnatgatgcatagatagagtatactactaggtcacaatgtcaatgagaagtatagggtgtaaagtagccatgattccggggggtcccgagttgacaagggaagagagaagaaaagtgtagtacctctggatgagccagagcgtgttggagtcggagccggtgacatcgtagagggagtggcgcagccagtggacggcgacggcctcgcggcgcgtgacgcccagcttctccgggtccagattcccggccttgtcagccaccgggcagaactcgaacggcaatcccagcgtgtccgcgaagtccgacagcctcttccccgtcgcctccagcgcctccatggacgcccccagcccggtcagcctcaccctcggcggcccccccggccgcgacgccaggatgtggaacagccccggccattggagcccctgcatgatgtccaggtcgatgatgtgcaccctctcctccctctcgaacgcctcctggatcgcctggttcgccgtgaagtgcgagaacttcacgaacgggctgatcccgttgaacacctggaacgccgccgccacgcgcccgtggacccgcgcgcccgccggggacgggctcgggagcggcgcgtacagccccaggcacgagctcaccagccgcgccgacatggcctccgcgaagtaggccgccacgcgctgcgtcgaggtgccgaacggcgtggcgagctccgcgatctccagcagcgcgcggtgcgcctcgtccaggttgtccgcgttcaccgactccgcgcactggagcagcagcgtcagcaagtggaggccctcctcgtcgcgctgcttccgccgctgctcctccttacgctccttggcggccgcggcagccgccgctgcggcggccgcggcggcggcggcggtttcctccgcggtggggggcttcggcgactgcggctggttgggctcctgctcctgacactgaggctcgcgacgccgcttgtcgggctgcgctggcggagggggagggagcgcggcgaccgacgtgggtggtggcggtggcgccgtggcgtcgggagggaggagagcaggatgcgacggcggcggcggcggcggcgcggggtcggagttgaggagagagcggaggcggagctcgaggatggacgcgaggtcggggttacatggccggatgatctcacgcacgttgtggatgagctgcgcgacggagaccgcggcgccgctgctggcgatgatgtcacggatgatgccatccacccaagccgtgctgggcggcccaccctcacccgccgccacctgttgcggcgccggcggcgcgggcgcggcgaggtccatgtccgtgtggtggaacgccgggagctgcgtgggcagcgcggggagctgcgcgctggcagacaacgtcggcgcgcccgccgcggcggccgtgacatcggacaggtcgccggtgacatggcggcgcggcggtggcaggtccatgtcggaggcggggcgcttgcggaccatggcggcggcgaggtggtgttgttcttggtggtctaggtagaggaggagatggtggtcggaggggagaggaggcagcaaggaggtgatggcatgagaggaggaggagggagaataagaggagtgggtggcggaggaggaagaggaggggaagaggaggagggaggaggagcccatctacaaacgccaaggggaagaggccgtgggcatggcgagcggacgggcgtgcgcgggaggcctaacgcttgtgttgggtggaatttttatggaatttggcgcggcgcaagcgaggcgatggcgcgaagggggagtaaagaggaagaggccgagaggnnnnnnnnnnnnnnnnnnnnnnnnnnnnnnnnnnnnnnnnnnnnnnnnnnnnnnnnnnnnnnnnnnn

SEQ ID NO: 7025 - DNA, 552 bp, Oryza sativa
  unsure (1)..(552): unsure at all n locations
nnnnnnnnnnnnnnnnnnnnnnnnnnnnnnnnntcaggtattaataatatagtaagcaactattgtataaattggctatatatgatttagagctaatagttggctatactattaaacttgctcaagtaaagtggagtttgtcagcgtctatagtaattacagcggatgcatctcctggtcagtgtcagagtcgtcggaggcctcgccaggacgtcgacgtagcccttggcctcgaattgggcgcggatgacatcatgcctctggcgtatggtggtatgggtggtcattcagtctaaccgaaaaattcggttcggttatttggtgtttgaaaaatttggtctttagaatcacaagaccgatcggtcttcaagaaaactcaagaccgagcatttcggtcttcggctagttcggttcggtctcagttatagaccaaacttagcacaaaaattaattgcaaaaaattttttgagtcctctgtacaagatcgatgagannnnnnnnnnnnnnnnnnnnnnnnnnnnnnnnnnnnnnnnnnnnnnnnnnnnnnnnnnn

SEQ ID NO: 7026 - DNA, 53091 bp, Oryza sativa
  unsure (1)..(53091): unsure at all n locations
taggtgacactatagaatactcaagcttttgaaagtctagtgacacactacacgcgtgacttggtcgatactaataataactgaggtacgcaatcatgcatatatatatatttcttggtttggaactaaaaacaagtggagtactagagacaagcctttagtggcctcatcatctatcgtttagtgattgaagtggtctctttatcactgtacataatggcagcaagcttaagcatatatatactctcgtaaccatggtgcccatgaaagaaaatggcttaaagaaagaatggaagaaaaatggctcctagatggctagccatttcaagcgaacaattgaacatacacaaagccagcacaacaaactttttaaatttcaagttttgtatgcatgacttccatattgtgttggacttatgagtgatcagtgcaacctgctcgtgtggaagcatctttattgaatgttgatccttaatgaagtttaggttcaatttagaacgaaaaacacttacgagttgtgtattcttaggttcattatgggactctatgcagataagtatttagggagtagacacatactcacatcacaaaatagtaagcacgttactagatgcatacacaccatcatactctagttatgtgaagcaagcaatcaaacgttcataaaccaaagtaatcaaggctcgaatttagatgtcatatgtgccattgggttgtattcttttcttaagggttcaaatttggaaacacgtacgttcaatgcatatgcgttgtttcgattttagttcaaattgcagggaaacaaaatgtgtgccaactgtcttcttggttgattatgttatgccactcttttcttggttgtgcatggacaactaagcaattacttaaatcaaactatatgtgtcatacttttgttgttatgtaattaatgagcaaatatattattttaattattcaattccaagcatcacacctataaatgtccattcttaattcaaaatccagactcataaataatgatggaagacactattactttaacgagtagaatgcactgctctatgtggaaaccttaggtgtaatcaataaatcactaaacaatactaacgcattgtttttttacacacaactaaactcccaattcatgttgaatagtccactaactttgtgtagaaaagtctaaaaatatagggaaataacaaaagtcaaatcccacatgaaagtaacgcatagagcaataaaactaaaacttgggtcaagcattgaagagggagccaaaaaaaaggggaaaccgcccactttccctcttcccaaagccaagcgaaccatgctatttaatccactacactatttgtgagccttttacaactatgctcccactccgctccactccactggttttttccattccctttgtccccttttcagatctccctttccctctccaagaaaagaaaccatcaaagaagacacaacgagataggggggagtggctactatcaatctccatgggcgcctatgaggccaccaaggtggtttttgcccggttgcaagcgcttgagcccaatcttgctccaaacatcattggcatgctcctcaccaaggataacaatgagatggacatgattcgtctcgcatgtggccctgacaacctcctccaatctatcattgccaaggtgcgcaccgacctcacaaacaagccttcccctcctatggcctcctggggcttcccgtccgatataggtgaggaagcatctttctccgttgacaaggtggggtgtgatggaggtgaagagttctcctctaaggagtatgattggaggttacccatcggtggcaatcaccatcggagctttttgtcaagcaccgtcgacacccttgggtggaagccatgtctatactcccaaaggttccatcttcaaccctataatatcacatttcttagatccacacactaatctctattgtaccagcggagtgaccacccatcttggtagcgacgacatgcaagagtactcttctcgaccacctcagatagaccaaagtgacctaaccaacaactgcagtgcacgacagatctacttgaccttcccgcctgattccatttttagcaaagaggacgtctgcaactactttaggtatcacatgttccaccatagtgcccctattgatgtgtcttgtttcaatattggagcatttcataatttaatgaatgcaatctgttttggcttgtttgtgtcatgtggggacaaccagcatgtatgggatggtgcaagatgtgcgtatcccataccaggagaagtgcatgtttggtttcgtcaccttcgcctaccaaaagacagtgaagctaattcttgccaagggcaacccacattacatctgtgatgcacgtgttcttgtcaagccatacaaggagaaggacaaggtccccaacaagttcaggcatgttaatcattgcctaattccacttcgtatttttgcacatatattaccttttgtgagtacttctattgattttcttaaaaattgcataaagtctattgattttattaaaattgcagaaagtttcagcaaagtgactcttctagctacatgaatcacaatagattgctttattctagggggccctttgacctgcgacgacaccaaataggtgaacagtgatatctatgtggtgcttgtgttttgatctcttttttttaacaatttacaaggagtgttacattgtgttagggccgagaattttgtatagggacattgctagtcatgaggcatcttttaggatgaagcaagatgaacaacaacatgcgaccgagctgcaacgctgttgcttaatgaggcttccgcttctcaatcttcaggattggggccatcatctcagctctcccatgggttcacatgtgcttctaggacaagttgataacaaatataatattaatgagaatgacaatcccactcatttggaggatgtcacatttcgaggtctagttcttggtcgttgtaatgtcttgtctattaattatgttttttcggaaagtttattaattatgttgtactaaggttgtgacttcttgttttatttatagacaataagctgaagaatgagtttgctatgagggaaattgcctctactgcaatctccacagcagccaagcgcacggtcatctctacggaagaggggaagagagaatatggtcccaaggcagcaacacctaatgatgcttgtggattcctggaaaggtaagatgatgatagaaaaaggtttgctagatggacactaaaacgtaggatatttattttggaaaaaggacagaatataccattaaacttgttacctcttttatttgctatatttttccttttttttcacatgtatgttatataattctctctgacttaaacaattcttgctttagaagcaaatacaaaagaagataaggagtagacaattaataatgttgatcaaatgtttttcttgattagaaggaaccaatgggaaaagaaatgcaaaggcgaggataggataaagcagttaagaaactaattagcacaataaatgcctattattaagtagtttttgtgcaagtcatgctagttgccgaaggactttctggtattgatatgtttgttgatgtttgtttttctggtattgacatgtttgttgatgtttgttttgtagtggaatggagtacaatttgcctcatagccccttctcatctcccaccaaggcttccaatgttgcagcaacagctcacactagtaacatcagcagcagtagtagccctcataaggtggcctcatctctattccccccaacatgcacccttgagctgccccctacaactcatgcttccttcaagcgccaaggtaaaatcccaaaccaaatctcttccctaaatcactgtacatttgcaattccatgttagcatgtaattccatgttgcatttgcaattactgcagttatataagatagactattttgttgtatgtcttcagattctccccttgctgaggagtagttggtctatgagactacacatagtaaaggagagggggcttcatctttgctgagtaagtatcagtaattccaacctttttggagtgaaacaggaatcaactagtcaatattatgtactatatataatctgcctcctgtcaagtcttgatgatcgtgttattggtttctttgtgttgtgtacagggaaagcattaacagatcatacataacgagaggaatgccgacaaagaaaggaaataaatttagcttgttttagctctagttcttgggtatatggtattactatagtaccagtcttttagctcagtgtcaagacaaagtatcaacttgtatgctcttttaaagtatgagtcaatataataaaaatatatcgtagctcatgtagtagtaacaaatactagcagtctagcagtgtgaagtggaactgctacatatacaaacattgaagagagcagtatatcagcatctgctactaaccaactgcttctatttagataaaaatgcttcgcgaattgcttgatacctgggccgtagcttgtccagaggcagcagatgttccttcacgagtggcaagcccagaaaaccctccatccatgcagacagccaagggaacttgtcgctggtgatcagcctgacaccggtgatgtcctcatatatcggaatcacatacgacagggagcccagagacaagtcgacgaacccgatcctctctccaccaaagaatttcttctcatcgagcaccttttccagaaccagcagctgctccatggcagcttcgtatgcatcctcctgctccttgccttgtgtggtgaaccacttccaaattggaggtgacagctgcaattgtggataaatgattacttaaaagtttagacttgagaaaataaacaaaaaaaattgctgaccttgtccagcccaaatttggaccagaaacgtgccatggcacattcatagggatcttcaggcaagatacggtatctcaaatccttccagacatcatcgatgaactccagtatgacgtctgattcagcaatcggcttgccttgatagatcagcacggggaccttcttatgcacggggttgcactccagaagcaagttgctcttgttcctcagatcctcctcgatgtagtcatactccacgcctttgatccttagtgcccacatcactttgacaccttaagggcttgaccatatgcctaacagcttcaccttctcagctccatcttctagttcttggtgatccatggttgggactgcagagcaatgttgtgagtgagggtttcagtttgaacaatttggtactagataccttcactggtagtttggtactagtggttttcttgtggaggagatctgattagtttcagagtgtagcaatcagtcaactttggtggcttgacttactctgtctgcatcctgtttagttccattccatcaaaacctgaataagacaataggtgtaaattccatcacaaccttcagatatttatttagaaatctagaatgaataaacttcagttctttacagggagcagtgatatagtgcacttcgaagtggatgttcagttcagttcgttgctttccccacatgaatatgatgtcgtcaatccaaccatctagttgagatttccaacctttcaatcgatcaaagctccactcaattactagtacatctcaacaaattggatttatggaccaagaacattacataaaaagtcatatacatgaatgctccagcgaaatgctaaattcccatgtgcacagtaataatgcctaataaaattacacactacaccgaacaagaggttactactcgtgtgcgctgatgcgaggcagattagctgcaagtaagcacaggcacagctgcgaaattaatttatgcaagctaatcgattggtttggttttctactaattacctcgagcgagctcgaggtggaagatgtcgtcgtcgcgcgggcgcgtgcttgcccacgctggcggcctagctccctggactccttcggttgagcgcagcgtcgcctcccttcccccagtcgtgcgccgccgccgccgtctccgcaaccaccaccaggcgccggcgccgatgccgatggatatcttgggccaatcaatcccgaccatcgcctccctctttgggcttactttacatgggctttgtgatgggcctggcccacaaaattacccccatcactatcagtctctccttccccttcctcacacgaatcgaatcggactcgggagcccttccgccgccgccgccgccccgatgttgggacacctccggcgatcctcccaacgactgcccgtagccaacctcgccgtatactcgtaagagctatcctttgcccaaaccactttctcttttttataccccctctttctccttccaactcaagtcacccttgctactactggactgctgcttgattgcttgtgttcttgcgccatttaccaacccagataatgtcaggatgcagccttgttttgactgtaggcacaccccaagtcggctcaacattctattcgttttagtgttgtgcactagcagtgagcaatatttagtcttttgtttttaattttgtctttccatgtaattcttgaagctgtgtgaagactttaagcaaccaacctactgattggagattgctagcactagtttaaaagtgtatgatagataacaaaacttgttattgatccaacatgcattcttaaatcaggagcttttagcgttgttgttcttgttactgagagtagtttttaacgaggttgcttcttgctagtcaaaagtgactaatgttacttatgttactgttctctacattgtgcaggatccagagttcacatattgaggtactctcctttgtcctttccttcaccacaacattttacaccccttttacaaattcaccgttccattcatgcccctgcttttagttcatagccggctggtgtagaaaccattctaccaggaatttctctgtagatacaagtaataaagtttccaacgatcgggggtatcaatcaagggagttgaaaccaagccttgtgaaggtacgtacacaaagcttaaactgtatacttatctttgtgtgtctttcatttttcaagccacaaggtttgaaccttaaagttgttcccttagtatcttagactagtgtgccaaattagtgtagttacctattccagtcatacttataggaggattatctatttcttcacagttaatctatatccctgttaccatggcactgtcccttgtttatgtttccggttactccccgaaggcttaagattcaacccatttcatttttctaatccaaccagtttcactaaattttctgttgtaggatggttttgtttttgcctgtgttgtgactcttatcttttgagactgctggatgtttaccttcacagtcctagagttatagaagattggtgattgattattaaagaaattggctttgcattgcaggatgatgttgcaatcatcaaacacatacaaaacagtacaaaggaattgaaacaagggccagttgggaaaaatctatcatcggcagagaaaaggaaatttcttgtcaacactgtatgcacagctagttttcgtattgtctagtttactatttgacagcatgaagtctctatgataattaggttttgtttataatcggcagagaaaaggaaatatcttgtcaacactgtatgcacagctagttttcgtattgtctagtttactatttgacagcatgaagtctctatgataattaggttttgtttataattgcttcctggtagagaccaatcaataatttttataacttgtagctgcttgacctggaagattcaaaagaaggtgtttacagcactctggatgcttgggttgcctttgaacaggagtttcctgtggcctcgttaaagcaagcacttgtagctcttgaaaaggaggaacagtggcatagaatcgtccaggttttggatattataatttacttgattttaattgtgttttatcgtttgtaaacccaaaattaaataattggctaactacatggttaggtgataaaatggatgctgagtaaaggacaagggaagactatcagaacatatgagcaattagtgtgtgcgcttgagaaggacaacagagcagatgaagcttgcagaatctgggagttgaagatagcccatgatctacaatcagttccatggcggttttgccgtcttatgttgggtatttactacagaaataataggctagatacgcttgtcaaggtatggatcttaagtctttgtccatcaagtactgtttttcttatattttaagctaatgatcctcagtagaagttgatgggtcttgagtgatcaatgatgccgcttagtctcttacagattctatattatgataaaacccacttatgtgtatttcatttccctgtttttgcttatgatttcagctcttcaagaatcttgaagcatgtggtcgtaaacctccaagcaaagatattgtacggaaagttgaagacacatatgaaatgcttggtctagtagaggagaaaaaggaattgcttgagaaatacaaggaattgtttgacaagccatcaagtaatgatagaaagaaagggcggcagttcaaaaaggctgagaagaacacgaaaaccggctagacatgtagtgatgcctgcacctctaaaatctacagcatcgagcttccaggatggcataagcttagagcttcacagtgcaggttggaaacatctgaatatctgccagtctcttgcccttgagtttcacaatgcaagtatgtatcccccggaaaaaaaaaatagagtatgtacggtagtacagttgttggaatataaagctgtgatcattgtttcctacaactgtcgcttcaagcattgttgtcattccttttgcctccgtccagatttgtttctgacagtgtatccatactcagatcagagcctgatgtgatgcagcaagcaatggtatttgctatgccctctgaatgttaatacatcccgtattttttaactgatgcttccaacaaaacactgctctgaatgttaatacatcccgtgttttttaactgatgcttccaacaaaacactgctcgtgttcaatccttggcacatttgttattccgtcttcctctgtccagatgtgttactgagcgagcatccagaattacatgagaacctgatgtgatgaagcgagcaaattgttggtatttggcgtgccgtctgaacatgttctcttgttatttgatgcaaccattggcacatcggttaatgggccaacccaagaaatatatatactactccctactccctccgtttcaaaatgtttgacactgttgactttatagtacgtgtttgaccattcatcttattcatatcatttgatttattgttaaatatactttgatgtacacatatagttttacatatttcacaatttttttaataagacgaacagtcaaatatgtgctaaaaagtcaatggtgtcaaacattttgaaacggagggagtagctcgctgagccagccgattgatctgtcaatctctatgacaggattagttgagatggaatcgtattcgctgttgtctcctatttcctttgtgtacaagttgtgcaatctacggtgtatataatccgattcaggaggtgtgcggctaatataatccgatacgatttcgaattcacgacccaagagtttgtatataatcggatcgaggtgtgtacatctgatttgtgttgaagatccaagagtagctagcaacctgatccagaggaagacgaagaacatggcgatgacggaggaggagatgccggcggcgaagaagatgaagatgacaaaggaggaggtgttgctggcgtatctgtcgcgcgaggaggaggatgggaagaagaggaagaaggtggtgaggaggctggggaaggaggaggtggagaggctgctgtcggtgacggtgacggtgaccgtgccgaccctcagcgaggaggcgatggaggaggacgatgaggacgacgaggaggatgtgcgggagagggagatgctgctccgagccgaccggacgctgagggaggccgtcatgagcatgcgcaaggaccaggacctcatccgctccctgttcgaggccaagggctacgtcgacgtcctggacgaggtctccgacgacgacgacgacatggagatggagccgttgtaacataacttcacctgtaatctgaaatataccggaataaaacacataccagctatttcttttgattacggatttaatttttaagtagttaatatgatattgatttactagaccgtcatatcagtgtcacgtaggacgatggagccatcatgtaaactgctaagggattcgatttacactagttttaatagtcgatggatactcttctgtggttgagggatgaaaatgaaagttaagtttttcctaacgcaaacagcgctgattttttttatgtaagcacatgcatacaacctagtaatcctatctttctataaagttaaggccctctacatcctaaagctcaacatgcaaagatgctacgtcatccgctaacatttactacatctcaaatctcatgcaagcatgctaatttattaagttttagagctttaaaatgcaagcatgttaattaaattatcatcccacataattcacataatatttcaatatatctctccatcactttttataatatcctatatgcctatatagttcatctcacttaaattttagagctttaaaaaattcaagcatgttaaatcatcattccacataattctcaaaatatttcaatatctctctccaagtctccatcattttgtataatatctatgtacctatgcatgttatttctctcttctgtcattaagctatatcatctcaattgtttttagccctcaaatgattaatctatggttggaattatctctcttattttcttctctcataaaaccacatcatattacttttaaaattaggtcattattctatataccatttaaattatgataaaccatatcaacttatgcaagtttctatcatctaactatattacacattatttatatttcttaacatcataccaaactcccacagcaacacgcggggtttcacctagttacaaaaatgagcatgcaacaaccacatatataggcaagacgctcaatgaagcacggtgcatccattgatccagttgatcaacaaactattggcccgctgaaaacgttagcgcaacgaaccgcgtccaattggttaattagatgcatcattacgcgagcaaacatgtttaagcatggtttgattgtgttgttttcgttttacaacttattgtagcatatgtatttcttacattattttctaaaacagaaaacattatttcttaatgtaaacgaaaacattatttcttaatgtaatccgagtattgctattggctgaaagagaaaaggagaattaatactatcaggctgctcgcactttaaaaaccacaaaacaccccgcaaaaaaaccgcaaaacaaatagctcatgaacttttgttagaaccggatattgacagtggtcacgtgggtaggttggttagaattagaattccaaacaatacgtgctgtaattactgggctgcgcgcatgtgtcagcgagacacggaccggtttgcaggaggacccaggccgagtccgagtccgatccattcgtggtgggctggaccgagtcggaggccgggatgcgaaaggcattaaaggcggaggcggtgtcgaactcgaacccaaggcccaagatacaaagaagaagaagagagcgagaggagaagtaaacccaatatgtagctccaaggatggcgtgtaggatcgaatcacaagaattaaaccaactagatgggggtgaatggttggtatacccaaaaaccaaaaacttttagcggaaataaaagttaccctcgaaatcgacggaagtcggtctgaccgcccgtatgtcgccggtctgaccgccgcttgccgccggtctaaccgctgaaacccggtaaacacaaatcgaagaacttttaaagtggatgacgactttattgattctctctatgtttacaacgtgcaccaacagcactccttacaaaaatttcgactaaacttgaaaccctaactcaaaactcaactcaattgctctcaaaagcgataccgggaagcctcacgctccccctctatttatacatgaggtaggcagcctaaagccacgaaccaaactcatactaagaggcctaaacaacttaggaaaccctctagtacaagaaagaaactttacataaccaatcgtaccaaatttgaactccttccaaattcgactccgtatcccatacgcacataataactccatcgtatgccatatgaaatctccatcaaccacgtgcatcaactctagcctaagtatcccgcatgatctctgatcaccacggacgtcgtcttatctccaagccgactccctatcaatcaccgcaaatactctcccgaggcatcgagtcacctacacatgaaataaataaaaaaaccatattctgagaccaagttatctccaacttgactcattagtagcagacaacagtattacatacgtatagtattcatcgagaagtcataatcatgaaataatcacggatatccaaacaaacaacccgaaaccgaaaccgacacagtgtcggccggtcagaccgtgggctggccggtccgaccgctcgatcaccgccggtctgaccggcatacacagcccggtctgaccggtcacatgaaataataaaatcctgcgattacctgtgaatccaatcatctccaaaaccacttcgtgaataaattccaaataacaaaaccaataatctccaatgtctaattgttcatcacagaataataatcaaaaatacctttgattttatatggcgatgatgagggggtgcgccgatggggagaagcggcggccccatttcgagctggtgtcggcggcgaagaagaagaagacgacgacgacagaggatgatcatgaggaggtgttgctggcgtatcggccgcgcgagaaggaggacgggaagaagaggaagaaggtggtgaggaggctggggaaggaggaggtggagaggctgctgtcgttgaagctggccgtgccgaccctcagcgaggaggtggtgatgcctatgcctgacgacgacgaggatgatgtgtggcagaaggaggtgctgctccgagccaaccggttgctgagggagagcgccatcaggatgcgcaagaaccaggagcttatccgctccctcttcgaggccaagggctatgtcgacgtagaggatgaggtctccgacaacgagatggacatggacatgcagcttgtctaacataacttcacttcacctgtaataatctgaaatatatatatactgcaatctggaatacatacgggaaagttctcttaattgttgtgttgggccctctagtgcaataagaatcatgatgtggtcgacttttgtacccatgaaggctcttgaagatgcaagtttctgctttcgaaaccccgaaagatgacgatcaaacactatatgtaccgtgcatgtctgcccgggaccgggaggctaaagtgtgtaaactactcctagctagctagctagacgcgtttaactggagttccttgaaatatcatctctgatttaatttgttcgtacagagaattgccaaattcttaaccaagtgatctgctcatttctcactgccaattgatctgctttgcaagtttgagttttcttaggtgtgatgtgtgaagaggatctgcttgctgtatacagttttttttctctttttcacggagagttaataggtcccttaaaggcggaagaggatcctctcatttacttccctatgacttttaagtggcacaagttagtggaaagtaagttagagaatcttaatcccttaacagccatgacctcgaaagagaccattaattaattgagttccactacgatactctctactagtattacggtactctctactggtattacgaagcaatctaaaccgtttgtcccatttgattaaagggttcagatttatttataatatcaccttaggtaatggtaaaccggtagtagaaacgtgaaggagcattattataaaaaaaaacggagagatgcaatcgtcattttagcagtgactaaatcttttttttcttctttagctttttttatgaatatgggcaatgccaatgtaatggatggccatatatcaatctagacgggaaaaaacatatgacaaagctatccctaattattatattaataaattattgatttacccttaataataaggcaaaattggttatatgcctaataatattgatagtattataccactaggagagagtataggagcgctctaattaattatcatgttccatgtagtacgtcaatacaattagctagactggtagagaattactacagttgtttcaattcagtaacacgtacttgaggacagcacaaattaattaatttcgatcgctgcagttcactgttgaaaagttaagaatgtactgaccatggccatgagcagaacaaataatagtctctttggcctaacaattactaccaatctctaatctctcttttagtactactagtagcacagtctacacagaggaagtgagattcagaagagcaggagtaaatgtactaagtatttactccatccatccatccgtcccaaaatataagacttataattaattttcttacatagtcttatataatatactttaaccattaatacatttcatgttaggtttctgacaaatatgaaattagcctcgtatgaaaaatcttcaaaatataaatatagtgatataacgtacatatataatacttaacataaataaatatagcctaattttattttttttaagaaaagggagcgctctgtaatttgggaggagtatttatttagacaaaggaggaagtagtacatcacatcaattaagcaatagagcagggagataaaatagttagtatgtttgattaacaatggggaataaattcatttgaggtctcttaattttacacttaatccgattttcatccttgaacttcaaaaccagatataaccagtccttgaactttcaaaaccggtgcaaacgagatccctcggtggttttggcttacgtggctggtttaactaggtcttcgtcccacgtggtattgatgtagtgcttacgtgccaattccatcctagaaaagtaataaaaaccgtggtcccacatatcaattaaacacaaaaattaataaaaaaaaatggtggaacccacgtggatcctacatgttattctctctccctcttcttcctcatcctcactcctcttttcttcccagccatggaactagctcaccttcctccccattctcgcgtgcccgcggcgggcggcccgacaacatgaaggttgtggccgtcctcgggtgcttctcctcgcgctgtggcaccgcctcacggtcgtcgccgctgccgttgtcgtcgtccccccagtccccgccgccactgaggacgacgacgacgccgccgctgataacgacgcggggtcatctgggatgacgcagccacatggaccagcacgaagttaacgaggtctccatctcctccctttggacgcatggcaacaagaggagaggggagaggggagaaggaggcgtcgtcgtccttgggctggcctccgattgctcagcgtcgtccgcgccgccaacgttgttgtcgttgtcctcagccgccttgcctctcgcctgtgctccgcctgccgcccgccctagcctttgcctgctctggccctcttcttgcaggagagagaaaggggatagggagagaacaccgcggcgcgggcctgggcgctggaggtgcacgcgctgtggaaaggacctgacgtgacgctgtgggtggcgccggccgttgcggccgccccgcctcctccctcccttccctaaccccacacactgtcctcctcgcctcatccctctccggccgccgctcgccctaccctgcccgatccgccccgcccatagcccgctccagccaccgctcgcccatgctctgccagccggccacaagcagggggagaaagaggatagagagatactaagagagagagacgaggggagagggaagaagggaggtgtaacaccctgaaaattcgaccgacaaaattaaaactctaaaaatgcgggctttcaaaaactttttaaaccaattgcatcatgccgactttattcgcctgtttcattggattttgatgtcggagtctattaatcgcgaataatgaataactagctaggaacaaaccataaaagaaaatctagttgactaaataaataattaaaatataaattaaaataaaggttaggtgggtttggaaataaataaaatattatcgcaaccagattagcaataattaaattttagtacgatggaataaccctaattaaaataaactatataaacagaatatgagtgatattaaattaaggaggattttagttaggataacacaaatgtgggatgtacttcatttatacaagatttagaaattatgaaatcaaatttactttgaaaataacctaaaatcgggaataataggaaagtgcactattcattgcccgcaaggtgttcgatgtggtccctagcctttccccttctctcccacctctcccctagcccagccccctcctctgccccgcgcgccgcgcgcccggccgccccgagccccgtgccgtcgcatcgccgtcgcgtcgcccgttgccaccgcgtcgccgtcccatcgcgccgcgcaccgactcgtcgccactgccgagccgtcgccgtcgtcgcctcgcaccccgtgccacgccgctcccccgagccccgtgccgtcgctgttaccgcgccgcgccgcccgttccatcagcgcgcgccgtcaccatccggtcgtcgcgtcgcctcgcgcctcgcgcccgcgcgccgatcgcccgttccatcaccgcgacgcgagcctgccgnctcgcgccccgcgccgttgctgtgagccgtcaccgcgcgtcgacgtcgctgcgcgaccgtcccatcgctgcgcgcgtcccatcgtcgctccgagccgcgcgccgccgctgccgagccgttcccatcgccgtcccctcgcctctgccgcgccgcaccaatgtcgccgtcgccaccgccgcaggtcggcgtcgtctcgcgcctcgtgccgcccgccgtcgcgtcgccgcaaccgtcgcgtcgcctcgcgccgcgtgcccccacctcgcgccccgtatcgccgtcgcgtctctcttctcccttcccccccccccccttagctcttcccctcccctatataagcctcactatttccccctcttcccctccatctccacccctctcctctacccacactaccgcgccgccgcctccacgccgccgcgccaccgcaccgccgttatcgcaccgccgccatcgtgccgccgcgccgccgccctcgtgctgtcgtgccgccgcgttcatgcccccgtgccgccgccccagtgtgccgcaccgtgcgccgtcgtcgccgccgccgccgtcgccgtcgccgccgtcggtgagccgctgccccccccccctctttcttttgtcgccgagccgagagagaaagagagaggccgagggaggaaaaggagaggaaggaaggaggaagccgggagggaggaaagaaaggaaaaagagaaaaagagaaaagagaaaagaaaagaaaaaggaggaggaaagaaaagaaaaggaaaagagagaaaagagaaaaaggaaaagaaaatttaagagatttagaatatttaacatattagaaattaattataggattaataagaatatcgttagatgaactcctactatttaaaataccaaaagtactaagatttgattatagaattaattatttacgaattaaaacaattagatgaatcttaatagattattatagattatttttagtaatgtctataggagatcaattcgcggtaataatttagatcaattcgcggtaattattatagattattttgggtaatccctataagtaatcgattcatggtagaaattcggatgtaatcgctaggaattttagacgtatattatattaatcgtttagtcatagactaaattaaattgtataatatttctaggatttcgtccaatatttaactcgtaatagaaatttctaacctattatatacaatgctcggggaaagtaaattattgacaacgaaataattatacccgcaaagtagtttaaatcgaaattgggtttgccgtagtttgcagatagtaaagttaataaaaaggaatcgactttcgcattcgactttcatttggatttatttggatttttatttgaattctaaccgaattcaaatcaatttttgcacgtaactatagagcccgagggagttgcggatccaagcgaaggccaagacccgcaagactttgagcaaggcaagtcatcactattccttgaacatgttgatcccaattgcgaaattgttttgtttacaaatagaattgcatgcaatgatgaacatcccacttgtgattatgccatgccttgattattgtttacccttaaatctttgtaaccatgtttacgtatgagtccctagtcaactatgacaattgcttagaaatgctattctagaattatgcatactcatatttatcaaatgctatatgcttgggcaattacctttgggaaggtaattgagatgcggcatgtggagacatgagcgccacattgccatgatgttgatgacatgatttgtgaaaggaaaaaataaaattaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggagacagtatccctgcatagatggttcacccctgagtgaggcaggtgcgctacgatgggacagccgttgaggtagggccaagaggcgtgccctacatcggtgtcgccattggtaggactgccatgagtgtgtgagagagagaacttaacttgaaccataatttaatatgtgtgtgagacttccctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtacgggtaaagtgtacatccactgcagtgtgagtaaaccaaatctattcgaatagccgtgctcgcggttattgagcaccgggacatgtattacacttggctagactctaaattcttaacttgtgtgggatgggatattgcatggtgatttttatgctgatggagccacttcctgagaggagggaaggtggacgtcctcagaaaaccatgacgactcaatggcgggaagctatccttgggatcacaatggatggtggacagaaccgtcgttgtttaatgtgaacactggaactaaaatttgatcagtctatgataggtcttaggcttgtgaaaatatttgcaaaacgcagctttatgcaaaagaacctaaaaccattccttgaataccctctatcatatgcattgttgttgtggtggcttgctgagtacggttggtactcacccttgctatttatatatcttttaggagagtgttgaagagaagcccttgtcggtacgcttgcgtatcccacaagatgatcggagtgcggtcttgttctaggtctcgttccccagtcgactgcctgtggcatgttaaccgggcccttatattattttgtcttccgctgttgttctctgatagttgttggcctacctggccctaatgtaagtgtttaactcttttagcctaaattcattcgtgatatgttgtgatccaactatgtatgtgtgtaccaactactgatccagggattggtacggataaacacagaagatttccgattttcaaaatcgggggtctacaggaggatagaggctgacatgtgggtccacggtttttattatttttccaggatcgaatgccatgtaagtgccacgtcaatgtcacgtgggacaaagacctagttaaaggagccacatatgcgccacgtcagcccaaactgcctggggatctcgtttgcaccggttttgacagttcagggacctggttgtatctgatttttgggttgaagaacgaaaaatcggattcggtgtaaagttaagggacctcaaatgaacttatttccaacaaatggtgagggtgtgggattgcagaagtagaagtaggaagatccatccgggtatggtctagtgggctggacttgtccgagtcagattacatccgagttagaggattccaaaaattaagcccagcccagaggtggtgatagagtcgagtcgaaccaaccaaaagaaagaagaagaagcaaagccccaaaatcgctagcaatggagatggagttagatggggagagtacatgcgctgctccatgcgagaagaagcggctgattaattccaagctatttcgagtggggtacggtctcagcgacgaagaagatgaagacggatgaggtgttgctgccttgctggcctatacattgctcggcgaagggaagaagaagaagaagaagaagaagaagaagaagaagaagaaggtggtgaagaggctggggaaggaggaggtggagaggctgctttcgtacacggtggtcgtgccgaccgtgagcaataaggtgctgggcagcgagacggtgcctgcacgacacaaggagatcctgctccaagctgtcgactccatcaagaactctgctgtcaccatactagggatggacaaaaagctcgggctcgtgagctcggctcgggcttggctcgagctcgttaagctcggctcggctcgaagactaaacgagccgagcccgagcttcctccacagctcgtttgcaaatcgagccaagcctgagctagctcgcaagccgctcggtaggctcgtcaagtctgtggaaaacatgagtacatgacctgacctggcccattaacaagttgtatcagtctggctcatgagaaacagagaaccctaccctaccctaaccgctcgccgaccctccccattctccatcccacgcaggcgcaggcacgccgccgctcgcgcgcacgactggcatctggtggcgactggcgagaggagttgccggacaccgcctccgtctccctcccctgcgccaccgacccgctgtctccctccccagtccctagtcgtccctcggtgccgccggcccgccgcctccctcccctgcgccaccggcccgccgcatccctcccctgtgcggctgcgccggctccggcctccctccccagcgacgcttgatgatcgacggctcgacgctctgtgccgccgcagcgccgcctccctcccctgcgctgcctccggcctccctccccggtgccgctcgagctcgacgccccctgcgccgccgaccctacttgctgcttacatcacaagccggctcgagcttttatacgagccaagccgagctacactttttgctcgttccatttatcaagccgagccgagccaaagcctgtttttgaccaagctttctcgcttggctcgtttccacccctacacctaggggtgggcaaaaaaagaccgaaccgaaaaaccgaaccgaactaactgagaccgaaaaattcggtcacaaattcggtcatcagttgtaactaaccgaattttacacggtcttttcggtcatctcgttcagttaaccgaaataaccgaattgaccgaatcactatgaaagcccaatacagcccaatagcccattagctacagaaaaccttaacattccatcccgtccccacctccttcccactctgcccggtcctcccacaaccccacttgcgcgttgtgctgcctcttcctcgcgtttctcctcctcctctccgcctcttcgatctctgctttctcctcctcgcaccacgccgctccgcgttccccacccaccgcgccgccttcaccgcgcctccgccatctcctcgcgccacgcctctccgccttctcttcgcgccgcgcagcaccgccgccttctccccacgcgtctgcgcgcccgctccttccgctcttccgccacttccttcgaggctgatgggagacgcgagatggatgggatctggactttctggtggagtggttgagatcgacgggatccatggctggattgatttgcttgatttgattttttttccatgaatcatgctctacttgctacttgttggtggcatcatcatattttactcattcatcccagttgctttctcatcgatcttgtacagaggactcaaaaaattttttgcaattaatttttgtgctaagtttggtctataactgagaccgaaccgaactagccgaagaccgaaatgctcggtcttgagttttcttgaagaccgatcggtcttgtgattctaaagaccaaatttttcaaacaccaaataaccgaaccgaatttttcggttagactgaatgaccacccataccaccatacgccagaggcatgatgtcatccgcgcccaattcgaggccaagggctacgtcgacgtcctggcgaggcctccgacgactctgacactgaccaggagatgcatccgctgtaattactatagacgctgacaaactccactttacttgagcaagtttaatagtatagccaactattagctctaaatcatatatagccaatttatacaatagttgcttactatattattaatacctgaccctgtctatcatacacacattatgttttagagttcgtgctgtagctggctatagatctgtagcccgttgcttttttctctttttctttatctttttaaaatatgtttatagctggcttatagtctgttattgtacctgttcaaattcactagtatattactatagacgctcttgacgatgctggttacataatgtctcgttgatctgcatgtacatttgactggattactgaattcaacttgttaagtggaattaaaaaagttacgaggcctggtttaggtagcaattgaaaggtgacgagataaagcagcggcatactattatatgtgctttcatgatgctcttctcttcttttcttcctttctttcttttttccccatccatgacaaagtgcggccatctcaaatcctggaataaaacatatcctggaaatcatggaaacaaggcttttaagttgttgtgttgggccctgcagggcaacaagaaccatatggatatgttggtcgactagttgattttgtacccaggaaggctcttgaagctgcaaatttctgcttttgaaaccctgcagaaagatgatgatcagacactgtttgcaaagccgcaatataggaaccttaatttaacaccttttgcactgtggccgctcgggaggctaaagagtgaggtcctagctgcctaaactaggaacattccatatctgcataattgaagcttggtgattttccttcctagccaaaagtgattccctctcagcctgtcgagttcgtgggcatcgcatcgcatcgatctccctctggatctgggacgtgtttgtttcgactgcctccagatcacatctcttgtttgttcgtacagagaatatattttgcctgattcttacaccaactaggcactagtttccctttggtagtttaagctgaatgtttttgcaaatttgacgctgctcaagtgtgaaagaggcccctggttgctgtaagcaggtcaatttttaactgctatatatcgccatgaaagaggcgaggtagtgcagcaataggtagctatcaaattacgactaaatcaataaagtagattagcacatgattaattaaaaatcagctgcttgtttgcttcagactgaaaaatagattttttttaaatatatatatatatagttttcattaaaaaaccacagtctaatgatttggaaagcttgtaaatgaaaaatgagaaagtaactttttctataagctgaaaaaacggtgccctgagccgatattggtttcagtcctgtaatatgcagtgcaaaacagattaattaagaatttaagatctatcactgcagtgcatttttttaaatgcaaggaatatgtcatggccatgatcaaaacaaagtctagtctctttgatctctctattggtaccaaagcgcaatgagatccagaagagcaggagtaaaggagaggttagctggtctggtctggtccaaatgagactgtcctagtagagacatgatcgcgcatttctttctttatgtgattcctgtgcgtcccaagggccaacattaattctgatcgttcattttgcacccgacaataatctagtactaccagcatagagtacttaattagttgtagcagcaaaaaaagttcactatattactacctctaatcccaaaataagttaacttagtatgaaatgtgagttaacctaatacgagattctagattcttagtaattttaagatggaaggagtacatcattcacaagttcatggaggtgctccctccggttccatattaattgacgttttagataaggttgagatcaaacttttataactttgactatcaataactttaaaaatatttagtttaaaggaactagaacaatatatatatatttgtctttcaaagcactataataaaaaaagtaaacatgtatttatttattatatatattataatagaaaaataaggtcaaaaatatattttgtagaccgtgtcgttgtccaaaatgtcaattaaaatgaaactagagggagtagtctttagtgaagagcagagagagcacatatagggccatgtttagttcacccccaactaccccaaacttccaactttccatcacatcacatcacatcaaaaactttcctacacacataaactttcaacttttttttttcaaactcccaacttttcccaaacttccaacttttttttcaaactcccaactctccccaaacttctaacttttttcaggaactaaacacaccctagattgtttttgaggttggagttgtattttgtttgaattaacatgctgattatatacatttgcgatcgtgtgagtaatccaacacagtccaagccaacccagccagagggagtattgaagtattttatacatgtgaacacgtgtgtgtagcgcagatctacggacagtatatttgttggattatctatgtactgtagcatgcaatagaaaagcgcctttgttatttaaatggtgatgaaatcatggcacgaatcacgcaaagtggtttgattgacaattggagtagtaggttaagaggaagttcagtagtatagccaactactggcttcaattcatctatagtcaatctaatagctcatttatataatagttacatactacactattaatatctcggattccacctatcattcacacactgtatcttggaatcagtgctacagctagctacaaatttgtagcctgctgccattctctctccttatttatcttcttaaaatatgtttgcagctgacttatagcctgctattatatctgctctaatgccaacaggtagctgctaccgaccgactgactgagagctgactcaaattaaccttgaaccaagcaaagtaaatcaaccaggggttaatttagtttagtttattactatagattgctgacgaatctatctggaatagtacaaagtttttggatgtgcgtgcgcaagcccatatttgtttggtcgatgatgagaagaagaaagcatgtgcacatgaggatcagcatgttgatgctgtgggcgtgcaacgcatggcagcgagtaaaatgaccgagattgaaattgcagtgaaatatactaggatttattggtttcaccaggagtagtagtagtagtaggaaaaccgataaatccttccttgggttgatggatgggcgacgagctggcacatggagggaggagggcctacgttcgtacggtggggactagtcctttgggcgcctgcagtttcacgagacgagtcccggggctcccgactccattttcccagctgatggtcgaactgttaaagcaagtttaatactcccactggtacagaatataatcatttttagtgctagacacggttattaaaaaaatagatagaattaaataggggaggattattattggatgagaagtgaaggtaggtgaaaaatttgaatggtgaagggttatgattagttaaaaaaaaagaatattggtgtaaaagttattatattttgggacggagggagtagtagtttaatattataacccactactagctccaatacatctatagctaatttaatagccaattcatataatagttgcttactatattattaatatattgtcccacctgtcatacacacaattgcgtcttggaatccgcgctgcaactggctacattatctgtagcccgctgctcttttctctcatcttttatctcattaaaatatgtttatagctggctaatagtctactattgtacctactcttaatccctctatctgttagtagatactccatccatcccataaaagaccaacctaatatcacatccggtactagattggtcttttatggggacggagggagtagagttaaataacttttactccttataaccgatccaggtataatgttggttttggagtatttaagatgtgctgctgcaaatggtgaatggtgtgtattactaagggcacccacaatagttatctataggctctatacaagagattcatgtcagcatatttttctacttggaataaattaaatgaagagagagagagcaaagctatctactaacctggagatagtctatagagaaaaacgaggcaatggattagagagctatagatacccatgtagatatactattgagttggtttactattaatctagtttattgctgagatatacatattttatatggagagcaccttattttattattgcgagtgctctaatagcttgattagcttagcttaagtagacaagccactttagaggaacaatgaagatcagtgagacaacgaaggagaggggagtcaggggacacgagatttcgatttcattggagagaaagagacatacaacgtccaaagcaaagcaaaaaggagaaacaaacaaaagcaaaaaagaagaaactagagagagagagagagagagagagagagttgtggaatccaaccaaccaatatgcgccgctcctcttcactctccaagcagagcacaagaacgcgctttgctcaataacacactcccctagctccccgaggatgcctgcccctgcctagcttaatgtggaactaactaggagtattaattaattccttccactaatcacccatcagcgccaaccggcggccacggccaccgtccgctccgacgacgacgacaagttgccactgctcactgctcactgctctggaaggtggtgaagcaggtgtcgctcggcttcactatgaagggccaccaccaccaccattccttgccgccgtcgccgccgcccaagcgccggtgtaccgccctggccgcggccgtccctgcgctcgtcgtctgctccatcctcctgcccctcgtcttcctcctgggtctccaccgccccggtacgcgcgcctgcctcctcgcctcggatctgttctgtaccttacctacatgctgctcacctcacctcctgcttgtcttttttttcttaactgtcagcagggcatggatcggaggagcgcgccgcggttgtcatcagcactgtacgatttcatcaacacattttttccccctccttctgaatttcatacatgctacatttcgaaattacttatttttttctcattcttctgacgcgcgtgtgtccttttaattaggaaatggggtttagcaagcacaagcatctggatgggaggatgaagcacaagctactcaaggtaatgctgcttgctgattctgcccattggctgactcataactcttagtcgcccagctttactgaaagcataagagtgcatacgaagtttgaaaagaaacaaaaaaaaaacttgctggggattccagcgaactgggaagaattttcccatttgatattctgtcctgccaattggaagatttgtgtgactctggagtaagaactgaccttctgaacataaattcccaaattttcaggcgggttttatgggtaggtttctgtagtataaggaaaaaaaaaaacaagacggcatcggttcatgcactctgcatgtgtgtgcagtgtgcttgctgactctttactgccttctgccttgctttgcaggggtattcactctacactgtaagccagggctttgttgctattctggtattaccaccccaaaattgttctttgccaatgacactgacaaatggacttggactgttgctgctgtgagcaacatttctgatgaactgcacatctttccattttaactggtcttatttcttttatgtttttcttttgggccttacattgttgccttgctttcctcctaactgctgttgtcacacctaattttcaattaacatgctgttgtgaaaaatatatctactaatttaccctgcggtacttgcatgtaaatgtatatgtcctgtgactcatgtaactgaaaactgctctacagcactgcagcagactcccaagtggggcttcggtcgaatactatcgcagtatgccactacggctatagtatatttgctattcgtgcctggtatcgtcatgttgggggtgtaacatatggattagcagttttgtactaaatgtattgtattacaaattaataccaagtagatgaatcagctcgtatgcgatatggtttacactgctgcctaaacttattttgaatgtgcactgctattgaaatgaatcacccatgccattttgatatttgcttggttacaataatctttaagagcttgctccactgacctctcaaatgattcctattattttggctaatctcctttttgtggaaccaggatgtttctagaaagaaaattcctggatctgatgggattttgggtgagaaatctggtagtagatcaaagtccaagaatgtttctaccaaatcaaaagaaaagctcaagggtgttttctctttagttcagctaaaaaatgagaccagaaaaaacaaaggtaagaaatgtcagatcagattttgcagtgtgttactgcatttactttgtaaaacaagaactgcaagataccaccagcatccattttatagtatccaatgttatttcagaacttcatacacaaagaagataccagttaaaggacttatcctggagatcaaaggtaagaaatagtttctatatttatttgcaatcttgaggattttaatatatgtgcatttcatcggtttggagtaaccaacggattattcttgtctgtgagcacagttagttataatgtttgttcttcttgctatgataagttgattagtaatggtattttacagtcaacaggatcttcaggaagacagatagtgaatgtgaaatatttgagtaggaacatttttttgatttccagtgtggcatcagtaataatgtacacatttgtgttgattaaaagtacaataattttgtactatacagttgacttgtccttttggccatatttcacaccttaaaaattgcttcttagatatctcactgttgccagtactttcaatcagttaagaatgcacatacttgacatagtttgcagcacagtatagaactgaattttcctctgaaacttagttggttgccccttttttttctgctgttactaagtttattatatggctcagaaccactgagtaattttatattactctgcaaatcttgtacacatgtgtttggtgcgtctgtttgttaatgctttcgcaaatcacaactgcattatggacataatgatacattagaaaaggctttttcaaatttcatattttttccttgatataaatgaatttaaagacaatagtagcacaataacctgataggtgtttgtgtaggatggatgccctttccttttctgccacaagactctgaatctgttctgtgacaggatactactattgataagaaagagaaccaagaagtcgagcatgaggagaaccccaaatcctgtgaacttgaatatggtatctactgtctctggtctgttgaatataaggaagtgatgaaagattttattgtgaagaggcttaaggatcaactttttatggcaagagctcactatcctagtattgcaaagctgaagaaccaggaaacattcacacgtgaactgaaacaaaacatccaagagcatgaacgcatgctcagtgacaccattgcagatgctgatcttccaccattgtgagtccaatcttagtaatcaaatctatatcttctgctttgtttgtaaaaaaaaaaaacttatacaattaaacttcataacaaattatatgagaattagcaatgtcaggactgcttcttttgttataatatttgaccttatttacattctttttatactttttcagttttgcaaagaagctagagaaaatggagcacacaattgaaagagccaagtcttgtgaagtcggctgcacaagtgttgaacggaaacttaggcagctacttgatataactgaagatgaagcttatttccatacaaggcagagtgcatttctctatcatcttggggtacaaactatgccaaaaactcaccattgcttgaacatgagattgactgtagaatatttcaaatcaacgtctattcatacggtccagtcaaacaagcagaaacttgaagaccccaccttccatcactatgtgatattctccaagaatgtgcttgcagtttcgactacaattaattcaacagttatgaactccaaggtatttccaactgattgaaaacattatgaccaatgagtaatccatctcagttctaacttgcatcctcttgacacatttcaggattcgggtagcattgttttccatttgttcaccgattcacaaaatttttatgcgatgaagcattggtttgacagaaatatgtatttggaagcaactgtacatgtaactgacattgaggatcaccagaagctctctaaggatgttgattttcatgatatgaaactgttacgacctgctgaggaattccgtgtcacgtttcgtaatcattctcaatctttccagaagcaaatgaaaactgagtacatttctacttttggccattcacatttcctcctgcctgaccttcttcctagcttgaatagagttgtagttctagatgatgatttgattgtccagaaagacttgtcatctctgtggaacctcaatatgggtggtaaagtggtgggagctattcagttctgtgaagttaaattaggacaattgaaggcttacaccgaggaacgtaattttgacaacaattcatgtgtgtggttatctggtctgaatgttgttgaactgaaaaaatggagggatctccacattaccagtcggtatgaacaattgcttcaaaaggttagtactcctatccctaagatcttacattcgattgtaacttttatcatagagaatatctgaattcctttctagtagccctagttatccttccataacttcatttattaattgtgtcccaatgagagcagtattctcatgcactgcctttgtctttgtagttgcaaaaggacagtgtgacatcatttccacttaaagtacttcccataagcttacttgtctttcaagatttgatatatcctttggaagattcatgggtccaatcaggtcttggacatgattatggagttagtcaaaccgatataaaaaggtctgttactctacactacaatggtgtcatgaaaccttggcttgatttgggcatacatgattataagggctactggaggaagtatatgaccaacggggaaaggtttatgacagaatgcaatatacattaataacagtaacatgagattcaccacattctacatttctgggattttggagcaacagaactttcgggaacaaagagggttagagtgagataaaatctgatgcagcattataatgaattgagtatagtaagggtggcatggtggcactacattaattccaaaatggagataggatgaaatgtttttgtgccagattttaagcaatacttcatagtagctaaagatggtagcaggccaccagcatgatacctttgaagtagatccctggttaacaatggtgtatgttgattccttcaccttttacacgatttggatggatcttcttcacatttaccactttaggattgcaaaagtgcagttccctggtggtcatttttttcgtataaattctttcatgtgtatctttgctcgttgtataagagctatactgtataacttgggtgttgactggcatggcatgtacagatgtagaatgccttaacccgaaagcattgggtgattctttctttcttcttcaaggctgagatgtaccatgtcacaccaatgtcaagtttcgagatctttgcattttgtacatcggaaggattcttgtatcatcagtttgataaaagatacatagagctaaagcagacgtcgaaacattgcaaaaccagaatagcgtgattgcatactgcaggttcattacctttacattttgtcttcagccctgtgttcattgccatggtttcctaactcatctccctcgttttccacgtgcatgcttttcaaactgataaacggtacatgttttgtaaaaaattaatatagggaagttgcttaaaaaaatcatattagtccatttttccagtttttatagataatatttaattaatcatgtgttaatctatcgttctgttttccgtgcggaggggagaggttaccaacctctccaaaaagaacacagcaggacgtcctgtaaaggtcactcattcacatttatcaacttgatatgttgggtcatcattgattagcaaaatataacattagtaaggttttattcagtctgacaaccaaagcaatagcatgaaagaattttggttttgatgccaaaataatgtgccctaccaaatttttagcaatttgaattgtactttggctagtttttggtttgctaaaaaaataccaataataacacacatatagattgacaaaaaaaaattggcactaccaaaatttttctaggttttggtattttccatattaattttggcatggtagcaacggaaaaaactgaaaaaaaaagaagaccagggcacacactacaagattcatcccggtctcccgccgtatagtaggtgaggtgaaatatatgtagtataatacagatacatcgatggttgaggggatcgtcaatagctaatgacactcgatggttcagatcgttaataattaatgacagtttgcagcatcatactccctctgtcccaaaataagtgtagttttacactattcacgtttaacgttcgaccgttcgtcttatttgaaattttttttatgattagtatttttattgctattagatgataaaacataaatagtactttatgtgtgactaaatatttttaaattttccacaaaattttcaaataagacggacggtcaaacattgggcacgaatatccacggctgcacttattttgggacggaggtagtactactaaggagtacatcagtttcaactagaggttgttggagtcaacgtagcccttggtccgcagctggtcgagagtgttggcctgcatctggcggatgagttgagagctggtgttgagagcctgcacgacgttggcgagggcttggtcgatctccttcagctccggggaatcgtcacggatcaccggaagaggaaccggtgccctcggcaccatcgacagcaggtgctgcacccgttccatcggcatcctcttcttcttcacagcctcctccttcttcatcctcttggcctccttctcctccgacggcgtggagcacctcttcagctcatttgtcatcgccacacgatttccgtcgccacccatcaatcttcttctctttcctttaattcctctcgatcgagcacgcagatatcaatcgatttgattaatttccttacgattttcgggatcgatttcctcgttgcggcggctctagggtatcttgctgcccttctcgatcgagcggatataaaccctaccaccgggccaccggcctgttagcaaccaaatcaccaaacaacaagaatttcaccacgaacaactattcagtcaacagtgctgtttttggaggtggaaaatggggaaatacagggggctagaaggttctggaagctagggaatgggaggtggaggagggaatagatactcgacgaggatccagcctggacccaatccgccaccgccgccgattgccaagccgcctaggttggtcgtcgtcctgccttttctgttcgtccttgaatgagcagcagttattgctttatgtattgctcttcctaggtttgcttgggctgggatttgcgtagtggaccagctgtggtgcagcccaacaaggtgtctaacaatcctctctccttgaattcggcttgtccccaagctgatgaattaaaacctcccggatcccatggttgctccaaatatttggtgttagacaatggaacatcattgaagaagaatagagcaggtagctttagcctcaataacttcttactccatgcgaagtcctcctgtgtgatgcgtgacaatggcactgttatgaattgcttgccaacagtgattcccaacaatttgatatgctgcaaacaatgacaacctcgttagatcaactgcagagtccacccatgttcatgattatgtccatttattggcatgccgatttcatcagtcgagcatatgcattgctcaatagattctaatgtatttaccacctctgtagaaactaactcaaaagtatatttctcatcacgaattgaattagcatcttcttccatgtctttcacccttttgcagcctttttcatcagcaatcaaatatagcaaatctctttcagcattcaaaccaatgtaatttgattccaaacatgactcagattctgatatcaccatgcaaattattctcatattccatttctccactctagtttggtagtagttgagcaacatccccctaagatcaacagatgataaccaaacatataatgatttaggatcacaaataactagattgctttccttgctagcaagtgttgtcaaactgacctggaaagttagatcccaaaacttctgcattttctgctcaaagcaagtgcaagtttcagtagtcatcattttcttttgctcattccaaggaattatacttgcagcagaatcagtagtgcaacatttcccttctctagcttctagcaaaccaactaatggcagccaaggtggcatgccaaatagtctcagcttgtcacatgttttcctttgaaggaaatgatcatagaaccaaattgcccagtactgctcagctccacaaccatcactcttgcaagaagtaagtgactccaacttaagtagcagttgtcctttctttccatttcaacaaaagatagccccgaaagtaaatattcaagttcaccaacagcatacataccttccttgctagtggctgctataaggttgatcaaaaaggacaactcacttttcactccaacattgagtctcagctcattgctccacaaaatatacttccaatgaaaataatgttgtgggaaccaatcatccatccatattaatattttgtgaaggtggacctttccatcacctggatcccacactagtggccccaacatgacatgtataatgttcagcgggtttaccaatgaaaattgcttgcccacaaagagttgaaaccatttcgcttcggttggagggggccaaggtggcagtatatgtacttcagaacagctgcagttgaatgccagccatgacattaactgtgactcccatataatgaactcttgatcccttgatgttatgggtggccatggatcaacttcaaagtgttgcaacagcagttgccatggaactaacaaatgtcctccagctgattccactaacattggggtgcttaagaaggacaaataagacacaacctgagagttgttagacccagaacatttcgccgaatacctagtgggcatcaatgtgtaccgcttgatgtcggtgatcatccttggtgagaaggcactcaatgatgcaatggatgctggaacggtctcaagtacaaccgacttggtcaggaacacgatgtcgcctttgttggcgtcccacttgacatcgaagcccaacatcgaacacttgccgtgcgtatccttggaatagtcagtggtggcaattttggtggtgctagttgcaccatcatcagctaccaacttcatggaggccatgggagtggtggcacatttgtccaccgcaaccacggtgagattggctcaatgtcgggactagagcatttcgtcgagcatgtggtgggcgtcacctttgactgctctttcttaactgacgctggcaagtcttttgcctccttcccaacttccggtgtgcatgcttcaaccacatctatgagagaccgtatatcagctctagttctccgatcagcctcctctcgcctcagctcgtactcctccatccgcctcaacagcaaatccaatttgtcttctattgccatggcaccctacttgaagagaactttctcaactagaccaagagctagatggggggaaccaggctggctctgataccaaattgtttttttttactaactcaccgggggggggagagattccccacctgaattgtcattgcataatagattgaaaggttttgttacaacagattcagagtttgaagtgcggaagagaaaagatgtttccagacatctattacatgtcgatcttgcacagctagtgtttctgcccaaagggttgcttcacttatcgctcggtgtaaacaagcagctaaagatggttgctgccctctgaagaccacatcatgcctatggttccaaagcgcccaaaagcataagatgtagaagacatggaggtgtttcgacggcagtaacggtgaattgctcagccgatgaaagagttgcacatcttggatagctggctgaattcgcacttttgaccagaagtttatcgcaaacgggcaagtcaggaataagtggtttgttgtttcgtccccgctactacagattgcacatgaagctgattgaacaattttcttttttgatagattcatccttgtcgacagtctgtttcggaccagtagccaagcgaacaattttaccttcaaaggcgcccgacagttccagattatcttccaatttggcgatggcatttgtacagggaatcttgcatcatagatttctttggttgtgagagaggtcgatcggttgttttgccagacatcgttgtcattggtcagagtaaggtctgccaccattgcctgaaggctgtgaagttccgcatttgcagcctctgaaagtcttgggacaaacattatcattaagcctcttgaaagaacatcttttacagtagcatgacaatctgttgtgtgagaataaagagccgggaagagatttgctaactgaagaatcccaagccaacagtcatgccataatgaagttctagagccatttccaatctttaccgtcatcagcttttgaagctccggcaagaatttctgtaacgaagtccagtgttgtcctaaaggaagggatttcagtagagattgcccatcaaattctttccaaatccagttcgcccaggaagattctgaggagaagaggctgaataaccgcttcaggagaagagcctcattttgaacttttaagttttttactccaattccacccagttcctttggagagcaaaccacatcccaggcaaccaagcaacgcgctctagaacaaacatcctcccccgtacagaggaatgcccgccttcgcttatcaatttcctcaatcaccgaaggtggcagcttgaaagcagacattgcatagacaggaaggctattgaggaccgcattgattgaaacgagacgctctgcctgaggagcgaagcttcccaacctgctaagaacccatccaccttgtttagaagaggctgagatcacccgtagacaacttgtgcacagttagcgggagacctaggtaagacattggccagttttcacgcttgcactgtagcagttccgacaaagtcgcttctttcagcagatcaacatgaagagagatcatagtacttttcgcaaagttgatatgcaaaccagttgctttggagaaactgaggatggaagattttagggctcggacatcatcttcttctgctctataaataatcagcgtgtcgtctgcatattgaatagttgcgtaggggcgatcatggtatattggatgtcttaagcttgcatttctttcaagcagtcgctggagcacatctgctaccaagataaaaaggtatggagaaagagggtctccttgacgaaggccccttcgacaattaatccaactccctgggattccattaattagaaccaaagattttgaggaggtgagcaacttgttaatccacccgatccaattgtccgggaaacctctgaccgctagtatttttagcaggctttcccaatttactgaatcgaaagcctttgcaaagtcgagcttgatgattaaagtttggcatcctcgcttgtggcaagcttgaatcagttctgtcgcaaagattagattttcaaaaatgcaccgaccttttagaaagccagtttgatccatgtgaatcatttttgtcaaagcaatttgtaacctaaaagccagcacctttgatagaattttgacagagcaattctgtaaagagatcggcctgtacccatccactgtgttttctttacctggcttttggataagaacaatgaaggctctgttaattctttccagttgaatagcgccctgggagaagcctgatgctagatttaggatagcctccctgatgtcgttccaagccgcctgatatatagaagctaggaccaaaaccgtctggtccaggggcactgtaagaattcatgcccttgatagctagcagcacctcctcttgtgtaatcggcaaaccttgagtagccagcatgttagagtcgcattcctccgacaagtagagcgctgaaagatcaacatcccacaccggctgagactcaccccccaaaagattttggtagtaggagtgcattaggcgcgctttgccattgtgatccgccacctctgtaccgttgtgcttgattgatttaatccttgatttcctgaaattttttgatgcatgagccttaaagaacgcagagttatccagacccaactttattcttctgactttccccctctgcttccaatatgagagtctgctctgaaccaactgtgccagtttattctgcactagatttcttaaacattgctcaccttgagataaaggcctgaattcttcgagaatgtccagtagatcaattgtgaatttacaattttcatcgagataaccgtgtttccggtgatccttcatccattgtttgatttgtgacctggtgtgtttgaggtttgataccaaattgttagtaaccaaatcaccaaacaacaagaatttcaccatgaacaactattcagtcaacagtgctgtttttggaggtggaagatggagaaatacagggggctagaaggttctggaagctagggaatgggaggtggaggagggaatagatactcgacgaggatccagcctggacccaagccgccactgtcgccgatcgccaagccgcctaggttggtcgccgtcctgccttttctgttcgtccttgaatgagcagcagctattgctttatgtattgctcttcctgggtttgcttgcgctgggatttgtacagtggaccagctgtggtgcagcccaacaaggtgtctaacacggccttccaggtcgagtccgactacgccgttgcatcactatacacgggcaatacaagtccgaggcagagtctaattgcatcgaccaatttcaggttcggagaattaaacaccgcccgatatccgtataatccagccgttccagcgaggttgggaaattcgattctgaatccctgatatttttcataggacgtcggagaaagaaataaactccgaacccccttggccttgggtgagctcaaactcctccagtacagcgttagcgtcgcttctctacaaccactacaccccaagtggatgcagctgcctgaaagggtccttctaatgccttacctctgcttctttgacagtccaagagaaatgcaacatgaaaaatccaaacttgcgcaggaaaatataatgaacaaacactgtctagctgtaactggtctgatctgaactggcatgcagcaaattaatttgcaatgcatctcttgccacaaagcaccagcaacactcaaaatcactcaatcagggaggataaaaaggacaactcttggccaaaactatcaaactataggaacaccagcaatcagttgccattgtatttcaggggttcggagaattcaactccaaacccccacctcccgattccagtatttgagggattcggagaattaaaccccgaccactacgtaccgctccagcatggtgggaaaattcgactacgaaccgcctgataattttaagggggtcggaaaattgaactctgaacctcctcgatcggcatcgccgtcgctagctcagcacaccagatgctgacgaaaaaaatgcagtggtgtaaattaactgacacggatcggacgagaagacgccgacgctgcccctcgctcaaattcaagcaggtgttgcgcaaatgaaaccttacagaaggcaaagtatactataagctatgtgtacatgtgctgttaatttaggtggtaacgagaaattcgatcatatgatttccggattacatcattatactggtgtgaatatatattatcgtttctctgtatattttgacagacgtaggaggatttgtaggcaccagcaagaaatcaaacgatcaaacaagactcaagcaatctagtatgttaaatgatggaaatcatgctccaacgacaattggaatttccaggaatctaatctaatctagtgaaacaagactcatgcaaagaatctagtaaacaggctgctgcaactagttacgatcacatgatagtaggagagaaaaaactaaggtaaaaaaaattaaagcattcattaatttgaaataaaatagccttgcttagatagttaggttgatactagctagttgaaattggggaaattaatcggcgaccaaggcgtggacgtagccctttgtccggaggtcctcgcgggcgttggcctgcatctggcggatgacttgagaattggtgttgacacggttaatggccctgatgaggagtcggtccatcctgttgcgcaacgagttgggattgccgtcagagtctgcagagaccaccggaagaggaatcggctccatggtcacgaacgatagcagatgctccacctgttcctccggcaccatcgtctgagtctccttcatcctcttagcctccttctcctccgacggcgtcgccttgcagcacctctttagctcatggctcccctttgagcaacccgtcatcatcgtaaaaaaaacgctggatatgaaagaaagggctttcatatcgatatgcattaagagaggagtgagtgtgttcgctgggaatcgaactcaggccgtagggcgcaccaccgcagaccctagcgcagttctctacccgtcatcatcatcggacgatgatttcctgtatatatgatttcgagctggttgggtattggaatcgatttgtgaattgctggacacgagctgagctagcgatgctggtctgcatttatatatgcatcactttacctgggcgaggcaaaacaagtaggattcgatcgagtccaattgcatcacccggccggatcggcgttcggtctcttaatcggatcggacgcaccgcaatatatgggctatggcaagtgtaatactagtacgtatttttggtcgtcgtcgtcgtaataaaatctgtttacagatataatacagatgctactaatcagtaataaaatctgtttccacaccaccgaattaagaagcaaatatcatcgtaatgtcatgctcatctacattatattaatacagttaggagagatgctgatgcttgaattgaggcacgcagagcagggcctagctaggctgttgaggccagcatgtcgtcgtcggcggcggcgtatttggtgacccagcagtcgacggagcccttggtgcggagctcctcgcgggccctggcctggtcctggaggatgatttgggtgttggagttgaggagcagcacggtgttggcgagtatatatgtcctcgaactggttgatctcggggtcatcggatcgtggctttcgatctcgaggaaacgtcctcggcacgaacgacagcagctgctccacctttttcgtcgtcatcctctccttcaccttcaccatcaccgtcctcttcttcatcttcttggccgcctcctcctccgcgttcaagcacctcttcagccccagcctcgccccatcagatcactaaattctcactagaacggataccatcatctcaatcgggcggcaacccctatctcaatcgggcacggtgtccgtcacaggctaaaagtcactgatgtgaaaagttatctcaatcgggcaaacggccgtcacggatgaacctatcttaatcgggccctaattaaagcccattactgatagctttgacccagacaacatgtcaaactatagcccgtcatggatgacctatctcaatcgggcctaaactatagcccatcacagatgacccttatctgtgacgagcattaactatagccctgtcacagatgagtcatctcaatcgggcctaagttaacagatgagtcatcccaatcgggcctaagttaatgcccgtcactgatgagtataaatctcaatcgggcctaagttaacagatgagtcatcccaatcgggcctaagtttaacagatgagtcatcccaatcgggcctaagttaatgcccgtcactgatgagtataaatctcaatcgggcctaagttaacagatgagtcatcccaatcgggcctaagttaatgcccgtcactgatgagtataatcctaaaaaatataaattttatttctagctagccttgccatgccatcccgccccactcatgctaatccttttttttttttgtccttgctcatgtgcacgaagttcacttcccgatcggtcacccatcctaaaattgctccaggcccagtacgcttaatcggtcacccatcctaagatcggcttccagaagagtagttgtagcttcttggtatcagtgttctattaatcctattaagccctaggccgggatatgtcacaccccaacatcccccattcatatacattcattcacatacacaaccatcaaaaatcataaacaacaaaattgtatgactcatcgagatctacaactgtatcggtcctttgtacaaataagtttatttgaacaattcaaattttgaattttcaaaatttgacaacttcgaagaaaaattagggttaataaatgattttaaatggaaaagtcaccgaaaccaaagttgtagagctcatcgaggtgcaaaatttttattttggtcatttctccatctgactctatttaaacaatttgaaatttaaaattcaaagtttgagaaattcaaatagaattttttgttagggaacgacttcaactgaaaaagttatcaacaacaaagttgaataactcatcaagatctataacttttattttggtcatttttctatataacattttttgaaccgtttgaatttgaatttaaaaatatgataacttcaaacaatattttcaaatactaaatgatttcaactgaaaaagttatcaacaacaaagtttaataactcatcaagatctataacttttattttggtcatttcttcatctgataaaatgttaggaacattgttcataaattttacatatatgtgtatagtttataaatccagataaaagatatgtcaattttgtgaacaatgttactatcacttatacaactttattgttgatgacttttccatttgatattatttactacccgtaaaattattttgactcgtaaaatgaattattatactgcaagttaattattttgctatagttcaacttacaaatataaacatttcatatgaaaaatagaaaaatactcatcggtgacgggctttaattaatgcccgatagagattaagtgattaattcatgtcaaccggggattagtatatagcccgtcactgatgagttatctgtgacgggccttaagttggtgcacgtcactgatgatggtcatctgtgacgggccccaacttaaggcccgtttgagatatggaatgttatctcaatcgggtctaaagttggtgcccgtcacggatgatggtcatcagtgacgggccctaacttcaagcccgtttaagatatggaatgttatctcaatcgggtctaaactacggcccgtcactgatatgtgttatccgtgacgggcttaagttttatgtctatctaatgtctgtgcgaccatatctcaatcaggctaaaatgcccgattgagatgactttcttgtgacggcccgctatttccagacatgttagagcccgtcacagatagaagggtctgtaatagtgtctccagccatatcgctcgacacctcgatctcaatttgatttgcggaggggtggttctagctagggattaccggcggctaggcttctctctctattttatctcgtgagtacgcgttccgacttccgaatcagaaacatattagaacacacgttcataattatgttgggccgcacaagggccgagcaagataacattggtagcccatatcaattagtattactctctattaacttctttttttttattttggtcggatcaaattaatcgccacttgaatcaccgtaattttgacaatttgatccttttaaaaacttatttgaaaattagtccgtgtcaaaaaattattgaaaaataggtcaaaacctcagcgccataaattttggcgctaaagcctatctgagttggacaccacgtcattggtggggcgctgagctcccatccatctaaaatgttacataagtgagcaccttaacagtattgtttgcttgctgtagtggatggattgttaggtttgtactcaataggtgacgggttctagcccttctacctgcaccgttttttccttcgtaatttaatttcctttttatttttgaattgaaatatcgagaagaagtgtatattagaaaactcaaatcatctctcttaagaagatatcctcttatttaaaaataaaaggatatcttctcgagggacaaaaatccatttccatatattagcatatatgcttgcaaatgaagagatccctgtgtgtatagtgtaaagtgttatgtcacgtatccaaactcaaatcatctctcttaagaagatatcctcttatttaaatttaagaggatatcttctcgaaggataaaaatccacttccatatattagcatgtatgcttgcaaatgaagaggcctctgtgtgtatagtgtaaagtgttatgtaacgtatccaaccatgcaggtaattaagcaaaaggattgattaatttatccaaatgtacaagcgtcctcgttccctactactacctctatattttaatgtatgacgccgttcatttttttccaacatttgaccattcgtcttattaaaaaaaatttatgtaattatcatttattttattgtaatttgatttatcatcaaatgttctttaagcatgacataaatattttcatatttaaaaaaaaattaaataaaataaataattaaacattggtcgaaaaattaactgcgtcatacattaaaaatacatacggagggagtacttaatttcctagctagcggcggggagatctcgcatccccggccggccccgtagagagtgttaatttcctactacgtacgtgtgccccttgttaatttacgtacatgaaacacgagaaattcgctcttaatttctggattactacaatatatatacgggatcctaatctcactggtgtaaattaagaaagccttttaattatttggagcgacatatatcaaatccctcgtttacgcatacatgcatggatacatgctatatatatttcctaagttaattccttgattgcatgcatgtgcatcactcgatctgtatcagtatatattgaaacgcgcgctgattggctccatcattagctccattattcctatctagctagtacatttctcctaagagtacccgcaatggtaaagtaaggtgctatctataaaacatgtacatctcagcaatagactcgattaatagtaaaccaccttaatagtatgtctacattggtatctatagctctctcatgcattgcctcgtttttctctatagactatctctaagttagtagatagttttgctctctctcttcatttaatacattctaagtaggaaaatatgctgacatggatctcttatagagagcctatagataaccattgtgggtgccctaagatacatatcaagatatgggcgacagcttgtcttgtcagaggaacaccgacgacgacgccgctccgccgccgccgctggtgcccgtcggcggccagcagcaggcggagtacatgagtaatcagcaggtgaggacgaggagagagagaggccagccaagcagcagcagcagcagcagcagcagaaaccggggcgtgggcgtggcagatgaatatcaaacacgacgcggccggtgttgatgataatgttggctttcccatcagttcacagccccctacgctgcgtcctcacaattttatgagattttgcgctacctgcaaccgcacacttagtccacagatgaacgtctacatcttcaggtacctagtagctaattaatttgttgatgacaattgacaaaccttatattctttttctttcataaatgataataactttgtatacatgcacgggttagttaattgattttctaatctccatacataattaacttgtacacatgctactaattatgatcacttttacttatttaggtgaaatcaatttatataacttttcatccgcggttcttttcatccgtggttggtagtgcattttgtttttatagatagggaagatttttatttgtttgacatgcacgtgtgaattcttttttaaaaaaaaacaagaaagaaattattgttgaacaattgtaatatatattgtacaatgagctaggtggattgaaaacttcacctccttttatgcctctcttttttaattttaaggtgttgtaacaggggagagagcgctttctgcagcccggaatgtcggcaagtacaaatggacgcctatgctcgcatacaggatataattaattcttgaacttgtgcaaggggtgatcatcatattcaataacgaagacagaataatgcaatttaatttccaagccatatttagagaaactgatacccttatttgtaatatgcatgtatccatcccttcttaaagttctagaaggatatccatgaatgttcaagcctttacgatctcatcgtctaagctatatggttagtgaatgcttcatgcaatcagtgtacatctgtcttacctatctactccgaagtgtgctgtctatatgcatgtaatgctactcttatttatatgatatggttgttgtttaaatgtgttctttcactatgtttaaatttgagacctttttgacgtacttgattacctctagattcaaataaaatatcattgccccaatatcaatcgacctaatttgcattctatagatgtgtatgaatcgtataaaaaatcacaaatataatgtgtaagaactttatcaaaagaaactacgattatatatgcaagccaccggatgaagtgaaagaaattgttggggtatggtcttaattataataccaaactgtaagcatttgcgttaaatttttgtatagaatatgtgagctagtcaccatacgacacctttgaagtaggctgcagtttaccagttaccagggtgttatgttgattacttcacctgttcaactgcacttttgggtttgcaaaggtgcagctccttgcaagttgtcattttattcatccaattctttaccaattgcaatcctggctatttttcggtgcgttgacatctttataggcagaaaaacgatgtttgttttgctctttggcatcaaattaaatggtatctttatgtcctgcatattccaatatgtttttgtttgcaaggaatttaagcactcagatggcaacactgcttgtgccttgtcccctttcactataagcagggcattgtggcttttggattgctctaagaacacatcttgtgtaaaaatttcatacggtagataagaacgcataaatctgaaagctcacatttatctccagtaaggatcaagctaaatctgtaagtggtttctgatttctgtgaatataaatcgtttccatttatctacagtaattatgcaagcttttgttaggttgatgttgttttttttataaatgccccttcaatgactggatcatgtgtatttttctatcgattctacaagtaaagagtacattatcaagtaacaacagtagagaaaatccaatccaggtgttacaagtcatgaaacttaggaccatggggataatgaccttccagaggacacttgcaatgcttctgcaactcaaggtacttttccatatcaaaactattcttggcacaaagctttctgtgtcttgacaaatacagcctttccatgaagtcctcatatgttggatcccttgaggtaatgaggaaatatgcgtaaccaacgagtaggccagatgcagttgtgaagaaggcaattggctccatcacatcccatgaaaattcccagaaagtaaggcggaagaagagcccaacttggcacatgaagaaacctagtccagaccacaggatgcgccgaacttgcttgtgtgccagcttgtcgatctcttccttcttctcctggagcttcttcagctcttcttttcttgaatcgttctccggtgagagtgcaagcggaacagctcttctaacaagctcaaccacctaaaaattgtcaaaaaagaaaaaaaaaggcttcagtttaatagcacaagtgtcaccgagttctaaaaattgatcaggcaactaggcaatttgggagaaatgtcaccttctcggggtggaggtaggccttgtcgcggaacagcagcacgacgccggcctcatccatggcccgggcgagcgcctccgcgtcacgccgcgtgcgcgccgcgccggcctcgacgcaggcgtccaggagctccccgtacccgaccacctcctcccgcccgtccctcagccgccgcttgagcgcctccacgcccaccagccgcaccagcctccgcgcctccgccgccgtcacctccgcctcggcctccgcgggccgcgacgacggcggatgcggaggcggggagaagaggcgcacgtggcggagcgcgcaggccgcccctgtggcggttgccggagagggaggaggatgcgcggcgcggcggcggaggaggtgggaggcggccgcgcgccacatggttggttgccgaatgaggccggccgccggcgacggcgtggtagtagacttgtatactagcaaatgggccggaagtggactggactggacagagacccttcctctcgttttcctttccttttcagtttttatttcctttttctacgtgctagtaaaatcttgaccttttcttttctttttttcctttttttttttggaggatgtcgccatcgccaacgtgctgtgatctttacttcggaaagtgatgacttgggatcatggacaagaatcaacaaaaggatgtgccgttacttgtgtgctgttgtgatgttgtccattcttgcgaggttgcacagagaattccaatttgcaaatacatcaccaactgaatttatggggatgcaaaagatttttctttgatgaaagcatgcaccttgtgctgacaaccaagtcggtcatccttttgcatcctcatgccttatgcagttgtgctcttactcagtgtatttagggcatgtttagaagggctttcacttctaaatataactattgaaagtggagtttggagtagaactatggagcatccacaccgcctcactagttatttttttacgatcactctagtggtctagcccctttttcttttagactttagccttagaaaaaaagtgaagctagaatctgatcaaaacacaaccttatccttgtcaaacttaattcgcgtctttagaaaaagtaaagcaggagcttaagcccaatcaaataaatccttgttcttgtcaaacattatttgttgcagttatgcagtattgttagcgaattccacagacactgtacgtatttttcctgctaccgctgatcagctaacagttgtatccaatgtaacttccatttttacgctttcatagttaggccttacaccatgtcaaatcgaatgtttaaacacatgtatgaaatattaaatataagctaaaaaataactaattgcacagattgcgactaatttgcgagacgaatcttttaagcctaattacgtcatgatttgacaatgtagtgctataggacggattaattaggcttaataaatccgtctcgcagtttacatactgaatctataatttattatgttattagtctacgtttaatacttcaaatgtgtgtccatatatctgatgtgacacgccaaaaatttataccctggattaaacacccccttagggtgtgttagttcacgccaaaattgaaagtttggtttgaaattggaacgatgtgacggaaaagttgtaaatttatgtgtgtagaaaaattttgatgtgatgaaaaaattaaaagtttgaagaaaaagtttggaactaaactcagccttaccgtgaaattctagcatgaatgaatgtcaggttaccagatcagcggataacagagtacgggaaggcatggcaggagagactgcagtgtacagtaagcagtactccgtactggtctccggcgagtgaggcaggggtaggcaaggtttactaccaaaatgaataccttcacccaactcctcttaattctgctcatcatttcctccaattaatattgctaccaagtcacagacagacagacagaaacaagaaagccgagttccatcctccactcatccccgtctgctaataggattaaacttgatcaggcaatgtaattgtaaccccttccagcattcaggccagcagttcaaggaccaatgtcattaaaaatcagaccatgagctttgttgactgaaaactgtaaaaaatgaggcgagtttcagtctgcagttggtgctgtccctgcaactgattgtagagctcgtttgttaagcccgtccgtcaaatagacagcttcagatcaaagtatgcagagcaatttctgaggcatttggtcttgtcatcgcggagtggtagcaacaaacaggtcgtccggcggggccatcgttcacttcagtcagaaatgctgaattgattttatctgacgctgaagcttaggagacgatctttaccagtgctagcacattaacagcgatccgaaaaatcaggatcacaatcatcattaatggcgatccaaacaagataagctaggggggctttctgaaaaatgttgtcgattgcggcctcgtagccattggatgctttctctgtggccaccgtctcctctaccaatccaaaccctcgagagagacctcgccgccgctgtggtggtcgtcgtccatggctgtcgcgagcccaccgccacatcccatcttgtgccactgccgcccaggcgcccatcccatccggatgcaatggcgaattggcgatggctgaacaggcgacgcccgatggccatgagatgcgatgtgtgcgtgtcagcttcttcttgctcttgtgcatgtaaacccagcccaggaagggatcgtcagctcagcaatggcgaaactgtaagtctgcagtagctgttcttgtttcattttttttcgggagaatagctactttagtccctaaagtttgtctgtaggatcagtttagtccctaaccttttaaatggtccaaagaaattcttaacctttgtcataaagcctagaatagtcattgggtccaccaaaatcatcatatggatatgccatgtcatcattcatacaaaatctaagatgaacagtccaatttacccttacatatatcatagaaaaataaatataatggtgaattagacataaccataggaaaaaaataattcttttttcacccttttgaggtatatttttgctcttacatatactatatatttttttaaaattttccttttgttttttattttcctatgcgtaagggtaaattggataaatcatatagattttgcataggaaggtgacatggcatgtccatgtggcgattttggtgagaccaaggactatgggctggtttggtttcaggcctaaattagacttaacaatatttggtaatttcaatagtgtttagcgtctatttggtttgaagacaaattttggcatgcctaagaaaaataggccatttcaatagtgaacttagactattttggcttcaatccaaacacaactttaccttaccaaaattagtcatgccaaaacttgctaaaatttggcattgacaaaatttggtaaggcctatttaggtcacaaaccaaac

SEQ ID NO: 7027 - DNA, 12756 bp, Oryza sativa
  unsure (1)..(12756): unsure at all n locations
nnnnnnnnnnnnnnnnnnnnnnnnnnnnnnnnnnnnnnnnnnnnnnnnnnnnnnnnnnnnnntgtgtactgtctacaagtttcacactacagttaaaaactgaaaactttgtaaagcagacctccaaaaatcaagagtaaatttcacaaaactacagatactttgatcaaactatcacaaaactacagatttaagaatgtatttcacaaaactacagatttagagttaaatttatcatggaactacagatttaaggtattatatcacaaaactattgatttaacaactattttattacaaaactacacatttaaaaactattttatcacaaaactacaaattttataactttaaataaataatagtgctatgatctaaactctagaatatgtagttctttgataacttaatcactaaatctgtagttttatgatatggtgcattaaatctgtagttccgtgaaaagtttaacgctaaatctgtagttttgtgatacacattcttaaatatgtagttttgtgataatttgacacaagtatctgtagttttgtgaaatttactcaaaaatcaattgtggatcataagtaggatggagtataagggacctctcaattaagcgcccctttgaatcgtaggaatggaaaaatggagtgtcggtgacatgggaccggaagtatcatgacttagagacttgaggcagacacgatcacccacgtggcctaaccccctcaggggggggggggtcgggcccgagggtgatacggccgcccttaccccctgcctcgcatagatcagattgtcgactccacagcggggtacgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttggatagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgctcgaggcatcgaggccaaccccgagaagatacgagctatagagcggatgcgccccccagcaagcttagggatgtgcaatgcgtcacccgttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagttctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcccgggagagagcagggaggagaggcccccgagccgaacggtggcccaaggcccccgacgaccggagcaggccctctgcccgcttgtcagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcccccgacccccaggacggccccgaggccactgtgggaaggccgcccctgtcgtcctccgaccccgaggtcgtcggcacagaagacgagtgcaccccgcgaggccgcttggacaaagagcgccccagggatgtggcccctagcgaagaggatcggccccaccgaaaggtgcagcggcccatctactttgttagtgaggccctccgggacgctgagacccgataccttcaggcccagaagatgctttacgctatcctgataacttcgaggaagttgcgccattatttccaggcgcatcaggtcacggtggttacgtcttatcccctcggccaaatcttgtataaccgagagggtactggacgggtggtgaaatgggcaatcgaactctctgaattcgatttgcgctttgaaccaagccacgcgatcaagagccaggccctcgccgactttgtggtggagtggaccccagctcccgagctcgtctccgcccccgaggccagctcgagcccatcgcagctgtctcacaccgccctctgggtgatgtagttcgacggcacctataggaaccggccccacctgtcaccaggccttagaagtggcgtcacacccgaccgcttccctcgaggagggcgatcgccctggcataacgccgggggctactgtcggtgacatgggaccaggagtatcatgacttagagacttgaggcagacacgatcacccacgtggcctaaccccctcggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcactcgtttatctggtctgtgaccagtcacagaccaatcagattgcgggttaggtggcgacgggcggtctgacgcacgcctcgccccatcccgtcaggatgagagcctccaaacactcgtccctagccggagccggcgtgttagctcctgggggtggcacgttggacccggtcagatatatgccaggcttcatcctaaccattacaagcaagacattgtatgaagaggggcgaacatgcagattgataaactgacgcgtggtggacaagaatgaccgatttgtgaccggtctgacactggtcatgtcgtcagcagacaaccatgttcccacgtcgcgcctgcttccggcggaagtggaggtaggtatgggccgtcccatcagaaggtcattcggacggcaaccatgcaagtctccgtctatttatgaaaagataggataagtccccacaaaaaaagagagagatggtgcatgtggtatccccttgaggtataaaaggaggaccttgtccacttagaaaggggattttggggatcgagaacgatcagagagggagagagtaagagctctctggttctccagctctttggtagcttcttcatacatagatccaccaaaacacaggagtagggtattacgcttctcagcggcccgaacctgtatacatcgcccgtgtcttgtgtgtttccattctcgcgaaccttccacacaccgagagcttagaatctcacccagggcccccggccgaaccggcaaaggggggcctgcgcggtctccccgtgaggagccccacgctccgtcatctggcgcgccaggtagggggttctgcgtgttggaggaatagaaaaaacataggattctgataagaatgtagttgtaaaacagaggattggaaaatacaggaaaaataaaggaatgactgtttgattggaccacaggaaaaatgcagaaatcggatgagagagatagattcaaaggaatttttccaagaggttggacctcttgctaactttcctccaaaatctctataggattagccattccataggaattttaaaggatagtataggattcaatcctttgtttcaaaagctttcataggaattttttccataggattgaaatccttcaaattccctacacttttcctacgaatcaaagggggcctaaaggatttacataggaatttcatatgatttaaattctagaaaattttcctattttgccatttgatctaaggaactgaagctttccaaatcatatggaatgactcgttatatgtcgatttcaaaggaaacttagcgagatctcaaacctcttggaaaatttcctttgactatatctctcttatccgattcatgtgtttttttcatgcggtccaattaaacgattatttctgtgttttgcgtctttctgttttacactcgcatttctgtcagaattatatgtttttcatattactctgttttttaaccctacgattcaaagggccctaaacatttcacatttttctcctcaaacatttgggggactgctaggaacgtagaattaaaatatcatgacaccttaaatccaaaataaatagaaatatatagaaaactgtggaatagtttggatgaagcacatgaaaacacacgtgatttaaaagagagaggtaggttccgacaaaaacaaacatacgatccatatgaacttcaaaggaatccagagacccaatcattcgttccaaagagccttataagaatttttctaatgagatttagggttagtttggtttgtaacctaaatagaccttaccaaattttgtcaatgccaaattttggcaagttttggcatgactaattttggtaaggtaaagttgtgtttggattgaagccaaaatagtctaagttcactattgaaatggcctatttttcttaggcatgccaaaatttggcttcaaaccaaatagacactaaacactattgaaattaccaaatattggtaagtctaatttaggcctgaaaccaaaccggcccttatatcctttgaaatttcactatttttcatgtgttcaaatggagctatgatagaaaaagaaaagaaatggattgattctggtgaaattttagtaaactcctcggtccaaaggagtattaaacaatgtccaaagtcgtagtttgtcatgcgatgcattggaattaagtgaggattggttctttcacatttccaattctcaccagagtcttgaggcaaaaatttcaaatactaaaatacggaaaatgaagaagaatattactgctgaaaagtgtgtgggcattattgtgacgctacatcgatctatcgtgtagaaactagtagaaaggtagcgactcctttggttacgcctgcggcctgcctgttgaccgactagcttgcagagaacaaagtttgggtacgcacgcatgcatatttgttacacgccgcgacatttcttcttcttggcccgataaaaagggtctttgaaacgttcttgtcaacgagtcttttgatcgatccatccatggatcattcgatatgtacgttgttggggtcggcaggcccgaaagatggccatctccatcagaccaggttagataattcatctttttcactaaaaccaagagaaaaggctatctagctcatgttcatgtagtagagctactaccttggtactcccactgtccaaccgatacaaacatttctggcatataaaatttatccaaattctgttatgatatcttacatttacttttttttatcggtagcacgatctttgtgggtccaaaaaaaactttcaaggataccaaagtagtttcaccttgaacttaatctctgctacaagctcaaagaaataattatatttttgtgaacaaagagagtaatcaaatcaaatcattttaaaacattatttttttaaaaaatatgacagtcgaattaacaagtggtaaaaaaaccaaatcgaactaccttgtggatgaaggaccgaactaaccgcacacaagaacaaaaatgaaggaggtgcggagaatgccaacaaagcgagatggggacagtgcctacgaatggaggccattgcaaatgtcacttgcggaggatgcgatggacgatgccagggtagagaccggcatagctggtgatgcaggttgctatggacgaaacccatgacgaaggatgacacggagggagctagccgtgaaaggatggggaataagacatgctatgaaggtgttgatgaaaaacacgagacctgggagatctgcttaactccaatgcaggtccaaaactcgccttcgggtatgcaagcgtgccagttgatttgatcctgcaatcaacaagaacaaagacaaagaaaccgcggttaaactcataaacgatagccgatcggctaagtgccgatgacatatcatttatttttgagccgatgtcatatatgcatcgatcggcaatcgttaagaaataactaaatctactcgatcggctgtagatattaacgatatataatccttatgtcgatatatacttaaatcaagtgattgggatagatcggtcgccatgccgagacagtataaatcacttagatcgaaatatatactaacaatgagactatatatgttcatagcatagccgatcagatagatctagcatgtatcggctaatactccgataccactctatattaagatatcaaagcaaataggatataccaaacaaagagcctaatatacttaaatgcggcaagatcttaacataaagggcagatttaatatgtcaataaagcatataggataaaagcagttaaaccaggtaagatcggctaaaaccccgatactaccctaatcggcaaccaagaagcaggctagagattgagattctaatcacgactcataagatcaaacaactgatgcagctataagtatgaaaagaaagacaatatctagacaatcaaaccattggaagtttcatagagtggtaggtaccttaggtaatctaagtcaacatcgatatctaacctaatcggttgtcctctacagacagatgttagccgattgtaggttaaatagcgatattgccagagattatgtaagatatatgataactcgacgaattacataaacaagattagagtatcataaagatggaagcactaatcccgagaacgcaagccgccataacaagttttacctcttgttgaagatcgaaaccgatgcagctcaaactgaaagcaagaacccgtcgaaataaaacgaaagcaaaaagggtggcgatgtgtcgagattgtattgaacgtgtgttaatttgattacatagggctcggggtctatttatacccgagaattacacaacatgtccataacggacacgactcttatctctaacaaactctaagataccataagtctttgcggtagacttttgtccaaacatatctctaaggaaattacataaaatatcctaattaatagatacaattgccttctcaggactctatccatgcacagcaatcatcttcaagcatatcaactcaacccgatgacgtacaccaagtcgtattgtcagaatcggctatatcgtctaacccagtctgactcggacttagccgatcccgatcatagccgatttggactccagccgattcccactctgttttcgggacgatctccatctcgaattctactttgattctatccctatctccgatacttagattaccaaatttggttgttaacagagggtcataggggccagagaggggagcaagactaaagacgtagtggcagaagatgaattcgatggattgccgaggccggtaggtgcggggtacctatgccacgccttgtgagtgttgaagggttgtgatgctagcgttggatctcttagggatttagggttatactttcatgggccttagttgatggtaagggtgaaaacggtcatggaattttccaatcgaccgagctttgttttcgtataaggggtaccatttccgaacgtaccctttttagctatttataatttttgttttttctaatttttttatatcatattaatatcgacactgaatagtttaaatgataaatatggtcaattactggccgattgagcatcatttccgtacggacttggttcggcatcagcttggttcggtacggactttggttaatttgtgctcacccttaatcgaatgtgactttccttctttgtcggcatttcaacagctggcccgagatgtacacacgcgacttcccatcacggcacgtacctcaagggttaggtttctctccactacttccattagcattacaccgtcttaaaaattagtatttcaggcttgattaattaaaaaaccgtctttgagctgaccatttcaaaaacatactccttccgtccaaaaaaaatatctggagagaagcctcccccgattcgtgttactagattatgtctcatcccaattctaggttggtttttttttctattaaaacatatatatggaataaaggcatattattttgttcttttgaaaatatttatgagatgaaaatagtagtataagaaaacacccttcatcgaccactcaggcttgacaatactggtagttccaccaggttatccccgaaaggatagaaaaaccacctcatgtttaatgcctagaatatgttcatttcaataccattgttcattgttcatttgacgcaggatatgagagattttgaggctacgtaatctggtacgcataacaagagaagggaagggtcaagggggggatatggggaaagatggcagtaggtagagagggtgctttgtgcattggaccccggaaggcaggcaggctttctggcactgtcttcttcactcgtcgatccactccacgcgaggatcgatcgtcgatgtatgtatgcatcgatcctgttttcggggtggaaagtgtctctccttttgttggtccctccctgtccaattctttcgtcacttgctcttgttccttctcattttgcagcctcatctcatcacctgctgcttgcctcgtgccgtctcgatcttcttcacgtccatccaacgcagctcactccaattatactctcttaccaatgtagttggagtactacacatgtgttcaagctggcttcaggtaaacccccaaccataaacaccatgcatatatgcatgcagagttgcagacatgcatcagttgctcttcctcttgctaagttgctatctccattgattaggagtttagaggagtagtcagctgagctcccgtgtcgatcgatgacaacggtaggatcgatacgcagttgcccttttactgcacttgctatagctgctgcacaataacattggcagtgttgcatcgagccaatattggctgcactgggtagctagctgcacgctgcttcttcctgcgctcttctgtatatatgagacaaacaagcggcggtgctgcctgtaactgactcaggtcacgcgctaatcctgcggctgccaatcctgctcaattcctttgtaatcttgtccataatactactctgtatgtctgtatcgctcaccgccaccgatcgatcacctggccgaggctgcaatgaatatcttcacgattcgcataccaggagtccaggactggctctgctcatcagtcatcaactacaaatgcaccaagtacacatactgatactgtgtgttcattcattgagcaatactgctcgtgattgtacagtctgcatcacctacaaatgccatcactggcacagcaagcacgagtaaatatggtgcttgctctctgcttctgttcaggcttttaaaatactggtatggtactccagccttttatttaagaaggttgcaggcttaacagtgtactacagtatagcagcccgtttaattggctagacaagctagtaataaggtatgatcaattcgcatcagtagccattgcctgtatcaagattagcaacaatgcacacactgatcattgacgcatgcaatgcattgtaccttcattcaattgcaattgcctgagatgatgtaggatgattaggacatgttcctgctgcctactgtttagtggagtaattagtactacaacagtgtactaattaaagtagcagcagtatgtatattcaggggatcattgcaagtagtaggtcaaccatgacactgatcagtcgtagcagtaaccatcactccacagattggaaagtctagtgatcagcttttaactaattcctagccatctcgagaacaaaacagacgaaatcatggaaatattcgaaatattatactgtaaagtggtgggtcgatcaacacaggcactagattaacatcatatttacgttacgtgcaaccgttttctatgaccactacttacgcctagcaaactagccatcacagacataaattgcttaactgcatctataaattaagatcacataattaagttttggcaaatggcaaaagtgtatctctgacatcaatttacagtgtaatattctctacgtattaggctatcttttctttggataaacattgaacttggttgtattaactggaacacaaacactggaagggtccgaagaaatattaggctcttttaggcttcaatctgttcaagacattacttaattgcctagcttttttttagaacagttaattgcttagctaggtcactgctttttttttttttttgaaaaccgctaggtcactgctatgatggcgtccccaatttacagccgtgagggttagtacccttttttgtgtatataaaagaaaaaaaaagaggaagtagtcagtagccttttaggtgagacttgactcgatctagaaagcttcggatatactagagtatactcctttactatagtaacaaaaatcctttttgtattattttttttacttgtcactaacaagtagtaacataggagtatgcatcaagataatctttaatatttaccatagctaattttatttatagaattttttacgttggaaggggtgcgagtatttctttttcacgtcagtcgttaggcggagagtgaggaagaagatggaacatgtgcatggggctagcgacagaatcagtttaaggtgagaggttttttcatactaggaggggatctagagtgggagagggcgcgcttatgacttaatgtgagagtaggagtagcacgtagggtgttgtttagtgctaccgtgaattactatagctgagtcgtactaacttttttggttattttttaacgtagtagtacgatctaaaaccagcgtgaacattttgcacatagtgaaattaagacatatcttcgtcacataaataaaattgatcgagaagctagctttggcttatttcattatattattgatagagaagtaaacacgccaccaacctaacaacgggtaaacaccagcagaaaaggtatagcaatcaaatacaaagcttaagtaaaaacatgagagagtatgtatatatatatatatatatatatatatataggagcagtaactagtttttgggagcagcaaccagagtcgataaaaatgcataatactttctccatcctaaatatttgacgctgttgatttttttaaacatgtttaacctttcatcttattcaaaaacttttgtaaaatatgtaaaactatatgtatatataaaagtatatttaacaatgaatcaaatgataggaaaagaattaataattacttaaattttttgaataagataaacagttaaacatgtttagaaaaatcaacggcgttaaatatttagaaatagaaggagtattaaaggcaggcgagcgattggtggtgtggaattgtggataggaaacgatcaaggggtggataatttatcttgggtagggatggaaacagccaggctggggtacagtacatggaaaaagcttaaaggggcaaatgggatccagcaatcagcatacatgtacgaccatatatatcagagcaaacatacaaactagctacgaaacaaacgacttgatcacgagtgtatccatatatatatgcatgcttgacaagcaacaatatataatgcatcaagaattcaggattccatgcgaaatttctgatacgaatgcgacgcttgcatacatcaacaaataatgctgctagcacatgcagatgtagcagacgtacaccagatcgatcgatgtgcggtgcggatatatatttaatatttaattttgatcaatcagcgaatagctaatatgcagcaactggcgggccacggaccttcacctcatctcctgcacgacatgtgattaattgcttcaactaatattatccccaatgtattttaatttgtttttctctcgtacgttttgttgcatgcaatgcaagcagctacttcactaggcgcatggatgaagttcagaaagttcccggtttcggacatgttttgaaaaaagagaggaaaatatcggtcggaatcttttcgaaaaattttggaaacagaaatagattcgaaatgttttctcataatagaaacgaatacggtaaggctactatctatcgaaaatcaaaatcggttggaaactgttggattctttttcttggaattggaaacgaattacttttcatataccgctaattatctccaaccttctctagtctagatgctcagatttgtattgagctttgaggcggttggttgaatgaagatattttttttccgtgctttagatatgtttttcttccattaggctatgtcatactacttacaataatagatgaatatagttcttgttttttttattgttctcctggaaagtgagaggtgcacaactagttgtattactactccctccgatttctgcgagaaaatattttcgaacggtaaaagatgcacaactagttgtactactgctccctccgttctagcagaaatcctgaaaagtgaaagtgagaggtgcacaacaagaaaatatttgtgcacctctc

SEQ ID NO: 7028 - DNA, 1036 bp, Oryza sativa
  unsure (1)..(1036): unsure at all n locations
nnnnnnnnnnnnnnnnnnnnnnnnnnnnnnnnnnnnnnnnnnnnnnnnnnnnnnnnnnnnncaactagttgtactactgctccctccgttctagcagaaatcctgaaaagtgaaagtgagaggtgcacaacaagaaaatatttgtgcacctctcaccagaactactccctccgttcgaacggttttcattctagtcacatccggtggtcacgtgcatgtagcatgtgcaagtgcaacaagtccaagtgtacaggacagaatggcatatatgcaggcacgagagtatgcgaaattgtgatatcacagcaggcgatgcagatggctagagatatactgcatgcagcagtgcatgtgtgtaggcttatgcatatctggatggatcagcaaccagcgaaaaatacttacttgtccttgagcagttcacgtgacttgttgctgtgctcgatcgctgtatatatgggtcggagtaacagtgctgctgtaatgctgtactagtactataaagctagctagtgtagaaagaagggaacaatagtccatataaatggcagtggtccgccggcctctccttcgttatcctagttatatcttatccatatctaagttagtcttttcgaatgtagagagtatttggtctcggccattaattcacttgcttgctgcgtagtaatataattcattttcagataatcaatggaataattaagcattccaaacgttgtagtattggcatatatataaatatatgccgtttcgtattactacaaaatttccacatatcattcattctcgatcgatatctatctagctatctactgcttaggacaatggctaattaattgatcgattgatgatgcaaatatgtgtactgctacatactatactggattgaatatgtatatgatcgacagtgaaatttaattatagctgaatcgataagaggccgtggatcaacggacgttactggctagctctagctaggtcgtgagaaaatgacatgaatataggccgagtttagttacaaactttcaacttt

SEQ ID NO: 7029 - DNA, 10911 bp, Oryza sativa
  unsure (1)..(10911): unsure at all n locations
gttgtgaactaaacttctgggcaatagcattaatgcaagacctgttcctaagttactctccattgacaaagcttttactgtcgtagtacttcttctcactggcttctttcttctcgttccgtttctgcaaaagcaacgccacagactaaaaatgaacaaaaccacagcacatcaatggaccagaataaataaatgcaaactacaccaagtccccacaccaaacaacatgttgctgagcgtagttatagcatgaaaaaattggtcccagagaaacagataaatatttaaagcgcatatgcaaagggcttcaagaaaacactaacacattatcacaaacatcggtttataataaatcatgtacacacatcattaatatgaagtagacaacaggcaaatcgcatttatttgactgggattatgtactttactacatgctgcatgcaccaaacagaaaaaccagactccaccagccaatttgacgtagcaccaatataccatgttacatacctggtaggcttcatggttagcaactatcctccttatgatagtactagtagtgatgtctaaagggctctccagcctacggtagatgcccatagcccttggaacagcatatggatttaaatcatcctgataggtgcacaagtaacagttgttaatgatcaatgctatacatctttatattctaagaaaatgtattgtgtaagtaaccttcataaagtccatattctcagcaattgtcccatgaacaaccaacgaaatattaaatgtggtaatctgcatagaaaaaggaaattagctacctccagccacactgcaaagacacataccctgataatcataagtaacagttaagggtatgaatttcagatagtcaatttcaatgataatattgcatacaaatacataatctggttcttaacatatctaacggaaacttagactacatcaaattaaacttttggaaccaagccagctcctaaacttttagtttatttgactgacaaaattaacgctacgtgcaaatcgtgcatctgcaaaaaatcatggataagcacaaatcagaccatatctgttaatctgtatctaaaatcaataatagctgtgagcaaggcttttgctggcgtagcataaatatcatgttcaatctttgaactgtgcatgcatagctgtgccatgttcaatgaactattactagcagttgcatcaagcaattcctactacagtaagagagcatcatgataaagtagaacagaaaactaaccatatctttcgaaacatcccatggagcaccaatgatcacttcatcaacataacggcaagccaaaacactcaaacttctctcatggaggttcatgattgggcgatgtggtcctcttgttgaactggcaaatacagtaaacaccaagtgcccccaaaaacagaatgttatgacgacggaattgagtagagatgctatgcttcaatacaaatacaacctgactataaactaagatgcaaaactgaaaaacagtacaagcattgtaacttggaaaaattgagacagtgaaaaaaaaaaccatcattattaccttatagtctggtctgtgtgaatacccacaagcaggaaatctccaagctctcgagcgaggcgcaatatctaagtagaagaaactataaatacacaggaagtccaaatcactatgtcttagaaagatcatttcagtttgcacccttgcaataagaaaaagaaaaggaaaaggaaaaccacaggtaaaaccatacaaccaacaaatgcatagccaagttgctctacatgctgagacagacatttgacattgcgtttacctcaacatgtccagcatggaatagatcaaatgcaccatctatgtacactatccgagaatctggacctggaccctgcataggtaaagctgacagtcaacagaaagaataagtggccgtactcagcaagtagttttatctagtgaatagtatcaaatgtaaacagcttgaaataaatgataaacgactaatgcaatgattaattaatagttgagcttagcagcatgttagttcttgttggaagttcaaggatataacttatattctttattaatataacctcagaacaaatctaagttgtgaaataatccatttgtcgtcaggtcattcaactcaatgtttactagataaagaatgcaaccaaacaacaaatgtctttcaaatggcaaaagtaatagtaaaatggtaacaggatcctgaaagccaaataactcgtgctctactgtttaaaggcaaaaaaaaaaaaccatctatgaggcatttttatgctgtcaatgtttaattcatgccttcaaaaaatatgatatctcaaaaaaaaatgacattcaaagttttacatgagcagttcagaaaatgatcctccgtgaaagaatgtaaagagctgtaccctgctatttgagaactgaactattctccgagatgtaggaagaaaatgagatatcctagttccacttccagatccactatcatcaattttctggccatgcccgtgactgaactgcctttgtagtgaagagtggttgtgactatcagaagctgatctctctctaacacaaagaagcattcttcctgtagtttatttactagaaagatgagctgggcagttagcatgaaaataaaacctattcatgaccataagcaatttattgatacagaagggaattatgtagttaattgtctggagagcttaatagcttatcagttcatcatatgataataaagcaatagtttgaatgttttcctaaagtaccacttcaggacaaatcaggtgggcattgatcttgtctacaaacaattatttggttgacctataaataattgtaatgttggaaattgctatggtattgagccaaagaaataacttgtaaagttgtagtacataacaaaaaccatatattcccttgcgatggaagttttaggttaaatttcactatgagtaaaaactttaatgattaaaacagaaaagaacagaatcaataccaacaatgtctgtcgttgacactccttcggttcttttaatctgcttatatcgaccaacctttttggcaagagcatatgcatcagtaccatctgggagcagacaaggatcatcgccatgaatgatataatctatattatactcattgaataatttattcataaaatcttcagttatggcgtaaggtgcatctggaatgacatcgtgcacccattttacagcacggaccattatcaacctgtatatcagaaaaagaaacataaaaaaatcattccaaataaaatggtttttttaagtagaaaatatgagtatatgataatacataatacattcaaagaaacaaaactgcaagtctaaaaggacaaaaatgcccaaaattccatacggcctggggtcacacgtaagattggtaacacaactaaaaatagaaagaaaaaaaaaccaatatgtgcagtaactcctaaactggaaaaccagacacaatgaaagtcagtaaacaacaaaagaaaaccagcaaaaataacaaatttatagtgttgctaaactaccatgatgatgattaaatgaggaaaaaaaggttgcagcgcctaacatctaaaatgccacacataccatgtcatatgtgagcagcttgtgattatcaacaagacaaaggaaagcaaggaatcacttagcaggtacttaaggcaaactaagcagaaccaaacctgcaagtctagtatggtttatcgttaggagttaataagttttttggatttgtatgaatgtacagaccaaaaagtcactgtttagtacttttcagcggagcaaaccttttttttttctgtgtttctccttcaggcacccaaaagaaatagagctaatctttttggttactgcacagatattgaatccatactctcaaatgaattagagaaacatatgcagctcatccaccaccaaagttatcagaaacttggtccgacgactaactacaacccacatgtcacaacatttcccttagcaatttcaaagtttccagatagaattactggactagtgctcaaattaagaccgacggacacatatatgatgtgtggggggaaaacgttgcatcttcaaaaactaatctgaggatatccctataaaagcgctccactagtaacttgtattgtgcaacagtacattgaacgcaactaaagagtcgaaactgaaacaaatcagcgtgtgatacaaattaagttatgaaatagtaaaagcagtaacatattccccatgattaggacagaatcagtgtgcagctgaaattgaaacagaagataggaagtttgatgcaacagcttctcagctaacccattaaaccagcaaaagatcgaacaacccacaacagttacccccaagaacttgaaatgtccacagaaaactgcagaactagtgcacaaattgaaactgacgggtacatatgtagaggagaattcactacctataaggctaatttgccattttgcctgaatcattattaaagtgcacaaccagtatcaggcaacagtttggtaggattacatcgtgcatcattcaagattttttttaaaaaaaaatgacgaagggtatggagtgaacctctcgtggagcggcgtgacgggcgggcccttgttggcggtgatctcgtcgtcgctgacaacgccgacgatgagctcgtccccgagggcgtgcgcctggcgcagcgcgttgcagtggccgtagtgcatcatgtcgaagcagccatccatgtagacgcgcacgggacgtcggcgtccgcggcggaacctgcggcggagcgcgtcgacgggcggcagggcgggaatggcgacgggcccggcgaggtggagcgcgaccacggacgcccccagcacgatcccgccgatgacgcatgccgccaccagcttggcgctgctgctccccgcccccgcctccataatgaattgggagattgagcagtgcgagaaggagagagacaggaaggaagagggagattggtcgtgcgcgagagagcgtgggaggagggatctagggttagggattggggcgcgagggtggaggaggtatcgccattcgaggggagggcgcgacgcgaggagatcagggagatgcgggaggggagaagccgcctctggttctctctcttgtctctccgagctccgcgagagagatgagagatgaggggattcgctgccacgtgggaccgacgagtcaattagcggggcccacatggcggtgtgacgtggcatagcagaagaagttgccaggtttggcccacgcgtcggggagggagctgtttttatgtactctgtactaatccacgtaaggcgtcgaaaataaatacgacattagcatgaggatgagggtttatggattggttcagctaaccgtgttaaagaatgaacgtcaagaaattcaaccgatggacaacgatatgtgtagctaaatatacttgattgattatgacgttggatatgctcaatatatgctgcttcagttgcagccaggagccagcattagggcatagggcatgtacaacggtttttattagtggtctctttctattactatgcaagtaaatttgatgacatggaagaaagagaaaggaggagagaaaaatataattgttatgcatgacaacggttgagagtcgactcttagcatttattagagtaaattttgttgcatggtggttaaaaaaagaaaacaagagtaagaaaaaaaatattttgatacattaatggtagagaccatattgtctctaactgttgtataacgttagattctatatagtgtagagctcatatagtctctatctttgtacatgcccttagatgcgatgtgagcccccattccgtatgcaaagatatctcaagtggaggatctcaaaacctgaaaatgacactttttgtacgtctttggttctgttttctacctcaaacatgctacttaaagaatactactatttctttgcaaaaggaaaattgaacttgataaccaaagaatacaagtataattcagctcagtggctaaaaagttctctccctgagacaagtatgagtgagattaattccaacccaatggtcagagaccacatcaccatacggcaaactaactacgaaatcaatatctttggaagccggtccaatctgggaattttgtgtggttgttactaaaacccagcttcttcttcttcctccctcattcacaggcatagcgttttgttttctactcatttatggcgtcgcgcttgtatgccatgctacaaacacgaaacaccagcaaaatatcatgcgtgctggcaacagggtaacagcgaagaagaaacacagtgattagcataaaaggaagggctttttctacagcaaactgaatttacaacatgttaaaaaacgagtacactacacaaacaggatgtcagcaaaatacagacaattccgtccaaactgcggtcaaagcgccatctctgcttgaagtttggtcagttcagccaaatcattggctggttgagtagtcgtaactctcgctgaaggttccatacttgtcctctgaggtggttcaggcagatcattctcgagctcttcctcctctagatcttccagctctgcttctagctcatccttcatcagaataaataaataaacaaaaaccaagtcaagcatcttatgaaaattgacaccgtgcctgtttaaatgcatacatgtatttacatctccgtggaatggctattttgaattacataacttgatcttgcaccacttgttaactgacaccaaaggggaaaaggaaatatgagcagtacctcgtcaaaatcagcagaagcgccaattggtgttgcaagggcctcctgtatctgcctcatattctctgtgtgttcatttgcctcttcaatggcattttcaatgtcatcgatactcctgtggaacaatcgtcgttacttaccagtttatctaagtacatgttattttaaattaagtttcaacacattggctacatctaagctagaaagatatattatgtattcataaatggacattgttgctgaatttaactatgcatgctgtaagtttgaaaccatatttaagttcacattgtgcacacaagctcaagaagacactgctaggctagtaccttttcgcgtcatattactcaatttcagaaaccatgattggaaagaagagagcaaacacagacttacactgactggtgaatagctttgacagcagatgatccagagcgcaaagcatcaacagtatctgtggttgcctttgcactctcaagcattattatctagcataccaaaacagactacttcctgtcaattcatttcaaccttcgagaatatccaaatgcttcaaaattcaagattaatatgcgcacatatctttcatcacctgatcatgaacccgtaattggaagtttgctagctgctcaatctgtgtttcatacaacttctttttctttagacattgaattgcagctgcaacaaacaggaagttgtttgtcatttaactaagagaaaagtacattttattattttaagtccctgaactctatcaaagcctaaaattcgtccctaaacttcaaaactggacattattcatccctcaactctttaaaccttaattaacaaagtcatcacaagcttgagaaacatttttttcaacattaaggaaccataagttcataaccatatattcagggaatggtatatccacatatgcaagcatactaacccacaatttttctcccatcttatacgtgaggtatggattatgtgcaagacatgaacatgggagattggtatttgaccaaaacacaatggtcacatattgcacaaccaaacatatttgagaaaagttgtgaaattcttcaagtgttaatgcataatccaaaaaaaaaaaaacaaccttaggtacagcaaaattatcacaaaattgtaagacatgcgcagtatgtttcttgacaaacaaataagtttcttcgacgaaatgcctaccgcttttgttcttagcttttgtatagtccttagctctttcgacttctgcagaagcctttttctgaaggaaacactctttcttctccagcatttctagagtctacacatttatatcgtattaaaaataaacaactgcaaatggtaaaaataagatagcaaaataaacatcttcggcaatattcataactcagagcaacttaaatttatccagttaattacctagtatcagttcgtcaacatataagagaaatgtcaactttatttcagttaagtttattatgagaaatgacaactttcttcaacaatacagaacgtttattatgagaaatgttgctttctgacattaagtatgagacagaatacagtaatataagtcgcagaggctgcagctcagacaatacatcgacctaatttgaagtttatttttccttttcgatatatgattaccactccggtcatttttttgtgtgccaaaacatactttatatcaatgccatcagaagtgtcaggatcaaatactttcttttattatgtccttaaaacataaggttctgtcaaaaaattgactaggcaattcggctgaccaaacctcaaattcaactaagtaaaatcttctagaccaatggtaggaaatggtcaagataaacagatatctagttttgtccatgtcaaaaaataacttaacagtatttttatttcatactttcttctagaagcccattgggaacacgaaacattcacatttctgcattcaatataagatgaacaaggttgcttcataagattgtttccatatttacttgggtgatgcatagtaatgaggatctgcattacttccaagtggttaattcctaattctagagtctacacctttttattaacaaaaactaattagagatatctccaaattgtgcttcctatcttgttgacagttgcttaacacgatacccctatagcagatagatttcttctgaggaaacttaagtaaagaaagcagcaatgaaaactagcaataataagcaaaaggaaaagggataaacaacctcatgaagcctatccaaagtggggagggcagaggaggcagcctccttcttcttcttgctcttgggctttgatagcagtttcttcagcatcttcttgtaacactcacttgatcttcaatctcgggtgacgatagcctgtgtgggaataaagaggtgaatgatgaatgtatatagcctctccagtaggattgaagattaagagaggggaaggggaagcaaagggaaaggtggttggaagcagattccttgagaaaagtaggaaggaaaaggcagagatggccaaggaagatagagaagggcatgtctggttgtctacttatgaaaaagaaaggatgacaatatggtgaggtcactattttgagatacatgcttgactttttgtttatgacaacttatttttagaaataaatatatcttcagagacaaaaaaaatgaagttttgttcgtacaagcgtaaaacaacataattatagtgctcaacactgtaaaacctcgaatttacaactagtggagattttatgcatagtaaaagatgaactgaataaagttcatgtcaagaccttcagcaaggcccttcccaaaaaaaaaaaagatttgcttcctccggttcatattataagtagtttgactttttcgtagtacaatttctttaggtttgaccaactttataggaaaaattagcaacatttatagcaccaaactagtttcattaaatttagcattgaatatattttgataatatatttgttttgtattgaaaatgttagtatatttttctataaatatagtcaaacttaaagaaatttgactaagaaaaaagtcaacgacgtataatatgaaatagaggaagtaatagtaaaaggactgagacaattctgctgtaagtagtaaagtacaacggttttatttagaagacaaccaacactttgagcttatcagaaagtgtgtattaggtatgttggattaggtttgccttgcagcctagatattttggcatgatgttgcgttcacgattcaagtggttagttgttcgtactttacataggtaatcttgacaacagttgtgattttctgtggtctgcatcctacacaatactttataagtggttgacctgctgtttttccattgcatgcagtgatgattaaaacttgttaattgaactttttgccattttactaatgtgggtgaactgcagcttcctaaatttgccataaaactaaaagcaacataaagctgtattattaatccatttttttaaaaaaaactgaaggatctaacttctgcaagcaagtttttttttacaacttctagatgccccagctactccccctgttcatctgtttggctgcaaaattagctgagggacggctctcccaactcccaggtcccaccataagaagagaacagcaaacactgacgaatgtaaaaaaaaaaaaaaaccaaaaccaaaagggaggtagctcaagaataggcatgcaagatggaaatgcaaatctgaaacatccacatggtattcccagacctaggcagtatattaacgcgaggaatagaggggggaaaagaagcataccaaccttgaccttggctactggctggctaagtggctagcaccgcattgagtgacggagccgtacagccgcacaagcctgaggcctccgctgcgccgcccgcggaagaagaacaagtccggtccggatgcgctgttaacaacctcggcgagtcgccctagaccctagtgcactggctggctgcggctccgactcctcttgtctctgcggtggcctgagnnnnnnnnnnnnnnnnnnnnnnnnnnnnnnnnnnnnnnnnnnnnnnnnnnnnnnnnnnnnnn

SEQ ID NO: 7030 - DNA, 10518 bp, Oryza sativa
  unsure (1)..(10518): unsure at all n locations
nnnnnnnnnnnnnnnnnnnnnnnnnnnnnnnnnnnnnnnnnnnnnnnnnnnnnnnnnnnnnnaaactgatgattgagaaaattaatatactaatggctaaactcatataaattacaaagctagaaaagcaacatattaattgaaacaaatctagatcttactaattagtggccagtgctaacatcaatgtacatttgccataggagacagacaggagtagtgcagtacacatgagcagagcacccgagcagcggcggatggcggtatcagtcaatcaactgaatgtggccatagaggaatcaaatagacagaaacggaggagagttcctgcgtgagagtattatggcataatacccccacaatcctaaagatgagatagtattgcattcgtatcatgaattcatggtatgcttaaaaatgttgtgaacctgaaaatttctatacgtacggatgtgatatgcattggagacggaggcggtgacttggtgaggcggagagagggcctgcaggtcctgggcctgcggcgccgcggaggttgctgccttgcgccgttgagcaatcgcatgagaacctgctggtagctgcagacatcggcgaggtgcgctgctgctactcgttgtattctggcgccgtctcgaagtattcagcggcctcgtccgattttcgtgttctaggaatcgcaaacgctgccaatcgcgctcgtcatgcgccggccatcgcgcttgtgctgctctatcggccgcagggggggagggtcgggggtaggtgggggccccatggttttgggggcccagtgcaccgcactgctcgaaccccctcagggccgggcctgctctctccgtcctaaaaaaaagacaaaccctggtttccgtgtccaacgtttgaccgtccatcttatttgaaaaaattataaaaaaaattaaaaagataagtcacgcataaagtattaatcatgttttatcatctaacaacaatgaaaatactaattataaaaaaaattcatataagacagacagtcaaacattggcataaaaatttagggtttgattttttttggacggagggaacatgtatatacatactacaagtgtatcggccattcacgcccccaacagattgtcacctcaacctggcctatagtactagtactccagtcgtcctagcccctgactcgagaatttgtcggcagatacatccattgatcattgccaccatcatcatcacattatttatttcgaataatcgttattacaaaactgtcataaaaagttttaaaataataccgctagaactatcgttcaagttacatcgttacaaaattaaaaataccagtgataaatttacaaatgtccctatttattttaatccatcttcacctcctctgtttttttttaaaaaaaaatctctatctccctttattgaaaaagggcacggtcggttcaaaatagcaactcctgccaggggttgaggtcggtcaaggacggccttcgtaaaaaatctaccgcggaaatagatttattaatttcaagttctccatcatttatatatatcgagatcgccctatacagtggattaaaaaaatctatagagcttaagagaaacatactagggtcctgtttgagaagttttattctaactctgtgttcttaaagtacctaaaaaaaatctaggaataacctagtaaccagaaactgattaaccccagcttctctatgttttctccaacttcttttcataattttcagctccctctaagtaggattaagctcaaaaagagagagtggtgccacgtgcttgcccttatgccacatatcgatgagcgtgagcttacgagactacccaggatagccgagagctagatatggtgccccctatattattaactactccctctgtctcatattagaagggattttgagtttttacttaaattgtttgaccactcgtcttatttaaaaaattttagaattattatttatttttttatttactttattatccaaagtactttaagcataacttttcgttttttatatttgtacaatttttttgaataagacgagtggtcaaacaatgcaagcagaaattcaaaatcccttataatatgggatggagggaatagatgatatccccccacaaaaaaaaactaggtgatatcccacgctttgctatgggattcacggatgagtataagttaaatattgtcgaaataatgaaagttgaaatgttgagaaaataatgtgaggaagatgatttgacacatacttgttgatctctgtaatataatattatagatgatatgtcatgtttgcatggaatttaaaataggctagaatagtaattgcaagtgagtgaagatgtgacatgtttgcatgggattttaaatgggctagaatagtaattgctagtgggtgatgatgtggtatgcttgcatgctgagttttagttttagtgggtaccaactatatagaaattaagtatagattgtatttgtttttcttgtacaaacaattaaacatacaattcctgcggtattaaatgtgtttgagatctcataaacttatggatacttttatcatccttgagaaggtatcgggaggtaccatattttatagtgtaaaattttggtacctctagctacgtactaagtaccttgagtaccaaaatttgtaatgtaaaatcttggtacctctagatactttcttaagaactataaaatttctctaaatttattaggttttgtaaacctattctaaatataaaatggtaaccgagattatacttcaaagacttttaaaagtcaaacaacaaagtattaaacgttacaaattaaatgcatacatgtgtgtatgttaatggaatgagatttgcttcagtctagtaaaaagtaactcgaggtatcggtatctgacactactaaattattttcgatcgttggatttaactgaataggccgatgggcattgttagatctaacgatcggaaacgatttgttatcatgagatatcaatacctcgagttactttttattagatccaagcaaattagataatggaattactgtaatatgatatggccacgagaggattgattatatatgttgttgctggttaggcaggcagcagtagatggctagttaattcgccactgatctgatgtgagtcgcgtgccagcgacgcttggcgtatatgcatcgtgttccctttgtccgttgctagtccacaccaccttgatacgagctctcctctgctgctttccccttgtatacttgctttgcccactggaataatatcgatcgtcttgcgctctgtgtaacatagtacttgtacctgcctgccaccatgtgacactgcgtgcttcatgtctccacccgtgtaaactcttcctgccaagatcgatctagatagtcactacctccgttccatgttatttgttcttttatattatttgtctttttgagttttttttgtttgtcaatgtttgatcattcgtcttatttaaaaaattttgaaattattatttattttgtttgtcaattgctttattatcaaaattactttacatatgacttatcttttttttaatatttgcactaatttttcaaataaaacgaatggtcaaatgttgcaaataaaaagtcaaaaatgtcacctattatgggacggagggagtagtagctactcttgtgcatcatatattaattgatcagttggggattggacaattaattagtcttaaatatgacttttaggacaactacctttccaatgtataaatattataatatttaggaatttctcgtactaattgttactagtagctagcaatagctatatactaggtgaaaccctgcgcattgctgcgggaatttagtatgataataataaaaaaaaataacgtgtaagatagctagataacatcagattaagtaaattaatgtggtttacgataatttaaatttaaatagtatgtagaatggtgattcaaacataaaaagtaaggtggtataactttatggaagaagaaaagtagggatatagtttggaccatagattaatcatctaaagactaaaaacaattgatgtgatataacttaattagaggagaaaaggagaaagataatttgtacaatagattaatcatttaagcactaagtaaggatgaactatataagtatataatatctaaaacataataaagatatacattgaaacattatgtgaattatgttggatgttaatttaacatatttgtatttgaaaatctcttaaattataaaaaactataaagatatagcatgtttgcatgatgtttaaatgtgatgattgttagtggatgatgatgtgacatcttgttagtggatgatgatgtgtcatctttacatgttaagcttaaggagttagtgggggataattttatagtaagataggatatgtatcatccatggcattgtaaataatattagtgtctgtttgggttagtgccctcgtaaaattttagtagtgcatgttagtgtctgtttgggttagtgccctcgtaaaattttagtagtgcaaaatcttagatatgttatggcactactaaaattattattgacttggacaaaagttgaccacaatccaaatatgtaccgtgctatattaaagttatcaaatgattcgtaggactaaatttggtatccaaccaagctatttcgcagtacataccaactatcaagttaattagcaccagctactatgagaggcttgtaaacaacccgtctatttaaaaaaatatataatgcatagtaaaatgttcttaataagtctatatatgcgtgtgtatattaattaatcataaccattagattaagctctggggcctagaatccagcaacaaatatatatgtaccaacccatgcaattaagctaaccatataattaaccttgtaagccacctgctatataaggttcagaaatttgttgtgatattttttgggtaccagtgatttatactccccataaaatcgttttttcttttaaaaaacggaacacatgcatttgctgcttcttcttttcgatctggaacctgccgtcgatcgatcgatgaagcatcatatctcatgatatccagtcacgaatgtaaaggttgccacacctgactggttcctttcattcgcgtgtatagcaaagtacaagctggtgatgatgctggtctgattagtggaccgaccgacctggaatgaatatatacgacctctcagattttccttcaaaaagacaaacgtgtcgctctagtacttagagatgatattcttgagatgcatgctcctctcactgtctgattgttagcttatttcgaaactccttaattttcaagcttatattttttcgggggtggccaaacaactatttctaccagttatgctttcgaaacctcgggagcggcgtcggacggtggggacggtggtggggagctgtgggtggttgccaccagttgggtgggagcagcatgtcgaggacagaggaagggcggcggtgggaaagcggagacggttgcgagtggcggagagcggacgtggcagggagcgaagacggcagccttcggcggttgccgacatggactgggtaaggtgggaggacctccctgacaacgtcctcctcggtgtcaccgcccgcatcccctactgtgctaactgtgtccgcatcgggcggagccgcgcccccaccgccctccttctacagctggatcagcggttgtcaccgccatgatgtgcatgccgaccgtgtgctccccctctgccctcgcgccgttacgccgccgcctcctccccctcagctgtgtgcacagcgccgctcgctttgcctccgctccatccttgcgcgctcccccctcatggcatgtcgcggccacggcgctgcccacgttgtctacatggcggccgcagaggcaagctctctcctcccccacccgcggccactgccgtccccaccaccattgccgccactcctcaccgccattgccgctctagccaggtgaaaagaaaggccgggggagagaaaaagagataagagagaggggggaggaggaggaagaagggaaggagagaggataacatgtgggctctacatatcagtggttaccacaatattctttttgtgaatgataaataagtcttgcacgtatgtttttgattttaatgccacataagcgtcacatcaacgccacgtggaatgaagacctggtcaataccgctaagtaggtgccacgtcagtgaaaccgccttctaaaaccactaagggagttaaaatgcaccagttttaatagttgggggtcaagatattcggtatatacgaatcagattcagccattactgaagggagtaaaagtaaacttattcccagttaagcccagtgcgtatctgccactgttcctttttgttttgaactccaattttattgggtctgaaattagtaggcctatgcataccattattatacgcgcgaaatgtcattttcgtcatagtactttgcaaatatttttgaaaatgaaactgctcctgagtttcttctgatatttccaaacctccctgcatttgttctcatcctcaggccctctaaataacaaaatgttgcatcacaacgatgactgcttgattaacaacatgctagtgtatggttatttagctttatttttccaagaactatgtttaagctttgcactatgtataaattttataccataatatgcaattatccacaccatattatcagctattcctacatctatctcaacggtcaccaattctagaaagaaaaattctccgatgatcgatgatcatacacccggtcgtgcccatggcctacgcccactggctgtcctctccgccatcgccacgctgtcgccgccaaaatccaccgacattgctcccgctcccgctcccaccactgccgccggcctcccgtacgcctgcagcaccagcaccgacgccgtcgtctggaagtccttggacgccagcaggtcgccgatgggccccagctccggtgactcgctccactccgccatgcccgccgtcagccctgaccccccgggcaccttcccgacgacgaacaggtccttgttccccatggcctccacgctctgtatctcccccaccatctcgctcgcgttgaacacgccgcgctccctgtactccaccgtcgcgccgccgccctcgttcgccctctccaggaagtcgcgcaggcacccctcgtcggccttccgctctttcagcgcgtcgaactcgctcgccgtgaagcttcctcccttctggacgaaccggagcaatgtcaggtcgatggtcgggttcctcaccatccgcgtcgccagcgccgccacctcccggtcgtcgctcccgccgaagaagagagccaccacgcggtacccgccacccggcaccgccgcgaggccacggtccacgaggatgcccaccgtgcacggcgagaagctctgcacgctgcagttgagcggctgtatcgccgggtgggacacctccaggccgccgtccaccgaccggtacttgtggaacgggagcaggatgagcgccgagtgctggttctccgcggcggaggtgatgtcctcgtgcatggaggcgtacggcgagacggcggccatggtgcgcgccgacacgcccaccgactgctcctcgtacgccatgaaggcgtgggagatgtgcttgaactgcatctccgtgtggctgcgcccgtggacggaggcgtcgtaggaggacgacgatggcgccgaggcgttgatgaggaggagcgcggggaggagcggcccacgaactcgatgaggtggagggcgaggacgcccacgggcgatcggctcgacggcgtcaccacgtcgaggagcgtcagtagcgcgggcacgtcgcgcggcacgtggacgcaggccagcacgcggagctccgattccgggtgagcccacgccaccgtgcgccgcttgtagaacacgagccgccgcgccggcttcaccaccatgcccaggaaagggctcaccatcgccgtgatcagcgctgacacgaacaccagcaccgtgaacgactggtcactcataatctacacaacacaagaagctacctacccttaattaatcacgacatgcaatgcactacatggcgatcgattaattaaaatggattacccctttgttccttgcaatgttgaggatgacgagctcgatgatccccttggtgttgagcaacagcccgatggacgtgccgtcaccgagcggcatgccgaacacaccggcgacgccgattgcggcgacgaccttcaagaccgcagcgaccatggcagcgaccatgagcaacacggcagaatgcatgttggtgatcttggcggtgtcggtgcggaggccgctgagggcgaagaagagcgggagcagagcgcccaccacgaagtcctccaccttcttcaccagcgccaccccgaccggcccgttgggcaccgcgagcccgaacacgaaggcgccgaatatggcgtgcgtgccccccgcgtccgccaccagcgccgccaccatgacgccgatcagaatccagcactcgcggtcctcgccgaccgcctccccctcggcggcgcgcctcgccagccgcaggagcatggggcggagcaggaggtagctggcgccgaagatgacgacgcccgacgtgagcgtccacgtggtctgcgtgatggtgcagcgcgagtggccgagcaccgtggcgacggtgaggccggtccaggcgaaggtgtcgttgatgagtgacgcagagagcgtgagctggccgacgtcggtgccggcaagcttcagctcggcgatgttgcgggcgaggacggcgaaggcggtggaggagaaggtggagccgaggaagatggggaaggagagcttgttgaggaacgtgtcacccttgtgtttgtcgtcagtgctgagcgcgacgtagccggtgagagcgccgacgaggaagggcgggagcgtgcagccaatggcgaagccgaagctacggatgccggcgcgggtgatggcggagacctcgatctcgacgccgacgatgaaggtgtagtagacgaggccgagaagggccatggactcaaggacgaagaggctacggacggggaagacgaggttggagaagtgagggaggtggccaaggacggaggggccaaggaggaagccggcgaggatctgggagatgtaggtggggagacggagaggagagaggaggagggtggcggcgcgggtggtggaggtgatgaggaggatctggaagaggaggagaggtatggagaagtcgagcggattgtcgcccgtccagacgccacccatggtgatcttgctcgggtagaagcacatcaggtgcgtcttgtccatcgacatcgtgtggttccatagctcctccagtgggtccgtcactgtatgcgctgccattgatgaattccttgtttggtatcaactccggcaatgggtggcgttcttaggtaaggtgaggtgaggggaggaggagtgataagatacatcgtcgatctctcatttgatgggagggaagggaaagaggagtgtgctatttttggatttttgcatgcagaggtttagatgggttgcatgcctatcaaaggacaacaatgggaggtaaaaggcaccactaaaaatcaaagtgtttatgtggttgcttttaaaaaaataatcttaacgaaagataacctcacatagagaaaatggaggggaatcttttactccaatatctttttttttactaccacgttgcatattttgcttggcgatgtgtcttctttgtcttcaatatccccctcctcacaatgcaaaatatattttggtgattggctggggagtgcctaggcccctccaaaaaagattttatttggagctagtgtgctatattggtcaatctggtgtttccgtaatgatatagtttttaaccataagaaattgtttaacattatgcatgttatctttatgtgttttaattggttccacacttggtgtatgatgttttcacatgaacaatagaatactatgtgcattggtgctatacacttggaattggtagccaatgagcttttattctagtttggatggcgtagtacctaattttgtgctagaatctatgtgattttgaaaaacgttatttcatttgcgtcgaggaggaagggcgggagcgtgcagctgatagtgaagccaaagttgaagctgcggatgccgacgtggatgatggtggggacctcgatcttgaagccgacgatgaaggtgtagtacacgaggtcgagaaaggccatgactcgaggatgaagaggttgcggatggggaagacaaggttggacaagtgagggaggtggccgaggactgagtcggcaaggatctggaagatgtaggtggggaggcggagaggggagaaaaggagggtggtggtgcgggtggtgtaggtgatgaggagcatttggaagaggaggagagagggatggagaagtcgagtggatttctactgtgcaggggtccttttgcagg

SEQ ID NO: 7031 - DNA, 704 bp, Oryza sativa
  unsure (1)..(704): unsure at all n locations
nnnnnnnnnnnnnnnnnnnnnnnnnnnnnnnnnnnnnnnnnnnnnnnnnnnnnnnnnnnnnnntgatccagggattggtacggataaacacagaagatttccgattttcaaaatcgggggtctacaggaggatagaggctgacatgtgggtccacggtttttattatttttccaggatcgaatgccatgtaagtgccacgtcaatgtcacgtgggacaaagacctagttaaaggagccacatatgcgccacgtcagcccaaactgcctggggatctcgtttgcaccggttttgacagttcagggacctggttgtatctgatttttgggttgaagaacgaaaaatcggattcggtgtaaagttaagggacctcaaatgaacttatttccaacaaatggtgagggtgtgggattgcagaagtagaagtaggaagatccatccgggtatggtctagtgggctggacttgtccgagtcagattacatccgagttagaggattccaaaaattaagcccagcccagaggtggtgatagagtcgagtcgaaccaacccaaagaaagaagaagaagcaaagccccaaaatcgctagcaatggagatggagttagatggggagagtacatgcgctgctccatgcgagaagaagcggctgattaattccaagctatttcgagtggggtacggtctcagcgacgaaaaagatgaa

SEQ ID NO: 7032 - DNA, 438 bp, Oryza sativa
  unsure (1)..(438): unsure at all n locations
tctctctctcttagtatctctctatcctctttctccccctgcttgtggccggctggcagagcatgggcgagcggtggctggagcgggctatgggcggggcggatcgggcagggtagggcgagcggcggccggagagggatgaggcgaggaggacagtgtgtggggttagggaagggagggaggaggcggggcgtccgcaacggccggcgccacccacagcgtcacgtcaggtcctttccacagcgcgtgcacctccagcgcccaggcccgcgccgcggtgttctctccctatcccctttctctctcctgcaagaagagggccagagcaggcaaaggctagggcgggcggcaggcggagcacaggcgagaggcaaggcgnnnnnnnnnnnnnnnnnnnnnnnnnnnnnnnnnnnnnnnnnnnnnnnnnnnnnnnnnnnn

SEQ ID NO: 7033 - DNA, 3692 bp, Oryza sativa
tttcctgcgatggattgaagatgttcaacaaccacttcctgactatcatcatcattccccaaactatagctagcaaaccccttttttgcaacttcaaggttgcattgcactgcactgcacaagccaaagggggtagagaggtcagtgtctttccaagctgacctcgtgccagtagctccccacactagcacaagagaacaagagacaacaggtccctctgctggtagaaaaggactagtccttctccttgggggcaatggcaatgctgggccctggggacaagaaaagattgggccctttgcttgctcgcttggacccttgaagccttggaggagagagaacatgagaaagagggaagcttttgtagtagtagcagtagaagaaagaagccaatgccatgcatcaccccatcatggcaagcaggcaaaggtggtctaaaggcattgttgggaaacaaatttaaaagcctgccttctctccccactctgcctgaccccaatcccaacccctctctcactccacaacaccataatgagtgtaaagtagtgtaagtataaagaagcaagtgattcatttgagggtaattgcatcatcaggtggatctattttccaacccttgaatgaaagtgatgttcaagattgccacattggcacataaccaactttggaaatgtgactaggaagctaaatcagttactactacttttaatagtgaaatatggcattggttggttggaaatgcaggtgcccagtgccaaaaactgccactctttagcaaagtaaacaaagtatcaatgtgtagtaatctggcagtgaataaacaacaatcattcagacatactactattttgcataaagctggtaggccaataagatgcagacaaatggtagacaacgccagcattagaaggaagggaaaaaaaacatgtgaaactaggaatgttaccaactcaaggcaaatcccaaccaaaacattcgtgatgatattgtaatgaagaatatgcaagacaacgacatccaggtaaacaatgcccaagaagcctgtttggcttaggttagctaggaacaaaaaataaatagcaaaactagtggagtgggatttcttgatggggatagtcaaataagaaaatcaccagaatctcaatcgtgtaacgtaacctttgtgataaagaaacatggaaccaagctgatcatacaaaaaggttatactggccgaagtgtccaggaagcaagacttttaacaagctaaataaccatcacggacggaaaggtgaaaatgatgttaaaaagtaaaaccatgtatatccagtagatgccggatacaggaataagtgaattccataataagattattgtaatgcaaaaatgttagaaaagtgatacaccaatgtctaaatgagcagtgtaggtcagtggtttcaaatatttcagaagaaaagaattagcaggatttagatggcatgaactaaaaccactaacatcctgactttctagtacacaactactgtgctacccatcattagttcattgctgatgatttggcattcagaaggagcacccatcaatgatcaccgaataataagaactcctgtgccacccaacaatctaattgaactcactaaccaccagatatgatcattttgtgatcatatgaatttcatgtcagtaaggatccttttgcgtgttcccccaaaacaatgtcagcaaggattaagcactacaaaattgcaaaataaactaaattggacagaatggttaactggagcatgaacagaataaaagctaaagctaagttgcacattagtaactaccactgtgtggagatctgaaaattagtgatcagaatttttttttatttttcttttctcagaattgaccaaattgagcagctaaaagaagcaaaaggactaggtaattgcacctaagtaagatcaagtgatacttcagctctataaattccccctcaatactaacgtcccgaagcctgaattgggcgccaagcagaggcagtgagaaggcacagatccttccatccgagcttcagagcgccattctcctcaataagcgtgtatccatcggaagggaacatcccaagcagcagtgcagcctgagcagcagcgcttccagcaagcgacgacacacggaagcccgactgcgcaagcttttcgcgccagctcccaaacttaacatcgccggtgcgtgctggaccgcccacggctagcacattgcggatctcccgcgacaagagttgttgctccacgacatgccgctccgggctatcctcgctgtaactcgcatcaagcgagtcgaacagtgccgaatagtagtggatggcctccacaaaacgtgccaggaaggagcctgagtggctcagatcctgctccaccattgttacaacctttggcgccaacctgatttgtgtggtccacagagtcaagatcagtacacaaattaattatgattctgttcgacaagaatgactcaactagcaacatttagaactataaatgataacaataagttctcaaggacacctaaattggttgccttgccttcatggtttttgcaagtacagtgggacatatctattgcagtccactactatgtgatctctagtatgaactgtgtatagattgcagccatttcaatttaataatcaacattggtggcacttagaactagaaagctgagaccttttggcatgaaaagttggtcatgatgataagaacttttagctcgttcatagtgatccacaaaccaaatggaggagaaatctttcccacttctcggatcaccaaagaccatggagaagcttgataccacagaaccactagaaagttgcaacctttctaagcctaaaaagttggccataatgacatacttttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttagggctccaaaacgcaaatctttttttactcctccttaatcatcctatggtgatctagggctagtactactaaccactgatatgatgatgcatagatagagtatactactaggtcacaatgtcaatgagaagtatagggtgtaaagtagccatgattccggggggtcccgagttgacaagggaagagagaagaaaagtgtagtacctctggatgagccagagcgtgttggagtcggagccggtgacatcgtagagggagtggcgcagccagtggacggcgacggcctcgcggcgcgtgacgcccagcttctccgggtccagattcccggccttgtcagccaccgggcagaactcgaacggcaatcccagcgtgt

SEQ ID NO: 7034 - DNA, 1306 bp, Oryza sativa
  unsure (1)..(1306): unsure at all n locations
cgtgctgggcgggccaccctcacccgccgccacctgnttcggcgccgncggcgcgggcgcggcnaggtccatgtccgtgtggtggaacgccggaagctgcgtggcaagcgcgggaagctgcgcgctggcagacaacgtcggcgcgcccgccgcggcggccgtgacatcggacaggtcgccggtgacatgncggcgcggcggtggcaggtccatgtcggaggcggggcgcttgcggaccatggcggcggcgaggtggtgttgttcttggtggtctaggtagaggaggagatggtggtcggaggggagaggaggcagcaaggaggtgatggcatgagaggaggaggagggagaataagaggagtgggtggcggaggaggaagaggaggggaagaggaggagggaggaggagcccatctacaaacgccaaggggaagaggccgtgggcatggcgagcggacgggcgtgcgcgggaggcctaacgcttgtgttgggtggaatttttatggaatttggcgcggcgcaagcgaggcgatggcgcgaagggggagtaaagaggaagaggccgagaggaggagaccaagaaggagaggttagcaggagcatatcacgagcattgagggggtaatttatgggggaagagaggcaacgcaacggcaagctgtctactggactggactgctaccagcgtgtcatttgcccttgggctccgtgtatcctttctttttcgttttctttttcacctttcccatggtagattactcgtaccgatgtttgtccctgttgtaatgttcacacttagcatgtaataatgcctttgtcaatatcatgtgtactgtctacaagtttcacactacagttaaaaactgaaaactttgtaaagcagacctccaaaaatcaagagtaaatttcacaaaactacagatactttgatcaaactatcacaaaactacagatttaagaatgtatttcacaaaactacagatttagagttaaatttatcatggaactacagatttaaggtattatatcacaaaactattgatttaacaactattttattacaaaactacacatttaaaaactattttatcacaaaactacaaattttataactttaaataaataatagtgctatgatctaaactctagaatatgtagttctttgataacttaatcactaaatctgtagttttatgatatggtgcattaaatctgtagttccgtgaaaaagttaacgctaaatctgtagttttgtgatacacattcttaaatatgtagttttgtgataatttgacacaagtatctg

SEQ ID NO: 7035 - DNA, 684 bp, Oryza sativa
  unsure (1)..(684): unsure at all n locations
ctttcccacttctgggatcacaaaagaccatgaagaagtttgataccacagaaccactagaaagttgcaccctttttaagcctaaaaagttggccataatgacatacttttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttagggctccaaaacgcaaatctttttttactcctccttaatcatcctatggtgatctagggctagtactactaannnnnnnnnnnnnnnnnnnnnnnnnnnnnnnnnnnnnnnnnnnnnnnnnnnnnnnnnnnnnnnnnnn

SEQ ID NO: 7036 - DNA, 553 bp, Oryza sativa
  unsure (1)..(553): unsure at all n locations
tgttcatgtcttgcacataatccatacctcacgtataagatgggagaaaaattgtgggttagtatgcttgcatatgtggatataccattccctgaatatatggttatgaacttatggttccttaatgttgaaaaaaatgtttctcaagcttgtgatgactttgttaattaaggtttaaagagttgagggatgaataatgtccagttttgaagtttagggacgaattttaggctttgatagagttcagggacttaaaataataaaatgtacttttctcttagttaaatgacaaacaacttcctgtttgttgcagctgcaattcaatgtctaaagaaaaagaagttgtatgaaacacagattgagcagctagcaaacttccaattacgggttcatgatcaggtgatgaaagatatgtgcgcatattaatcttgaattttgaannnnnnnnnnnnnnnnnnnngttgaaatgaattgacaggaagtagtctgttttggtatgctagataataatgcttgagagtgcaaaggcaaccacagatactgttgatgcttt

SEQ ID NO: 7037 - DNA, 1272 bp, Oryza sativa
  unsure (1)..(1272): unsure at all n locations
nnnnnnnnnnnnnnnnnnnnnnnnnnnnnnnnnnnnnnnnnnnnnnnnnnnnnnnnnnnnntgatttggttactaacaatttggtatcaaacctcaaacacaccaggtcacaaatcaaacaatggatgaaggatcaccggaaacacggttatctcgatgaaaattgtaaattcacaattgatctactggacattctcgaagaattcaggcctttatctcaaggtgagcaatgtttaagaaatctagtgcagaataaactggcacagttggttcagagcagactctcatattggaagcagagggggaaagtcagaagaataaagttgggtctggataactctgcgttctttaaggctcatgcatcaaaaaatttcaggaaatcaaggattaaatcaatcaagcacaacggtacagaggtggcggatcacaatggcaaagcgcgcctaatgcactcctactaccaaaatcttttggggggtgagtctcagccggtgtgggatgttgatctttcagcgctctacttgtcggaggaatgcgactctaacatgctggctactcaaggtttgccgattacacaagaggaggtgctgctagctatcaagggcatgaattcttacagtgcccctggaccagacggttttggtcctagcttctatatatcaggcggcttggaacgacatcagggaggctatcctaaatctagcatcaggcttctcncagggcgctattcaactggaaagaattaacagagccttcattgttcttatccaaaagccaggtaaagaaaacacagtggatgggtacaggccgatctctttacagaattgctctgtcaaaattctatcaaaggtgctggcttttaggttacaaattgctttgacaaaaatgattcacatggatcaaactggctttctaaaaggtcggtgcatttttgaaaatctaatctttgcgacagaactgattcaagcttgccacaagcgaggatgccaaactttaatcatcaagctcgactttgcaaaggctttcgattcagtaaattgggaaagcctgctaaaaatactagcggtcagaggtttcccggacaattggatcgggtggattaacaagttgctcacctcctcaaaatctttggttctaattaatggaatcccagggagttggattaattgtcgaaggggccttcgtcaaggagaccctctttctccatacctttttatcttggtagcagatgtgctccagcgactgcttgaaagaaatgcaagcttaagacat

SEQ ID NO: 7038 - DNA, 605 bp, Oryza sativa
ttctttggatagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgctcgaggcatcgaggccaaccccgagaagatacgagctatagagcggatgcgccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagttctcccccagttctggtcgccccggagccaaatgaacccttgctactctacttagcggcgaccccgcaagtggttagtgcggcgttggttgtggagcgcgatgaggacaattctcattccgcgcacccccaccctgtgctggcttggccccggagagagcaggaggagaggccccc

SEQ ID NO: 7039 - DNA, 662 bp, Oryza sativa
atttcgatttcattggagagaaagagacatacaacgtccaaagcaaagcaaaaaggagaaacaaacaaaagcaaaaaagaagaaactagagagagagagagagagagagagagagttgtggaatccaaccaaccaatatgcgccgctcctcttcactctccaagcagagcacaagaacgcgctttgctcaataacacactcccctagctccccgaggatgcctgcccctgcctagcttaatgtggaactaactaggagtattaattaattccttccactaatcacccatcagcgccaaccggcggccacggccaccgtccgctccgacgacgacgacaagttgccactgctcactgctcactgctctggaaggtggtgaagcaggtgtcgctcggcttcactatgaagggccaccaccaccaccattccttgccgccgtcgccgccgcccaagcgccggtgtaccgccctggccgcggccgtccctgcgctcgtcgtctgctccatcctcctgcccctcgtcttcctcctgggtctccaccgccccggtacgcgcgcctgcctcctcgcctcggatctgttctgtaccttacctacatgctgctcacctcacctcctgcttgtcttttttttcttaactgtcagcagggcatggatcggagg

SEQ ID NO: 7040 - DNA, 708 bp, Oryza sativa
agggtgatttataaattcaattttaggattaggaggagaacttcagggtgtgacaccgcggagctcgccccctctcctgccggccgcccctacgagctcgcctcatccctcgcgccgctcccatcggccgccctctcaccggcgcggcgcgcaccgccgcccttcttcctcccacccgtcggccggctcgatgagctcgtctcatccctcgcgccgctcccatgggccgccctctcgccagcgcggcgcgcgccgccacccttcttcttcccactcgtcggccggctcgacgagctcgccccctccctctcggcgctcgcgtcggcctccctctccgccggcgcggcgctcgcgtcagtcgccctcttcgccgggacggcgctcccgccggccgcctctcggctcaccgacgtgatcacgaggagggaggctccgccgccgctcccgcggcatcagccgccaaggccgcgagggagagggatggaggcggtggggagttcccatgcgcatcggcggcggcggtgctgggggcgtcctcttggtggtgcgcgttgtggcgacgatagggaagatgggagtgagccgagaggagagatgggatgacatgtggggcccacgtgtgacccaccatatttattttgctgggtagctgacatgtggacccacatgggtcccaccatttttaaataaatttttgggcagctgaca

SEQ ID NO: 7041 - DNA, 1157 bp, Oryza sativa
agatcatcctgaaaaaaacaaacagtgaactcatgactcacacagctcatatactattgttcaaacacaatagatcacaatgcgagttcagaattaatattcgggacactggacgagttcagaattaaattgatgtcctacggatggtcaatgatcagatcagtgctttcagccttcagctcaggaaagacataccataaaaaccctgaacgtgggatagcgggtagccgcgtcctacggacgccggcggcggcggcaatgccctccctgacaatttgacagcgccctacagcggggaacaccgatctcaacgccatcgtcggcaggagaaaactccgcagcggcccgattccagcaagggcacacgtcgacgaaggccgcggcagcagcaggccttgccaccgctgccgaacgggtccggcccgaggagaaattgcgtgtggccggcctacctcctactgggccagttgtggaggaattttcgtcccgtctagacgggccatttgttttgaaggctagtaatgggccaaattggacaggaggtcctgaaatcaggaattcagaagagctctccactctttccctcgtcatgaaaaggaataagttcactttgggtccctctatttgtcgaccagtccgattttcatcccttgactgcaaaaccgggtatgacccgtccccaacttacgaaaaccgggcacataaggtcctaaggcggtttagatagtggttttggctgacgtggcgcctacatggcagatttgactaggtctccatcccacgtgacattgacgtggcgcttacgtggcaattatatctcagaaaaataataaaaagcgtggcctcacatgtcagctgcacaaaaaaataatttaaaaatggtgggacccatgtgggtccacatgtcagctacacagcaaaataaatatggtgggtcacacgtgggccccacatgtcatcccatctatgctctcggctcactcccatcttccctatcggaaccacaacgcgcaccaacaagaggacgcccccagcaccgtcgccgccgatgcgcatgggaactccccaccggcttcatccctattcctcgcgggcttggcagttgatgccgcgggagcggcggcggagccttcctcctcgtgatcacgtccgtgagc

SEQ ID NO: 7042 - DNA, 6369 bp, Oryza sativa
actagattgtaccatctggtcctagattgttatatgatagaatgaagagaatatattcttgtgacggatcctgagctactcttaatttcttaactaaacgattatacacataatttgttgtactatgaaatgtatcatccaattttatattgctatattatgggacaaagggagtatattcttgactaaactaatacaagtactatttgctagaacaatgctatacgtacgacgtgtttgtccgaccaacgtacgatcaaacggtaaaacaactccatacatggctgagtaaggtgacaacatggcttagtccaacagagattaacgtcatgaactcaggacattaagttcgttccaaagtcgaacaagtttagtcgtatatatagcattttcctacatactattgttccacccttatctagagccttgaagaacatattcaatccaatggtgagttagttgccacagttatcatccaatggtttgttttaatctaatgacgtggcatgcctaatctctttttagcaaaatatccaacggtgagtagactagaaaatcggcgtgccaaggcatgcctgttattgtataacttgcagcttatgttgtttagtaatgcttattccgtttaatgacttctataattttgtgtttgcataaggttggtgaaaaaaaaagttggtaaagctttatgttttgatgcggattgtttaatatcagaatgaaggtgcttgatattaccagtcaaaaaggcaattaccatactatattccctcagtaaccatctcgacgtgttacctatttatgctactccttatttaatatatgggcgtgtgttcatgaaaaaaaaggtgtgcgtttgtttacttgcactagtgcagaattgatcttttaccgtgatacccaaaacacaaatatcttggttagatttagaactggtactgaagatatttttaattccggttctaaaattccaagtctcaaaaacatctttagtttcggttagtgttactaaccagtactaaaaatatatctttagcatcggttggtgacaccaaccgtgtaagcgtcaggaggtgagcccatggcctgacgcgtacacgtgtcaagaaaattacggggcataggtggaccaatcaaactctagcacaacggctagcttgagaaggttagattccgctccatgatagacaaatgagctagttgagtggtggcctattttaattaggaaaaagtccaaataaccccctaaactttgggtggaagtccgtctagcaccctgaactttgaaactggacattcaaccccctaaactttacaataccgtttatataaccctctaagttgattttgcatagtggtttttactaatttgtatataagttggatgagtttgatcacatgtcatacactttggacatatatatatattaaagttttgacttaaatatttctttttgctccttattagctctcactcacaaataagtaccaacgtaataatagcatgttatcattgtataagaatagattgatgatttataactgatcatatgcaaatatattatattagttattcaaaattattcgtttaaacttccaaaatatgcaaaaccatcttttaaaaccaccttagggggtaacatggatggtatggtaaagttcatggggttggatgtccggttttaaagttcaggacgctagacggacttccatctaaagtttagggatgtatttggactttttccttttaattacttggatcctgcgactctcctgcaaacttacaaagagatatataagggggaaatttcataggacataaaagaacactaaaattcaacatcaaaggaattgaaaaaaaaataaatttattgacagaactaaaagatgacaaaatttaatgacaaaccataggagaaagatatacccaaaaccacaagtgttactcccctactaacatcaactgagctcacggagctgagcacaacatcgccctaacatgagtacgcgacaattgagctcagttgcccgcaaatggcccttgctttacgctaggcgtgcccatgggtgtacctatgggccatagcacggcggcacgaaccgctgacgaacaagctagggttgagcggtccgccgtatcctaggtgtttgtctgtttgagcctttgacatgtaaactatacgaactataacgcagttgtaataacactagtgagttctgtataatggttgattatctttaagtcagttcgaggcgtatatttttttatgagaatagctttattatcatctaaaaaatagcaaaatcatgtttttttacacgttttagttatttgagaggatatggcccaaatcgcaccagccaaagtgcaacccacactgggcgtatgacccagtggagcacccacctaggagtgggtgtttggtttccttgggtgtttcggtttggtttcttcagtgttctactagatcgatttgcaacaaatccaaaccgaagtgttcaccaaaagaaaaaaaaaccgcgccaagacagccgaacttctttggttctgttggtcggttttccgatcaagccgaggaaactcatctggcatgttgcgactctgtagcctgcgagcaacgtgccagtagttaaatgggctggataggttacaggcgataggaattggtgagaggtgatggaattaatgggcttttccactagcgaaagggcatggactgggatcgtacataattgattagttatgcgggttcctcggtttccagagatgagaaaccaaggggaaagccaaagaccgaacatagggagaaataaaaccaaataaaaaacggaataccaaaaaaagacacttcggcttggtttggtgtggtcggttcggcttttgattttcgatgattttatgcccacccctacgtgcaccggacatgcgcatgtacacgtcaggaggtgaggccacagctagagagcgacacgcactggtggagaaaccctttgtagtcccggttcgtaacccccctttagtcccggtttctaaaccgggagtaccaatccgggactaaagatcgctatctttagtcctgggtgaaataaccgggactaaagatagagctgacctttttttttttttgcatgcccctgttgctgcatggtttatatatatatatatatatatatataaaccatgcatatatatgtttcaatacatatatatgcatacatatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaagaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgtgacgtttactttccgagggtcgatgaatccagtatcgaaaaccctccgccgtcgggccctttgaatctcaattctacaacgataaaagggagtatattattttctatggtctacttatatacgaggacctaattaattaaaggagacgtatagtaagaaatctaactgaacgatatacttacaaaatccagcaactcataatagagacgtcgagggcgtccagctggtatagttcgttgattcccctgaaattgatccagagaatgtcatctccttgcaagaagtccgtgtccctgatcctcgctccgatcatctctctaccagtggcgctcatctccatgtacagctgatggaacttgtacatttgtgtgggtagggactgtagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctacgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcctccactgcatctgttagtcgtcgcgcagcctcttgtatctgatagccgaagaccagtgagccatcagctgggttgagcgttccaccatgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttg

SEQ ID NO: 7043 - DNA, 1152 bp, Oryza sativa
tccaccttttcactttgtcctctgtacccccacaaagggtgaatgtctcgagcattgtagtccacagcatttctttctccgaatcttggacaaagctctcatgatctccgcgtgcccttgttcttcgccagtacaccgtactgacaggcacgttatcccgcacaacccaaccgctgtgacgtacatagttcttggcggcttcggccggggcactaagacgtccatcttcttccacttccgttatgatgtgccgaccctcaagcttcttcgctgcacctcgttgcccgcgtgccctcttctatccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtc

SEQ ID NO: 7044 - DNA, 2435 bp, Oryza sativa
aattctttttaaacccggtaagggttaagaaccgggactaaagattatagcactgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatttatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattggcacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaatttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcactgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatagacccagacagtcccctcgccaggaaggcaagttgttggttgatcgactcgtaacccatgagatgttgtcgtagccacgcgggaaaagtatcaatgtgatgccgtgtaatccatgcatcggacttaccgatgttcttggcgcgaactagagccaagtgctccccgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttatgaacttcttctccttcgtgcttattattcgcttgatattcgtggagtatccagacggtacctttatgctctccaagcattcaaacatactttccttctttgccttgctaagagtgtagctggctggactcaagtaatggcttcctttctcctttggttccgggtgaa

SEQ ID NO: 7045 - DNA, 1036 bp, Oryza sativa
  unsure (1)..(1036): unsure at all n locations
nnnnnnnnnnnnnnnnnnnnnnnnnnnnnnnnnnnnnnnnnnnnnnnnnnntgagcaaagtccggaatattgtcgtcttccacttcatcttcttccatttcaacaccttgctctccgggggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccgatcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatatataggggtgggactttagtcccggttggtagcaccaaccggggctaaagatcaccgggatcattagtcccggttggtattaccaaccgggactaaagttaagatctttagtctcggttggtagcaccaaccggggctaaagatcaccgggatcttta

SEQ ID NO: 7046 - DNA, 4667 bp, Oryza sativa
cgtgttcgtgttcgtgttcgtgtcgtgtgtgcgcgccttgtcgcgagcgttcgtgggaaaaccggaagaggagcgctcgtgggcagaggcgaaactttgccgcgcgccacgtttgcttcgactgcggatgcccgctgtacggctgcagccgccgggcccttacgccgctagtggcctgtgtcagggtcattgtcattctcgtcatcaagccttcacatttatttctacacttttactcatcgctgtacttccagtaatgttgaacccagtagttgtctttttaagagtttaagtctgcattggtttagggcctaccgaacaacattggtttagtggggttaatttcggtaaacgaaagctttgtaaccgcctaaccggccaaaggattcatgtagtagtaagattttatcgaaacgaaccctgcatcttcacgaaccttaatgacacctgatggccacccctacggtctctcggcccatgcacaagacacgaatcgtgtaaggtgaccgatcgacccctcttatttatagcaattgtcatctcgctcctgttcgtcagcgtgtgtagccactagaaacgaatatatgatagacagtggccttcaacagttcaaacgtccaggctgctcacagcacccatcagaaatgtgctgctagatctgccagcaggttttgtttggttccgggcaacaccctgggccaccatctacagttacgtggtctactactactaccttcattttgtacctacagtgacctttctctctaagctaggcctggattgtcgtgcctccctacacccatgatgcatacgactgtatacacctaaagcaacagtactaggctccatgcacgttagaaaacggatcactgctgaaacatgtgcgtaaaatattctagtatatatatatatatatataaaaagctactccctccgtttataatataaatatttttaggtttaatgagagagaataattgtttttttccatgtcacttcatcgatcaaattttgaattatttggattttccttcatatacacttgattggctggaaatgtttgaattctcgtgcattaaaatcagtgttctagaaattaatatttatactatgtaacaatttgaatcataaaagttattaatattttaaaacagagagaaattgaggttctaatgttgaactagaaggaataagtgtgcatgctgccctgagagagagagaaaaaaaaagaataagtgtgctagtactataccgcaatacgtactaggattttctaattacttttaaactttttaatttttttaaatatcaactttttgacatgacattttgccatgccacgagacaagtggcacattggcatagcagtattgtcatgttatggcaaggattttaaccatgccagttactatgacacccacactcatagcgtggtagtgttataatgtcacgttatgtgtggtggatggaaggtatggctttaaagttgagattaactaagtttttagagtctttattttaaaattttttaaaaagcttaaaataataaattaaaattctatgtactaccaccactttttagctaaccagtaatcgtgcacgtgcaatgcatgttatgcaatatatatgatagaaaatgtataatacatcaaaaatctgaaaacatatgtagggtaaatttgtaacatatacatattgaagctgttagtctatttgagacaataaaaaaaatgtagacatcatccattacatggcacgctacaggtgtacagcatcaacctagcttgctcaatgaggtgccatgtcactttctcgggtctcttctgacctcctgcccttcgtcctcctcacataatcacatagatctatcagcttgtcaccaactgatataccaaattattattatagtcatatgatagctttagctttttcagagtttctatccttgacaagcaaccaaagataattgttaagttaaatatgtgtacagtggagtatgtgtaattcatataaattttgctttaaaaaaagaacgatgtagtttaaacctttccatcgatgaaactcaaaatgcgaagacccagaaatcaaccctttgaggatgccatagagcagtttgttagcatttcacttgcattgcatcaattaggtgttggttgtttagatatcacttgctttgtattgaatctgcaagcagaacacatgcttgagcttgttgcttggaggacatacatgtcgtcggtttcacagagcaaggaaaaaaaatctgttaccatgtgagtgtctagttacctgaaccataaaatggacagtccatatatagcttcatgagcgatgtcccagaaggtggcaatgtcacaacatcatctctgtacaatagatataatcatcacatatcagtgattgcagctgttgccccccaaatccataattaattttgaacataaacggggcctgatagagtgataggtaggctaagtgggcaaagaaaaagagaaattagccatcatatcaacttatgataaattggcagcaagcaacagaaagtcacgcagaatgtccaatttaatttatttgaaaaggcaaagtattccttctgtttggctcccattaattgtatttgagtcattttgtgcatgtggaacccatgtccatgtgactggacataatattgagattaactttcaagcttcagctaaatttacaaatcactggaatatttgttaagtgaaaaatccactcatcatggatatgatcacacgctgctttatacatacaacacctagtttcttgtaaaaactgtggtggagttcattgagcatttataatatatgaaaaatgaatagaaaagcaaaacacttacaaaatatcttgttcctgcaatttctgaactttcttgctgaatccatgatttttttcatcaacaataaacctacagacacaaacatatcaagagaaaatgataaatctaagaatataagtagctcacttaatggtagctttctttcttttaaataaaattttcttgcagtggtgtaacaaaagattgttagcatgtaatcctgatatcaattttgacagaaagagataaccaaacctacaaagtaatcggtgctctgtcatatgcatttttctttcaaaaatagattactattgtcctgaagaagaacaaaagtacagcacacattcttttaatcagttcattgtctagtttttgattcatgcacgataatatcagatattcatgctaatcctcccaaaacacaaacaaaattgtatttatgccatacaacttccttatcaagtcattgattgttatttgcagatttaaaataaattaacaaatgaatgtgtgattcttgtcctacgaattattggattggaagcatgcatgaagaaaccatagttcaattatataaccaagttaaacattgtaggcagctacaagatatttcagacagtaatgcttctcaatctgagagcttcgagtacaccttatgagagtatcaactataaagcatgatgtttacagaactaacctcgatgactggcctccacaccatgcggcatgctacattgattcaacatcaatataatcgtgttcaccctggtcctaccacttgttggcaccatctattgagagcttaatcacaggacttcaacttgacctatatatgcaccaataatgtagtcgaggaataaacctcatcgatgtacatgcatcaagatatggcatgggattagttaaccatcattcaataagcatgaagaaaattctcccctgtgcaacaatatagatcatcagatgacaattcagtaaatccaagtccttcattttttttaactaaaatctaggtcattcatttttcaataaaaataagatgcacttaatccctcaaaataaaaacaaagagtgcttatatcagtgtaaaagagtgtaaaagaaagtacagtggaatctgtcaataacatgatctggcagatatcaatgttagttttatgtaatttagaatgtagaagaaaatacaatgacttcaactacactaaatattcaaggtaaaagttagtaattagtgcatgaagaaagctaaaagacgaatcactgtatgcgtgtttaccaccatgatgatttaagcaccataacgattccctataaaccaaattcaaattctaattagcgattgaattgaaaaaaataggatgatttatttacaggagattaatgtttaacactggtggagaagtgctttttagtcccggttcgtaacccccttatagtcccagttttcaacccgggactaccaatccgggactaaagatcgctatctttagtcccgggtaaaaaaccgggactaaaaatcgatctttagtcccggttggtaacaccaaccgggagtaaagatagggatctttactcccggttggtgttaccaaccgggattaaagagagggtagcggcagtctagctggtccttttttttctttttttcttttctgctttttttttattttctcccgaatcgagtggtatgcatatcgtcaaattgaaccccaaatccacatcacaactccacatcacaattcacagattcatcacaaattcattcacatattcgttcacaacatcacaaatatattcacaatattgattcacaggttcattgaca

SEQ ID NO: 7047 - DNA, 5792 bp, Oryza sativa
tggtaacaccaaccgggactaaggatccgggggggcctgacaaggcctgataggtttagaaccgggactaaagattatttttagtcccggttgataacggcaaccgggactaaagatcaaatatgcccgctgtagccatcaaccgggactaaagatgatctttagtcccggtttttagtggaaccgagactattgtggatttcggccgaccgaccaaagatggtttctccaccagtgtaaaaaaacaagattatccctataaaccaaatctaaattctaattagcaatttaattaaaaagaaataggaatgatttatttattggagattaatgtttaaaaaagaagattataagatctgcaatatttgatagccatcctaagctcttaccatcccatcccgagccactgattcaaatgggattgatagggtgaacttgcatgaaaaatataatgctcctcccgagccgctgattcaaatggtattgataaggtgaacttacatgaaaaatataatattcatctgttcccactattttctaattatctactgctttttaattatttaataaaaaagataaccattaggagtaacatttacaatgagtataaaaaagatctgaaattccactcaatgtatttggtcagtacttacacattagaggactattcaaaatagaaaaaaaatactatttatgattagatattccaaacaagattgaatacaaaatacagaaatttatcacatgggaatttaatggagcagaggaggaaattgtggtggaggtgataagatgagagatgatgatttcacctgtaggattgctaggcacaactcttccttttttatattagtatagactaaccgtgagtaaactccgggatctaatctgtggccgaaatatcggtgctgactagatgatagagtacccagccgctaacgtatgtatgccagccactgatttatcctatgaggatgaacatgagtcgcatactcgcatcgcatgcatctcatgcacatatgtaaaataggttaatagcaaggagcttatagtcatccgttcacccagaaaccacgggagatgtatggaccacatctcgagatatcacaaacacgcatccatataacaacccagtcccataaaaaaccaaacaatgtaacacattctattactataggatatatctttatccaaattcgttatagtaatatgaatttggacatatctctgtacatattcgttgtattaatatatgtgacgtccaattttagattcgttttttaacaaagctaagggagtacagacgaacaattaaaacacacattaattgattattgacgtgttctcacaaacacaaatgttctaaaaaaaatgataattgacctattcactccgaacatcgagttggactcgcgagcatcaaggtgcagggaccagagcaacactgcaagtctgcaacaaccatctccctaaaaatatctactttgacttttaccggcaaacaattaggatcgatggtgtaatatccggctccgtacttccgtcggacggcgaatgaaccgaagaaaaaaactaccatgaacggaagaaaaactaccactagcatgcatatgcatatgcatgcagacggtacggtgtcccgcatgacaggcacgccgcgcgctccgctctcccatgcatgcggaccggaccgaccgagatcaggcgctagctgatgattttgtcaacgggacgggagagcctggaagcgcgcgcggccccgatctggcgaatcatgcatggtagtaagatcgatccgcgcgcggtgcgcatctctgaccttggtgtggacgacgtgtgcagcgtgcggtacagacctgagagtacagtggagaaggaccgggggcgacagggacgcgtgtacgtggacacgacggcgtcgtcgaatgcatcgcacggttgctcttcttactggacagaccgtcgtcggcacagtcgtgcagtctgcggaaactcagctgggctgtacacgctgggctggctgtactgtactcaatgctggccgagttagaacgattaaattgaggacgactctaaattgacacagtacaatataagactggaatctatagatcaggagatgagcacagattaattacggcaggcacggtagtatagtagtactgtagaacttaggagtacagtagtgagatgtgttgccggtggaataagtccactttgactcccttaaaagtcacccgaatctaatatgtaacccttaacttcaaaaccggatagaacaacttcccgaactattgaaaccagtgcaatttaactcactcagcagttttgctgatgtggcactgacgtgacgatgttgacctattcttcgtctcacatgacgcttatgtggcattcgaattaaaaatatatatgtgggacccatctgtcatttacacacaaaaaatataatatgggacccactaacatgtgagcccatacgtcatcctctctctctttctcttcccttcaccggtctgcaggggcggcagtgggcaaccgacggtagggtgtggcagtcgaggaagtagtcggtggcgggccagtgtgacaatggtcgttggtcagctgtggccgaggaggccttcgccctcttgacgtctctctgttgtcgccggttgccaggttctccatggtgctgcaccgtgaggtggagcacgtgcgtgaatggcacaatgccgaagaacttagcgaggaagcggccgtcgttgatgctgacgacgccgaagagcttggcgaggaggcagtagtcgttgatgccgacgccgtcgtcgcgcttgtggagcgcaagggagcagtgggtgtcgacgaactcggcggcgccggtcaccagcaccaatgtccccgagtcggccgacgacctgagaggcctccttggcacggtggacgcatggatctggccacactacaagaaacttgttaatccgtgatggattctccgtgacggatttacggatcgtcgctgacagacatactccgtgacgatattttgtttttcgtcacagatgagcccagtggatattcacagcccacgaactcgtgacggttttatcaggaccgtcacaatgtatgattttaaattcgtcatactctagttagcctagaaaaataaaaaacaatgtatgattttaaattcgtcatactctagttagcctagaaaaataaaaaaattgtagcgcaaagaaaaacaaaaaatatgattgcaagaagaatcaaaatatttgttaaatttgaacataatatttttgttgatttgttacgtgtatataatggtttgttaaatttgaacaaaataatgttattaatttgttacatgtgtatgatgcataatatggcaaactaaaaaaatattgtgcgcatgcggaaaaaatcaaaatatttttgttaatttgttacatgtatatgatgatttgttaaatttgaacaaaataattttgttaatttgttacatgtatatgatgcataatatggcaaactaaaaaaatatggtgcgcatgggggaaaaatccacagcatgtgggatttgaacccacattgagcaggaaggtaggaaatatgttaccaattgaaccacttgttgtagatgtccacttctgcacttatatatttttatttatttattattggcccagcatccctgttggcgtggcccattaatgccattcactcgagttgagttggtccaggatgttgcccacagcgtggcccagcagctggagttggcatttcgaaaatggggcccagcagccggagttggcatttcgaaaagaaaaaaagaactcgaatttgtaaaatagaagaaaaaaatgcaaccaacgagaatcaaacccatgacctactagtagaaggcgccccatcctaccactgcgctagttggtttgatgtgttattgtaggattctgtactctttttgacctgtgtatgtatggaggagtaaggtttcctcaaccccgactcagttattcagttcgacacccagccgcaaccaatctaagacaccgccgccgccgacggcgaaatttggcaggagcggcgttgccgctgcccaccactgccgcgtcgttcagcaacgccgcctccttgcctaccgtgccatcgcgcatcaccgctgcacaccagccgaacagcgacatcaggcaccaccgccgccctacaacgccatcctgtagatctgcagcaccgccgccctccattgccgcaccaacgagcgatgccgagtgcggccatgcgtccacctggtgacaaattcaactgttgaccggactcctgaagcctcttctcccatctgcctcaacagccagccaaggtaatatcttcttcttcttcttcttcttcttcttcttcttcttcgatttagttggatgtagcatttgaattggtgcagcttgctcattgtggtttatctacaatgtttgattagatggatagaagttgggtgcacagtagactattttcccctgaatacattgacggcgtcaaagaatttatgagtttcattcaggggaaattcaatgagaatgttgaaattctatgcccatgtagcagatgccttaatcagaagtaccaaagacaggctgttgtgaagaagcacatactgatgaatggtatggaaactacttatactcggtggattcatcatggagagagcttagatgtcaatgttattgagcatcctattgatatgaatgaaaataatgatggttccacaactatggtgacagaggatgacaactatggtaatcgtttggaaggaattttaggagacctacagactgcagcggcacaagcaagaccggatgtagaaaatcaagttggtgctgaagaacctcgtgataaagagtcatttttgaatattgtcatgagagaggcaaagcgtcaactttatcctggttgtaccaaattttcaaggttctcatttgtggtaaggcttcttcatatgaagtcattatataggatcagcaattctgctttttctgcacacatgaagctattggctgatgctttcccagaatgcaatacactcccaaaatcatatgatgaagcaaaagtcattctaaaggaaatgggtcttggttatgaatcaatacatgtgtgctacaataattgtgtgctgttcagaaaggaatatgagaagcatgacaattgctcggtttgtggtctctcgagatggaaagatgcagaaagaaagaagattccacaaaaagtgttgcggcattttccattggcacctaggctaaagaggatgttttcgaccaaagaagcatcagaagcggcacagtggcacaagttaaagcgacagcccgttgagaataatatgagccacccagctgatggcgaggcatggcaagattttgaccgtgaatatcctagttttgcaaaggatgcaagaaaccttagacttggcctagctactgatgggttcaatccttttcagaaaagaacacaaaatatagcatgtggcctgtgtttgttgtgccctacaacctagcactgtgggagtgcatggaggaatcaaactttatgatggctttgcttattccaggtccgaaatcacctgggaaggactttgatgtatttttacagcctcttgtagaggatttacttgagctttgggcaggtgttgatacttatgatgctattactggcaaatcatttaaacttcgtgcagcggttttgtggtgcatccatgattacccagctttgagcactctctcagggcgtacaacaaggggctattttgcttgtctccattg

SEQ ID NO: 7048 - DNA, 984 bp, Oryza sativa
  unsure (1)..(984): unsure at all n locations
ttgaaaaaaaacatatgtgagaacctaattgggacaattctcaatataaagggcaagacaaaagacacagctaaagctaggtttgatttgaaagatttgggtattaaaaaggtgctgcaatttagagaggatggagagatgcctcatgctagatataccttgtctactgaacagaagaaggctttttgtgcttttttacaagaggtcaagtttccagatggatttgcttccaacatctcaagatgtttaaatgctgagggaacaacggtacaggggctggaaacacatgattgtcacattcttttgcaaagaattttgcccgctgccatgagaggatttctggacattgatatttatgaagcaatagctgagttggggatgttttttaggaaattgtgcagcagaactcttaacaaggatgtgctggttcaaatgaagaaagaaatccctataattttggtgaagcttgagaaaattttccctccagctttctttgatgtgatggtacaccttgctatacatttacctgatgaggcattgctcaggggtcctatgcaatatgggtggatgtacccaattgaaaggcgactatatactttgaagcgatatgtgaggaataggtcacgaccagaaggttcaattgccgaggcttatattgctgatgagtgtctgacattttgctctaaatacatggacgatgttgaaacaagatttaatcgggagccaagaaataaaggtttctccaatgaagaagcttatggtgttgatgtttttgggcatggagttaattttacttctgcacctgaatatgtatatgatgaaaatggcattgatcaaatggtgtggtttgtgctaaacaactgtgcccaagttgagtattacgtcaagtatgttctatatacttacttttagacttcttctatatgctannnnnnnnnnnnnnnnnnnnnnnnnnnnnnnnnnnnnnnnnnnnnnnnnnnnnnn

SEQ ID NO: 7049 - DNA, 993 bp, Oryza sativa
ggtcttaggtacacgtcgatgtcgttaccaggttgcttggggccttgaataataatcggcatcattatgtacttcctcttcatgcatagccagggggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattataggaaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcagacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttccttctcgcccgtttgatttccttcaaatccaacatactgagcaaagtccggaatattgtcgtcttccacttcatcttcttccatttcaacaccttgctctccgggggatgtccaacaat

SEQ ID NO: 7050 - DNA, 40668 bp, Oryza sativa
  unsure (1)..(40668): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctagtccgaatgagatgaggcagtacaagaaagtgatgaacaaaattaaaactgaactagagttggactaagaagcgtgggtagcttcgtccccaacgctgcgggcgacgcgtcctctgtggctccggatagggagaggctggcgctgacgactccgctcgtccgtcgccgctccgcaaccgtactcgtccgccgacgccgccgcttcgcctggctgcccgctgccgctcccccgccgccactcgcccttctccttgcagcgtaggggagagagagaggtgggatagagagaagatggaggttgacatgtgggaccatatgggtcccacttttttttattattttgtgtgtagctgacatgtgggtcccatggttttttattattttttgcaaatccaattgtcacataagcaccacgtcaatgccacgtggaacgaggacctagtccaagaaagccacgtaggcgccatacaaaaccgggcacaataatgtcgagggacctattctgtatggttttgtaagttgagggatgcgttatatccggttttcgacaaattgagggaccgaaagtgaacttattctgtctcaaaatcacaggaagcgattgcaaaacagaacaattacagttggtgtagtggttgcatcgaatgtatgctgccgtgctgagcagaaaatacatacacatgtaataaccactaagcaggttcagaaagagaggaaatggaatatttgaacatgttctacaaattggcctaagcgcctagcgccctagcatggtacacaaattattaatggaatgctattttacatgctttagccttttaatcacctcgcataatacgtacttcctgggttcatcggtaggttctcacgttcctccccaagatagccggtactacttgtttcaatctcaagaccactattaattgtagatggtccgccaagaaggttctctgtttccatctctgcatcgacttgtacccaaggatgcagtgaaagcttcctcaatcggcccagctcgtcggtgatttctttcatcgatggcctgttggcgccgcacatatcaaggcattgcttggctagctcagggagccccccgagtcgacctggcatgctctcttggccttttatgtcgctcaccaacaccgagtcaagattgttccccttcatggcagataggaaaactgatgacaagcttctttgtatcgcaggtccttcgagcttcagtggcacttggcctgtgagaatctctagaaggataacaccgaagctatacacatcgctcttgtcggtcaattggcacgtttgcatgtattcgggatcgagatagccacatgtaccttgaaccattgtgacaaactgctctttgtcggatggagctagtatagatgctccgaagtctgtcactttggccatgtagttctcatcaagaagtatgttggcagttttcacatcaccatggagaattggtggagatgcataggaatgtaggaagtgaagcccttcagctgcttcatgagcaatcctcaagagggtgctgaaagagatttgcaacccttggttctttccatggataagctcgaataatgttccattcgggacgaactcatagactagcatcggaacttcgacctcaaggcaacaacctaggagttttataatgttcttgtgattgatttgggataggatgagcatttcttggccgaactccttcttttgtctttcgtcaactagtgcacatcttttaattgcgactagcatgttgtccttgactgtccctttatataccgttccatgacctccttggccaattattctgctcttgtcaaaattgtttgtggcatgtatgagttcagcttctgtaaatactgtgaaagcaagacctttttttgatttcatactctcaaacaaaatcatacccccatgttggcgaaaatattctttcttgattttggtcagttttctcctttgaattaccaattgtccgcagaaggcaatgatcatgagaacaatgaagcctataataacccctacacaacgcatcagcatcataagataggatcaatgatcatttcagagtagtcaggaacttgtattcctttattatttgaagatcataaaagtacataaaaatgataaggagttaaatgaataccaattatcaagccgatatcagggatgcatgtattgctgctcttggaaaatttccttcccttccgacaagaacaccggtagcctccttccgtgttgtggcaaacaccaccggaagggcatggccatgggttgcgatcacattcattaacatctgtcgtaaacttagcataattatatgtagaacacaacatagggtgagatagatctagtatttgtgcacatacaaataaatcaatttacaagagggctatacataccatggcatccatgtgggtctggaagataagggttaccttcgtatccatgagagcagttgcagacgtacccaggtccattggtggaagccacacactcgctgttgctactaagacaagcatagcttgtcatgttctgtttggcaatatcgcatgacttctctctgatagcccaatcgatcaccatgggtacccgcccgccgtttgtgccattaaacttggtggtgtttatgtatgtcgtgctgaaattgaacgatgctgcctccatcagcacggcatagctgcaccgaccgaacctcgagatctggcttgtgttgaatctcttatcaaaagtaacattatagtagtacattcctcttggtatcgtggtctggcagcagcccatgccggaacaagagccatccactagccctgacaggtcacgacactgcgagaaacacccactttggtaacccgtgccaccatcatcggcgatataggcaagggtgttgcacccaattacggtgaacttgttgtagacatctgaaaaccggaagggggtattctttgcattgaaacgaaaatgaacccctcccataagaccggaggcattgtagcaaaaggttgagatgccattgagtacccgcaatgtgctacggctcaacgaaatatttagtacctcaacgttgccgataaatggcttagaaatgccatgttggaccttgcattcgacattgaacaattctgcgagtgagcaattcgctccaatgccaaacgggtactgtatgtcaacatccccgcaccgactttggcattgagggctaggaactgctgccgtcgcaatagtgtgttttgctgccagaagtagaagactaacgccaagctgcagcatcgtattcatattccttggctggagaattagaattgagaaaccatgataatgtttcatcaatatttttatattaaaatcagtagcttctaattaaattaatctagtcattgagaccacattaaaagataaggtgagattgaattcttttctcgtacattcagctatgaagtataaaacgaaaaacatactacataactattagactgcttaaatgtttgacaaaccatcacaaaactacataactaattaagcaaccatatcataaagctaaatatttggcgcaagttttattaatgtagaactacatagtgacaacactattaacgatatgatacacgcatgcatgtcaatatattatttcccgtcctaaaatataacaacatttagccttcagaatttgtcctagaatataacaacctcttcaccaatattctattatcaaccaaacacaactctacgtcactcaatttcatcatctatacttctatttatcatccactcacaatcatccctcatttaattgtacctactttattagtaactttctgccctcgagaaattcagactggtaagattttagaccaattcctatattcctgacatctaactgatttagcaaaaaaaaaaaaaatcaccggccggcggcgaaagaagcccaggccaattttattaagatcatgagtgaagtacagtttataactgatgaagcatgatatgagcatataaatgttgctagctctcattggaaactacacatatatacacatataagaaattaataattctgtaaaattcagctgaaatagctaggcagttcaatccgtgcctatcagaagagtaactaagttcataccagatgcagttttctccagaattagcctcccacaagtacccttggagattgctcctttcctataggcagcgttggatgtgtatgccatgccagtatatatggagatgtattgcacatcaatgtcatcgtggaaggcgtggaacaagtccacgcaaacaatacaaaggcgccgggggtaaaaagtcatatatagcaaaaggccatggatgataggcagcgcatgcatgcagttgtgtgccattgagcatatatataaagttataagggtttaaattctaaaccatggcgatccattcctcaatatttgatgttggttagttcaacaaacaaaaagacacatagagagtacttactgatcaatatgtgtacgtgtttacattcttacaacatcgctgaacagctgaatggataaatagttcaatgatttgcgatgatattctggaatacaaagaaattaattaaatattattatgttaaaataatttaaaataaatatctttaaaacattcatataaattataaatattgtttagtagctcgagaaacgtgtacatttatacaccattcaattcctttgaaaaagattacacatgtgtaatacacactccctatattgtaaaaaataaatctattctttgtatcccaaggagtattgaaggaatggttttttttatagagtgggtaggtaagagccttaaaaattccaaatttttaactgtcaaaatcaacttattttaagacggaagagcacgtgataattaagcaggtcatcaacggtggatggatggcttgactgtacacgagtatgcgtagcccacgtgggttaaattttagatttgacatttggttagcgaccctagaactcattcctagtctagattttgatcttttctccagtacattttccgccacaaggagaagacaaagctatgtaataattcttcttctctggcggtaacacacttgattttaaattctcccatcataaattaattagcactctctgtagcacccttgaattttggtttattttaaaaattcctttatttaaaaatgggtgaatagttaatttagtccctcaagtttcaccgaaggttcaattttatccttcaggtttcattttgtccaaataggtcctctaagtatttgttttggtttaaaatcatcattgattcattgggcccacttaatatgctatttgactatttttagtcaacaattatgttagaaaatgtcccttttaccccttagtgtgtatacaactatacactagaaaagagaaaaccaaaatgaataatcaacattgcatatgtacttcccattatttcaacatgtgcacatgaaatttgagcctaagggctatcgtatacacttgcaagtacataaatttattttcgttttacataaattactatgcactatctataaaaaaaaagtcattgcacgtattttttttctcttatatatgtaaatgagggggtgtaagtgtcatttatcatcaaagttgttggttaagttgacttctaaatgggttcaaggataagtttgaattaaaataaaaacatgaaggactaatatggacagattgaaacattaagtactaaattgggtttcggatgaaacttgaaggaccactttgtctattcaccctttaaaaatttggagtttaaatttggatcttttttttacttgaagtattgacagggctttgcctcgcagtgtgatttttataaaaagaatacaaaatatttacaagttacaagttagagaaggagaaggaaaaaatattacacagtttgtaaccaatcaaaaactatctgctttaaaggatccttcattctacacatatgcaaaagaacatctgttttgaacaatgccctccaagaactgaaggagggaagttcattccgaaagatttttccatttctttgcttccaaatgtgccaagcagcaataaagaagatttccaagaagcccttctggttgaactgaatgcgagccgaaacaaccatttgaaagaagttaagattagaattccacatgactcccaaatgctgccaacacctctaactgaagggaaaaaaaagaagagatgctctcttgtctctcttacattattcatgcatagctcataagttagatcatcattctcctttgcacattgccgacggtctagcatatcccttgtgttaagcctatccatgaagaggagctaaacaaaaactttacttcataacacatcttgttttccagatccaaacaaaaggcctcggtgcttgcacattcgagaatgtgagtttatagaacttcttagctgtgtatttatcagaattccataaaaaagaccaatcatcacccttgccgtcctgaaaaagaagagaggagatttcttttgtgccaaaatagatctcaaatcatctcttagaaagatcccctcaattttttgtcaaacccttcgtcaaattcaagttcaaatccctccataaatctcctcaaaatatcaactccaaaatcccagagaaaatagaaagagtcactgttcattagggcccttttccttttctccctcccggcccaactcccaatcaccttcccctccttcttaccgaagtaggtctgcccggcctccttcccgcccctctaggcccacggcctttttccgcgctagcccaggccaccgccgagtcatcttcctcctcaggccggccacaaatgatgtaatccgtttgatgaaatgccgacccgggcgccgagacgtggcagcatcgttccgcaccgtgccgtctacccatgcacccacgcatcgcaccagggccgcgtcccgccaatcccgtaacaagccaaggccgcgccgcgccaagccgcaaatcccggcggaatccgaccatgtccctcgctcgggtttctctctaggagacacggtgccgcgtcaccctccgttccatcacggtgtcccgttgccaccgcctcatgacaccatgtcgtctggtcccgagctcccgtggacgcgtgtctcctccaaccatcgcaccgcgtccatgtcatccacctcctcgtgggaagtcaccgagcccgcgcctctctctctctctcacatcgcgtcgccaccactgcgtgacgttgcgctcgtcccatcgccgtccatccgctgttgtgtgcgtcacctcgcctcgcatcaccaccgttgcatgacgtcgcgccatcgcctcgccatctcctctatcccggaataccgccctagcctctagtcggatacaccccagatttcccgacgcctagctgccaactccccgccgcatccggccaaggccgctccgcctataaaagggaacccaagcccctttcctcgccaccccaactcccccaccatacctctttctcttctctctttaccctctctttgtcaccgctttgagctgccgccgatggaagcctcgttggaggtcgccgctgctgaccctggtcactggtcactgagtcgtgcctcgccgctgcgacacgccattgcctcgggctgggcagagcaagaggaggaagaagaaggagccccaagccactgatagcccgagcccacacctctctccctccaccggtcgtcgacaggtgggccctctctgttgtagttcacacaaaattctagaaaaatcctttaacctttgaaaattcttagaaattcaaccgtaactccgtttgatcccattcaacttgccatttttttttctaaaattgagatctacacattggtattgttgtttctctattttaatcttgtctttttgccttttcttgatttgtgctccttttcgcgtatagagcccgagtatgaagaagctccaaacgccgcttttgaaggagaaaacccgcatcttgtgcaaggaaatctctcttgatcacatttaccctatatttgcaagttatcttgtttgaaaaatgcattgcttagtgtacacaataatcttgtttaggcctcggattgtgtatgcaaccgatggaccgcccagtagttgcacttactttacctaggatgttgatatttccttacctttgatagctccacacatgtttgcgccggtatcactatccactagatacgactaccaaggtagtttacttagccatgcttatgtttgtattgtcatatgggaaacttgggttattccaaatatttgcttaaaaattcggtacgttgtaccgatgtgttgtgaaataaaataggttgtgaaaatggtgatggtgcgaagtcatgcttttgtggtttggccacgtattgtcgttgaggatcttttcctttgggaaatccatccaaacacgttacagtgcaaccccacgagtgtttatgggatacctctggctaagtaaatagttatcacatgggagtttggtgtgccaatggttgtgggatgccgaggatgagagaagacgaagttttggattcttacaaccctttttgggtagccttattgcctctattgtggcacaagttaccaataggagtaggagacatcctcagtattcctaagtggatgaaggctgatcttgcttgatgctcgtctaagagacttggcccaactaggtgacatgcgatttttatgggttagctttggaaaggccttgtcacaaataacttagttgcctaggtgcttcacttagtgcctagttgctcagtcgcttagtttctcaccgcttttagcttccggctgccgcttttatgactttctgtgatgccgtgttgctcatatataggcctgtccatgatgtcaacttatgtaaagtctactttccagtgatataataaagtagtttactttgattttacatttattctgtgtataccagctagtatgttctggtaatatattacacatgggtatgagtcagcttgttttatggctaacgagtgtcagggcgttacattctcactattccaaaatgtagtaatttaaaatcggattgaatatttcttagtacaataaatctaaacataaatcttatccagatttattaggaaaatgccggcgctcgggcgcccgacacgcgtgcgcgcggatcgggcgcctcgtgcaggcggccccccccccccccccacgcgtcccgccacatgtccccaccacaacatgctatgtgttcccaccacacactccgttgcaacaaatcacccacatattaagggaatccgtcttattttttgttccacaaaaaatgtttcacctagtgtacttataatatttcactatgtatagatcaatgttgcagtgaattgaaacattctttcgtaacaaataacccacatattatggaaaccctctgttaagggaatccgtctcattttttgtggaaccaaaaatgtttcacctagtgtacttataatgtttcacgatgtatatatcaaatgttgcagtgaattgaaacattctttcgctatttgctaaaacatttgtttttatataaggtgaaaaaaacgttagattttttaggaaactgttgtttcatacgttgtagcaaaatatttcatgaggtgatttagttgtgtttcaactttttaaacgattaaaacattttcaatatacttagtgaaacaattctgatctacttggtgaaacaacatgcaacatttaaaaacaattcaataataagctaaatattttttccatcggattatatccatgtgtggtcttgttttaaagatttaattgtaacggatttagtggtgcaatcggatcatgatttggataaaaaatttaagagaaaaaatagtttaaagttcgcttaggaagttttgcatgtatgtgtcgacgagtgatactcgtagactggatgatttgggtattggggtacgttggaacgaggatctacgtaatacgacatcaagcagataaaagacaaggattatactggttcaggccccttatcaggtaatagtcctagttcagtttatataagattgatgatggaaaaccacggcttacaatgaaagtaaacgaaacagacgataccgatgagatcgttgtcgatgtattcgacgagatctcccggcgacttggctccgcgtacttcggcttcgtaaactatggtgggtgtgttgacgatgagattcaatgccctgtacccctccctaggggtctcttttatatcgtggatcatcttgatccccaagtagacttggagacattggatcttgtacggtataacagaaactctatcccttctgagtaggattttggaaatcacctatctcgtggagatattttccataatttataacaaattccaacggcgtatacgaaaacgatccgtatacgtgaaggtataccatatctgtgtattccataagtcgtagagtatgaggtatgtcttatccgtaaccctgacagtatgtatgcatgatgacgtatgatgacatgcgcgcctgatttttctcagaaaaaatcggacacccaatccataggtgcctccgatttgttatattaagaaaatctaatccgatctactctatccgtttcacaatgtaagtcattttattatttctcacattcatattgatgctaatgaatttaaatagatataattgaatgtgggaaataatataatgacttacattgtgaaacagaggaattagttgagatggaggagtatatcaaacctatgatatgaggtatgacaagatgcgtgcacggctactctaatccggagccgaactaaactgtcaacttcgatgcacgtggtaagaatcacacgaccccccaaattttctagaaaacgcaggttggagtgcatgcttcagtgcactgcaaaactccacagtgagagtgattcggaattagttgccatataatgccaggtcaacgtgaactgtgttggtaatgtaatcctttcattggatcgatccatggagaaataactgagtggtttgaataaactaaggcctgtttgtttcagcttaagattattataatctagattattaaattagattactttaagctggattataataagctgatatagaataagctgtgagctgtttgtttctctggattattggaggcatttaagagtagtgggtctttagccacccaataatttgaaaaaaactcctccagagaagattattagattataataatctggcttatagattataataatctatcataataatctacttatttgtttcggcttactcctaataatacagattataataatcctagctgaatcaaacatgaccatgacctaagtggttagatacatcccttttcattttaaaaaaaattaacaaatctaataccgtatataatacatccactatttgaagacgtgacagccgaggggctattaaccgaacccgtttccctgcatctttgttgcttacttgcagcaaaccctcgtcagacaaacaccatcaattcctgcgtgcacgtgcagtcagaccggtttttctcttatggaaaaaccaggcgtgcggactcacccgaaacgtgcctacaccggacggagacttggaatgggctccagctccacgcaactggagcgacttagcaggccgaacatggccggccctggatcaaacgggctgtgtaacctcctttacgccgagccagatgacgatcgagcatttgtgctgtgccgcttcgcaagagccgactccccctgcatctgacgggagcaggtgtagcacgaccgttctgctgccctgcatctgacgggtgctgctggctgccgcctcgccggtgcagccgcccaagcagaagctggcgaccgcgggatccaccggcggctggctccactgctccagagtccagagagcgaggaggagcatcggttcgttcgttcgttccagagcttccttccagtccagcgtaatgaatgccatcgtcaccccgtccaatgaggccgcggcccatgcccctcctcgcacacggcacacccttatcctcccccttcttgatcttaaaatggcaatgtgtgtaaggatcttcttctaactcctttgacaacttcgaggtggagttcgttattctctccattattggatagaaagagaggcagaatttaaagtggccgccgagaatcttctcctgtacttgcatgaatcctttgcccgtactcctttcccagccgataaagcacacagaagcccgtactcctttgccgtccagtacgtactacgcaccggccgctcaccggcacggccttgtactggcatgcactgaccataagcccgtgcaacttgatcgccgtcacgccgtcgccgacttgacgtatcatcctcacaaggaattagtgcaagaagaaactgttgctgatcagtaccaaatctgtgttttccgttgggtgggtgtcaagcacagtttatcttcagaaaaacggatcgatgtgtctgcatgaccaagatttcacactttccagctcaccctaacctacacatagacagccgcaaatgagtattggccaatccacaagggttcaacgagatcaacatacaggccctgctgttgtatatatagccattagcaaccacattgccatacagtactcagtagtcgtacacattctctcgtacgcttcttcgagcagaatgaagggaggaggatcaaagaggagattgctccgggccttcctccactcatggaagaagctcggcgccgccgccgccgccgcggccccggcggccggcgagtgggctcctctcgacggtgacggcgagggcgccatcccgagcgacgtgccccggggccacacggtggtgtacgtcggcgaggagctgcgccgctacgtcgtcagggtgtcgtccctcgaccacccgctgttccgcgagctgctcgaccgcgccagggaggagtaccagttcgccgccggcgccgacgcgaggctgtgcataccctgcgacgaggacatcttcctcggcgtcctctgccatgtcgactccaagcaggagcactggaggctgatctcgttttgcagatagctagctgctgtgctgcctgctgatgcatgtcgttgttcatgcctaggattggatgtttcggactcgttgctccgaggaaacggaagaattaattaattcgcgtgaattctcacgtgtacaggggcatttaggctttgttagaatgttggcagtttgttttggttccattgttgtattggatatttggattcttcaaggatggagatggaccatgaatggtactcccggcatatttcttttttcgcttaaagtgtgattagcatgcatgtaaagatttgctcgagtgaagaagatacagtcttttccctgttggaacttgcaattggttggacccaactggatttttcacttttttaatccttttttaaaacttatttttataaataaacctctaaagaaacttagactcttttcacaataccaacgtcattggcaccgtggttcaacataacggtgccatgccatcatccccataaccttccggcgaaagctaagtcactgatgtgaagggacaacaccatgaactatttgtaattttttaaaggacttatttgtgataaaaatatttataaaataagtcttcaatgccgatgtcattggcacccaggatttatttataaatattttttattacaaatatatctttttttataacaaatagatggatttttataataaataggttcgaattcttttacaaatagatcctcgacgctaatgacacttcccccttgacgctaatgacatttccccctttatacaagtgacttagcttccgcaggggaggctagagcgacagcatcaatgtcattggcaccatcatactgggccacaacatcagtaaaattggaataagttttttaggggtctatttgtaaaataagttttcaaaagagtaaaaaatccagtggatgcaacgttaattctgtcgatcgaagatcatccaatctttgcatctatatctggccatctgggacatgctttaagcaaacatgatgctacaatatgacccttatggaggtaatttataatgcattcagagtttcagacacagcaatttgatttgtaaatgcagaaagagatggcacggtggaattgcaactgaagggtcttgctctgtattgactgagtggcatgatcctttcatatcggtaggaatttttagttcactttcctgccatgccaaagagataaggcactatactcatctatccaaacatgcctagggtgcactagaaatgtgccttgagtagtggtggaaatgtcaaaaagcactcgtcgcctatagttattcctttctcaatatgctgaaatggctctagttgaagtcaggcttctcagggtaagtgcagcctgagcgttggatgataacgtttgcagcataacaagcagctctgacacattcatcaatgctcttctcctgaaccaattgagagagaaaacccccaacaaaggcatcgcctgcaaaacaattgtttagaaaaaaaaaaccacttatgtttactgacagttatgtcgtttaaagcaaggatgtatatgcaatgtttaagccagcaaagagcatccagtgaaagcaagacacatagatgtttctacatcataattttctaaaccgactacctgcaccattggtgtcaacaagcttttccttgggcaaaacgataacagggaatgttttgacctgcagcaaaaagaacatatttaaggttatcggataaacaattatcagccgaggcttctgcagattgggtatactccaacaaatatcatgtcattaataatgacaaacgcacttgagttgttgctaagattgtaataacaccataagtgaaacaaatattggctacttcagagaagatcatcaattcgggattctaacttaggaaaaacactagctacagtactttcattaaccaagaaaaggcaaacaaatttacaatagaagaggtttgaacttatgttatgctctgtaaagcatatctcataatatcttataaagacaggaacatatcctttgcacacaagctttgtgtgcacactaactaacaaatatcacctaatttttttaaaaaaagtgtgcatatatactttcaatagtattacacatatgcgtaatattaacctcaaattcattatattttaggcataacaaaattttttttaacaatttcagtctataagtcaaaaatttgtcttttttgttgctctctatgtactccctccgtttcaggttataagatattttgactttggtcaaagtcaaactgttttaagtttgactaactttatagacaaatatagtaatatttataatactaaattagtttcatcaaatcaataattgaatatattttcataataaacttgtcttgggttgaaattgttactattattttctacaaacttggtcaaaattaaagcagtttgactttgaccgaagtcaaaatgtcttataacctaaacggagggagtatgatgaattcgaagatgagactttatacatagatgtaatgctattgaaagaacatgtacaattttttctagaaatttttatgatatttattagttgatgtacacatgaaggcttgtgtgtataggatacgttccctataaagacatgccttggaaaaagaaaaaaaaaaggaatatttacctttccatcatcagccacaactactgggtcacagccttgagtaatgacagtaatcctcttgtgtgctcctgaagccttaggcaattgcgagatcttcaaagcaatctcctcagtattctcagtctacaatttttttaatggacaatttgtaaatactttactcacagaacagaataataggtgataagtgactattacctcccaaccacgaactttagcaaaggtccttgcttcagtttcatttccaaaaatatagtcagcatacctagtttggtgatcaaaagaactttaatcctgttttacatagcactgtattggaaaaattctaacatggatgaagtgcatgggtttagaagaataatgtgctgcagttgttaatgcaacgttgaatgttctatgtcaaagttatttataataagcatatagtggaacccagtactcacggaagagccttctcttgggcatcacggaagaattcacatataaagggagcagaaaggttcatcataaacacctgcaaatagtttaatcatttatactgtaacaatgctagaaaatattctccttttagtaattagtattttaccttgttagttgcagcagcatgctcagcaacaagttgaatggaatccggggataccgtgaggaaaaagccagcaatgtaaatatattttgccttctcaactacaatcaatgaccttattattgtgagaaaagcaatcaaatgaaacacataaactgcacagtaagtagtggacagtgctaacacaatgatggactgacaaaataaacagttcaagactcatttttattaccaagtgtccagttctctggcctcttcagatgttcagacctgtagcagttcgctgcagacaagtttgcaacaagtgacctgatacagacagaaggaactcatttaattgttcctttttggcaggaccagagtagcaactttagggagatttaagtgccacgatatcagcagtaaatgtactaatagataaaacgaaataacttatcaggtgattctattagatatcgctttactcagcatacctttcaccaccaacaatgcagacagcacatgtgccagtaggagcattatcatcctcataataatgggcctgtttaaagatggtaaggtcaaggcagtatgtgcagtggtgcaactgagtgaagaggcataaaaatggaagaaatttaaaacataaagaggaacttataacttgcattaacaccagcggtttgtgcgtctttcttcatctcctcaccgaacttgtccttcccaatgcaacccatgtaacttgttgcaccaggaatctggagcatccactgcaataaatattaataataataatcaagagtgttgtgatctagtagtaacttctgggcacataaagaacataatgctagcactcagtattttttgaacttacctgagcaaccctaatagaattttgagtggatcctgaaagaatcgaacacaataaattcaaataaaatataaaccatgaaacaataattcatcacattgaagtcgtaggttaatgtatatggtgtggtaatattacctccagcgatatattcaacattgaccttgctagccaattcattgtacctggcacataacacacaaatccacaatattcagcaatcactaaggcacatcctatttggcatgattaatgttaggattttggaaaaaaaaatccagtgttgcaaggtttcagggggagaaagaaacttacataggcaaatgcttctcctctgctagaattgcattccctggcttgatatcatatctattgagttcaaaggcgcagagataaacattcagttagatcatgcgaactacttttttatcactcagcgcaagcaaacgagagagcatgttccaggccattaatgaatctatactgaagcaacatgtcatcgtggaacatacataaccccctccacccctccacccttccaaacccccaaaggccccaagtggaaaatatcatcattttccaggaccgagctgtccgagaatacacatcaagtataaatttgccaatgaatataaagggtatagttactggatgaacaattgaaatactggaattccggtccttttagcacaagtttacagggccatgtccactgagccgcatgctcaaaactcacacatactgttcttcacagtgagaaaggctctacttgtcaaactcgcatgagtataacagttacttcaccaaaaattggcagaagagtacagtcttacagactacagagaccataggttttaatcgagagatcattacagcacacgaagagggctgttggggtggttcatactttgcgaggaaggcctcgtcgacgacggcggagatgtcgaggagggggtttcccatgcccaggaggacgccctcgtagcttccgctctccatccttccctagatccccggcgaacggtgcggcggcggcgggggcggcggaaagagattaccggcgttgctttgcttctgcgtggaacagttggggaaggaggctgaggaggtcagatcgacttcgcgagggatctttttgcagctgccacggaagcatcggcctgcctatcacggaggcccacgtgaccacggcccaacacctcagcccaccacgtgccgggcctctcgctcgagcaggcccacagcgtttccggctccactcaatctgtgacacgcaattgatccaacattaaaatgggtcgataattgcggttatcggtcttattatcaggtttgtcagttaattaaaaaaatttgagactatctatacataaattctctcttatctatctaaaaatttatcagttgtaaatatattataatcacagtataaattatattgtattgtgtatgtaatttttaaaaatcccatcataatatgctatttccgtaaagtgtaggaccgaatcctctcacgctatgcgtgtgttgtgatttttccttcctcgagtatacaaatcttgaggcaaattctaattgattaaaattatacgtgaaatttgcgttgtagttacataagtacaagttataattatgttatatataaatttaacgatcttttttgagaaaatttatcaacacatataaagcaaaatcgaaaaaaaggtagtattcaaattgtttgacaaatatatgcttggttttgccccttctcttcatcgtaaagtattttcgccaacgcgtaaaaggattacacacatcgagcagtaacctcgcttaacgacgacggagtggtaacccgtaaccggtgaccaactgtgtttgtaaaccttgagaattggattgttggaatcgagtatatgttggtgtcaatcacacacactcagtctagctcagtcgttggtggtattagttcagttgagcagtccctctttcatgttagaaaaagggcagttcggttgaacaatagcactatactcggaactagtggagtggtagttggaaccaacgttcacaggtaagcgatatgtacatccatctacctccgaacctgaggtcaaacggatgctttcctcaccaacccctttctctgcaggacggacgcatcactatctaattcttgaccgaccttccctggactgtcaaggggggcaaacttatatctagcttcgtttggtagatgacagcaacatgcttttcaacttgtttttaggttgctcaggaagcatcgcctcctgattcatctcagcatctcgatctgcctttatcgatttatcctgaaccatgatttgccagctgcattgctgcaatgtgcattttaatcatcccgtttgtcgctccagtttgcacgtccaactgtacagagatgcagagagcccaacagatctctgatcattacacgaaacgaaattcagagtttcagacggatgagaaattaagccgctcttccctttgtcagcgctaagcatctatgcgagatttgacttccattctcgacagaaactaaccacgatatggggcttgcggcgacatcacgggatccgctgcatgcatggacaggctgactgctaacggcaccacatgcacggtgtagcagcagcagacacgcaccaatctactcctagcttagcaattaacatggtgcatcatggtttgcggcaaccaccagtccaccaccaccctacatccatatctgtggcagtctcgctccgatcgctcaagtgctcatgcaaagctgcacgcgaggctgaacatggacaggagatcgaaggatggatcgtgctacgatctcgctagctcgtcttgcattgtttgacgaagtgagaacagaatctcacacgtacgctgtacctaacctgcgaggctggagtgctggacggccgccatgttgatgcctcgactgatcgagttttttgtcggggttcagttttgtcgtgaattgggggaatattcggtgtgctcatgtactcatgttcatggcgatggattcatggtcctgagcagagtatctgtctgctcataggatgctagcagagtatctgcaggtaccatttagctaagcaaatactctctccatccctaaatatttgacaccgttgacttttttaaatatgtttgactgttcgtcttattaaaaaaatttaagtaattactaattctttttctatcatttgattcattgttaaatatacttttatgcatacatatagttttacatatttcacaaaagtttttaaataagacgaataatcaaacatgtttaaaaaagtcaacggcgttaaatatttagggaatgaaggagtaatatattgccgtacatgcatgttcaggcagctcatttctttttctcaatttggcacgtaggacgaataataattgtctgtccatttcttccaaccaaagaaacacaaggttctttggtcctaagagtattattataaatgcagtcacatggttcatgactaaacaatagatgtatcaagtatttgactttcatctggattatcaaatgagctatgacgcattggtgcgatgaagaaactataggagtatgttactacggtaattttcaaaatagttccaactatcagctacttccccgtttcaaaatatagcaacatagtattagaatagttcttgttatatcggaaccccacccccaccctagaaattatttcacccaactatttttttcatctttttgtgaatttatttaaaaattcaaataatttgggaccaaaattggtcatatcactaaccctcgatacaaatagcgaaatgagattttgaaccctatgccagattagacataatctagcactgtgaacgtggacagaaccttatccactctaccttaccacttcccctccaccgtcattgtaccttcccaccacgtaaaaaaatcacactgcctaaaaaccacccacctaaaagaattatttccacgagaaaatcaaccctctagaaaaaactggaagataaaattgaaccccataaaaacttacgtccatgtttttcataatcctgttgcaaagcatgagtataacatagaaagcttttgtttatatgacggttcttatagtagggcctagagccgtacctcctattcgaccaagacatgactttgagcctttgagcatatcctaacggaaggtgaacatttttcaacttctctaacagttaaactagaagaagatcaagccattcaggaatgacattgtgccaactaggcaagtagtacttgagctagctagccgggtggatataattagagcataccataaggggggcgaatggtacacgaagaatgagaaagaagcttagcggatgcaccattaggtaaaaatattctcgtaggagatatcgaggggactgtcccaatcattctagcaagctagtgccatctatcctaggggaccacctaaatgtacaaatactccctccatactcataaaggaagtcgtttaggacaatgtttaagtcaaaccttgggaatataaatcataaataactctcaagttgttgagtttgaaaatgtaaaaaatatataaatagatttgtattgaaaaatactttcatacaaatatacatatatcactttttaataaatatttttatagaaacaagaagttaaagttgtgttttggagaccgtgtcgctgtcctaaacgacttcctttatgagtatggagggagtataccttatggtttcgatctcttcgggatatttttttttcactccgtgtatacctcttgaggctgtataaggcagcccaatcctgtaacagagacatgatactttttactgaaacaatggtggcaagtgtctgtcaatatatctcaagttcacttcactttttggaaatgaaacctatcccctaatttattcttgaccttggttcccaacaatggtcatggtccatcttaaactctccagggcccaggctaaagtatttctccatcgactaaaagaacccctaatttgaaaagtacacataaatcgtatgcatagtatttgcatacgatacttgtacgatgcaacatttgccagccaaatcccatggcattttctggccgtttctaacgaagaaacacatgaatctcgtgtttttactctatattaagatattaagatattaacaaatttggttgttaacacacatccaccatctgttagcaatcgtacaatgatcgtacacataaatcgtatgcatagtattttctaatttcctcgtgttgtttttgtaacagtaacacttcgtatctccggtggtaggtaggacgagtggacctcttaatctgcgttggctgatcgacagtactgaccgtctgtttcgcatcaaatcgtgctctgcacctgccaagtagctactggtccagcaagcatgagctgatgagcacacgagagatttctgtcactctcacccttgaaagaggacagcagacagacaacacccagcaaaactatctcttgcagagttgcagttcccgccatcaaccgatcgatatcagtgatcagttcgaaagaagtggacgtaaccagttcagagttgagatgaccaatttcaacacatgtaatcaagatagcgctatattagtatatttcacttgcaaaatacaacaacggaatcagaaagctgccagccaaggccatgaacgctgcaggcgccacggcattgcagcagcaatctcacacgattacaacacggataaatacagcaagctcaaaaaggaaaaaaaaaacacggacggagaaacaacgtaatctgctgatgagcgtacgagaagccttcaggatcctgaattcctccctttcttatttcggtgcacgtatcgtctcttcctggatcttgtcgcgttcgcgggtggactggttcgatcagcagatgggcaggggctcgccgttccactccttgaggcactcgagcatcgggtcgatgagcttgcgctcgctgatggccaggaacaccttgttgcactcctcgccgggggacttgagcttctctccggtgaggtacacgcagccgagctcctcgcggacgaagcggtacagcgggaacgacctgctctccttgatcctgttggtgatcggcgcggtgccggtctcgaacgccacgcgcgccgcctccatctccctgggcagcgcctcgcggagctcctcctcgaacgcggtgatcttggagaacacggaggagccgtcgtccttctcggcggggccgttggcgagggcgtgctcgacgagcacggcgcggatcttggtcatcagcgggtagttggcgctgcacgggtcgtcggcgtagctgtacacggcctcgcggtcgatggcggtgagcagggccttctcgctgaagcgcgcgctgtggaggccgccggcggggcccgtggtgagcaccttcttggccaccgtcgtcacgcagttcttgacggcgctcttgaggttctcctccaggtggcgcaggtcgacggcctggcagagcgcaaccaggtaggtggaggacatgagcttgaggatgtccaccgcctcggcggtcttcctggcggagacgaggccgagggagttgacgtcctggttgtgctgctccgcgctctggacgtggttggtgaccgggttggcgaggaactggagctccgagcagtaggaggccatggcgatctcggtgcccttgaagccgtagtccaagctcgggttgcggctgccggccaggtttgacgtgagcccgttgttgtagaactcgttgaccagctcggagaactgggcgaacatgagcttgccgatgttggcgatggcgaggcgggtgttgtccatggacacgccgatgggcgtgccctggaagttgccgccgtgcagggccttgccgcggtggacgtcgatgaccgggttgtcgttcaccgagttgacctcgcgctcgatcgacttggtggccgcgcggatgacctcgatctggggtcccagccactgcggcgacgtgcggagcgcgtacctgtcctgcttcggcttcagcagcgggtccacctcgttcaccttctgcgcgtgcggcatgaacgcgctgccggcgaggatgtgctccatgatggcggcggcctcgatcgagcccgggtggtgcttcagcttgtgcgtcaggtggtcggtgtactcgggcttgccgttcatcacctcgcagaacacggcggacagcacctcggacaggacggcgaggacgttcgcgtcgtagagcaccatggcagcgagggccgagcccacggaggtgccgttcacgatggcgagaccttccttgggctccagcctgaagaagccgccctggatgccggcgatcttgaacgcctcggcggcgtccaccttcttgccatcgacggtcaccgcctgcgcgttggggcgcccggtgatgaggccggcaatgtaggacagcggcacgaggtcgccggacgccgtgatggtgcctcggagcggcaggcatgggctgaccccggtgttgatcagcttggtgatcgcctcgaggatctcgaagcggatgcccgagtagccctggagcagggtgttgatgcgcacaagcatcgccgcacgcgacacctccgacggcagcgagttgccatcggagccgttgccgaagattccggcattgagatgcctgcagggccgtgaaacagagcaattctttcagctttgcaacctctcagtatactgtgggtgaaagaagactatgtactaattacgtttcacaaatatctactgaaaattaacctgtttgttcgtccatgattggagttaatcagttactactactactccatccgccctaaaatataagtatttttagaacagtgcgaagtcaaactttttaaattttaaccattaatagcaaataaattaaaaagattaatcatgtaaatttgatgttactatatttatcattaagcgagctatcataatatgcaactctctttatttaaaacatcttacttttatagatattgttggtcaaagtaaatacttgtattttgggactaactaactattcgagatctttcgttttgcttcaacattcatgtcctctgttgtggtactacctaacatggcagtagtagtgtagtacagcagctaaaaacaagtggcacgcagttctaaaatctgcagctctgcatcagaccgagaggtagtacgtgcacaccaagataactgcaacaactggccgttcaccgacgcacggaggttgcacatgatggcattatcatcggaagcaacaaaacgactcgtacgtacagtaaaatggctctttgattagtgatttttttttactgtacctgagcagctcaacttggagggcctggccgtccttggtgcggcggtgggaggtgccgccgaagccggtggtgacgccgtagatgtcgccgccgtgggcgatgcagttgaggatccactcgctgctggccttgacgcgggggcgggcctcctcgtccagctcgaccaccacgccggaggcgtccttggccgcggagacggcggccacctggccgacgcggaggctggacccctcgatcttcaccacggcctcccgtgactgcgccaccatgcgcttcacctcgtccaggtggctccccgtcatctccagcgccgccttgccccacgacagcgggtcgctcgcgacgaaccccgtggcgtcggcggtctggctcgccatctctccgagcggtggtggcgaacaacgacgaggaggaggaggaggagctgggtggtggtggaagaagagctgagactatagagaggctgctgtgtgctcttcttggagggaaacggagtgcgggagatcgcttaaatagcagacgggtgaccagctgggttttggtgaggccgggtgttggtggattagttggtgactggtaaggtgtatggtggattggtggatcgaaacttaatgcttttttattgattttttaagcatttcaattgaacgtcaagtagtccagtgtactagtactatgcttttggttgggaaattggaaatgagtctactggaacacgaatgtaaatatgtcataaggcctactctctccgtctaaaaaaaatcaaccgatccctcttaagataatgaatctggacatcctcttctggttgaattatttttgggatggagggagtaacttgcgtggaggcagttcaactacagtgagactcaaggggacgagagactaaccgtgtctgaaggaagatgctttctgctagcagttgccactacatcgtcgttgttgaatccaacagacggtatggtttaactgctattactagcttacaagtataagctccactctacttagtgtcagctgaaagattaggatgtgttctggagtgagggtttagaaccttactccttaacacgcaaaacgaagaagcatttagcatataattaattaagtattaactaaaatagattaatataattttttaaagtaactttcgtatagaaaatttttttaaaaacgcacagtttagcagtttgaaaaatgtgcgcgtggaaaatgaaggaggtaagttggaaaactagagataagaactcagcctaaggtaagatgagaaaatcattaacatattattaattaagtttttaattatttaaaacttaagagtagatttatatgatatttttaaacaatttgtatataaaatagtaatataatttagcagttttttaaacacagtacaaacgccgatgtttaacaacacacgcacactcacccatatgaacacatgtgcacgcatcctatctctatgaatacattcagaaaataaactaacaattttaagattgactagtaatcgtgcacgtgcaagacacgttttggaaagataaaatgttggcataaaatcttttataatataagcttacacgaagatgaactctttgatgattctttcagatcaaatcacatatgttgctgaattccataactctatttctaagtgattaagaactgtcgggaataaacagtgtccaccctagagaagcatgcactgaagatgtgcaatattagtcacaacatctgcagtaggccttagtatattatcatcatccaataattattttttctggtataaaaggagtagatgaagacaagaaactaattaccagagataaccaccttagtaaattatcctggaaactcttaaatccaaacgattgtagataaatgaacatagtaataatgttataggcttttcaaccatgtacatcttcagttttcctatgcagctggtcgttaataattaataaaacatgtgaatcgacaaaaagcatcataccaaaagattctataaatgtgcaaaaagtcaacatggtgaaagaaagagtataaactcacatgccacattccatacatggtgaaagcaagacaataaactcacccatgccacatttcttgctaggagcatatgctctgttcatatatcatgagagaatggtcagtactcagtagtacaaataacaaccaatcccatagaataattatgtattcatgcatcagtgtaacttcagttttacattcaataaggaatacttatctaaaatgaagactaaaatgagaggattagggttatactcatcatttactttctggtaaacaaaaaattgtaaatatccaggtggatacatatgtttttctcaggggaacaactaacgatgccatgaaaactttttcctcacactttcctccctctgaagataacaccccccggcccgatctgagcagttaatattgctaataaaaggatgcatgggccatggttccaatgttatacggaaacattaacataaactattgaaactgaatggtgagctatttctgcagtataaaattcacatttatatgtgcatagatgaatgaacagtacatacttgaaagcatgaatgttacctgtgaagcaattgcagagcagtaaattgagtgctttgcaaataaatttcctgcaaaaagaagaaaagtagcaactgaacacccatatcaaaaagagttatgggttgaaccatatcactcttacatcaaaattatgtggagaaagcataccttttgacccaaaattcttagtatttgttttaggtaacttattaatgcccatacaaactaaattgaaggaagttttctttacatggtttctacctttttacctggtgagcttatcaaccaccccaaatatcatttttcagagttcttgccccaacagagagaaacaatatgaaagtatatttacaatgactactgttacatattggaaaaggaatcgaatggcaatgcacatgcatatagctatatcaaaatccttttttgcgcggagatatatcaaaatattcatactaaaaccagcaacgaaaataatttgtgtgaattaaaataaaaaagtggtttagatagttaattgtggattgaagaaataaatataaggatgcaatggcgacacatattcattttatatcttctattattcagcataggaatggtttcagatttttcaggttttacagatagaagcaataacaatattccaatataaacacaagaggaacactcttacttgttggtgacatctataaacgggaggcaccagggtgtcaatttagctttctagcgttcatgtcctacttataaaaatcatcccagcattgttgtttgcctgaattagctgtagaaaaaaatattattgaatggatacacaaattatctctagaaaaagtctgcactacaaaacatagaaacatgatgtagtatatcaattttaacatatagaatcaataaatcacactaatctgctctgcttgctgggcctcacagctcataacgacaacaaccgcacatttcttcggaattttgatcattgcaagcatgtcatatgctctctgtaaatgtaatgtgcatgggtgtcatatcgggttgctattcaaaattcatataaaaaaatttatactgcaccactgtgagtttatgacttacatatttatgctaactgtatccaaatgagattataatcattttcagcttacctctaatagtaatagaggcagaccaatttattgctccatatgcttcctttcttctgctaggaccgctacatgtactctcaattcttttgaagcactcattccttttgtcagcagtgagggagggatacttcgttctagcatgttttctacttaatttgagtcaacttaaattttagtttctacatgatgatgttccatatcttttttttggggaggaggagaggtgtggtaagcagaacagaacagaacatgaccgaagagggaaaagatcagctataggaaagcataataccagtgacataattgcaggaggctgacttgaccagcctccttttctgcctccaccaattgttatttatatgcattcttttatcagcaagcgcccattgatcctgcaattcatgcattagaaaacaaaattaagactaatcaaatacagctgacaataacaaattagctagctgcatattatattttctagctcttcgactcctaaccattatgcatgaaccatgcttacgcccttgcgcagaataaaggcttacatttttgcatagcagaaaggcatgattctttgcctcaattattttttcacatcatgattagtggcaagcaatattgaacagtaaaggaaaatattcacattgttcacagtgactaatacagtatcaagtttgaaagaaatacaaagaaatcacctagagaaaactcacatagattacgtaagcaacctgtaccactaatgaaaacatccaataacacttcgagcaaaacattggttataattagcagttattcagtcaaattgtcccaatatttctggattggtcttcagatgaaaaatcacatgttactcgtaatgtagcggcaagcaacttgactgcagcttctccatacttttcaccatttctacaacttgactgcctagtgctgtttgacagcttccaactcttggagaatccctcgtgattcagcatcaagcatgacataacaggaatagtatcagcaatcaccgcagcatcgtggtaccatggccacctgtgggcgccagcaattataagcaacatcgtggcaaatttgtagaagatttgcaatcaaaattgacactaaaccaagagattattagggtaaatacctagggttgatgaacgtctctgtgacggcaatcaggcagaagtcaagggccacaatatggtgttgaagaaggtggtggtctggcaacctggatgttggcctcggcagtgaagctgcaaaggggcacaggacagcgactacacggtggagtggactgcgatctggcggtgaggggctcaggtggtgaacacaacaatggagcctgctgcagactcatggcagaagggctcagggttggagggcctcggcggcggagcagccagatccacacgatctcggggtggtggccttggcagcggagcggctggatcgggccatttggcaatcaagcgttgatcgctgaagtccgctgctttgcatcgagcgagggagatcgcgattgaggtctgagcgcatagaaacatatcaaacttcaacaaaaatggaaaattatggtcacttgtttttagatcgtgttcgtacggagaagattagggattagggaaagagacaggatttgagggacttattgagggacttacttgatgaggggccgaggcctgctccggcggcggctccgagtaagagtccggcggagctccggcagagctccggcaaggatgcggcagagcggcggcagcagggaggaggaggcatgagcgaagaggtcggccgtgtcggtggggatggggaagaagcaagacccggaggtgggaaagaagaaggacccggcggcggctacggcatggcgcggaggagcggcggcagcggggaggagctcctgccaggacgcggggaggaggaggagcgagcgaggaggagaggtgcggtcttcggggctgcgggtggatgaggagcaatgtcttcgcgcgtgcaatcctcgggtgccaaatcgtgaggtggaaaaagttgtgcgcggatggacggctcagattaatccgggtgatttggcctgtagcattggaggggggcaactcctcctttttatattagtatagatgaaatcagtacaaacgattcactatcgatgggttacaacatcttttttttagataatggatattttatacccggcttcatctatcaaaagatagactcatgccaattataacaaacgttcttacagagtaacacttggaaacaaaaccgagataaaagttcagacgactaaagaccgatgtgtctagctgataaccatccattggaactaaaaaattgcaaagctgatgactcaagatgttgcgatgccgcgatcaactgtgaacgcaaatcctcaatgccgttgcagcttcgcccattaggttacaacatctaccactgaataaataattaatcataccataaagaacctaacaattgagttaggcttacttcgctatcatttaatagcttgaaaaacatgataataaaaattgagctaaaatatgtatctcaatcggaaacaaacggggcacggtagattcgtcatttctccccacggtgctagatacggggggttgatcccgatctcgtgtcgtcagtacgtgctcaacaaccatagggccacggtagatttgtcattcgagtgtgctggtgttggtgacttggtgttggccgctgaacgctaatggtttcgcccgccgtcacgttgcacagcgggggccaaactttacacagcaccgtttcggcgtcgcgagatcaagagcggtgcaggtgcaaatctcaccaaccctgaaagggggaaacgagggttgttgtgtttcacttttttaaattttccttgggcacccaactgttgcgaaccagggttgttggcacttgaggaggtccaattattgtgcgtctcggctagtagtactagttgtctttcatcgctaagggccatttctggtgtctttaattacgtgcacataacgtcacacgatggccatctaattaagcgcctgtcaaaaactaattgccccaattaaacacttgccactactgacatatacgaacaaatgagcaataacggaaggtctcatctcataatataaacagttgcaagtatcaagaacacttcaattttatcagttaggagcagttctgttagccgataacgacatatgcagtattacaggcatacttaagaagattgatgtctacagtactattatctttctgcattctctctcattatatatacaagaccatatgattagtccgcatatcatactcttatttaaaaaataaaaattagttagagcctcatacatgaaaaagaatccatgaacagaagtacctctactttcttttgccacacaaatgcaaaattcatgtcacggtatacaaatacaaaagagacttatacatcagttgtgagttagaaatgtaatgtatctaaagcagtgaaaaaaaaactttttcaccatcagaatgcactacgtcatcaaagaaatattggcggtccgattttctgttacgaatgatatgagccgtcaaattccttgattggcaaaacatcttctatatccttcgtaaaagttctttcacaatcaaacccttccacatccctgttcttattatttccattttcacccctactttcagactaccacgctgccgtgcgtgccgcttccttctcgcccctcgttgcaccgccgccactcttgagaggccaagacgccgactccttctccgcccgccgtctcttgtgattgtcttctcctccccaatgcaaccaccgcttcctccactcccactcccgtcgccgtcacgcctcctagccttattccctccccatctccaaagcgtcgcatctcctcccaatctccaccacattagttgtgggttcgtacttccatgaaaaataaacaggcccaacaatatatcacgcagacaaatcaatggtataggtagacttattgaattctgcctaatcaatagtatagatagacttctcatcccttttaattttatattgcaatctacaaacaaatcaatctaaactttttaataactagcacgaaaaaaatacatgtgtgttacaatggaaaaactttaatctatcatgctaaatcgtgcaacaagtgcttagggacactctgccgccgcggcaccgcggggccggtgaggtggtgatgctagctcataggtaccggttcgtttgaaaccgacacctattgattgtcccacatctttgcttggtggaaaatcatgaaaacggctacctttgagtaactgttggtgaaaacgactacctttgagtatatgtaggtgctgattttaaataaaaccgacatctatgctgtgagtaccattttttagaagaatcaatagctataatatatttataggtctaggtttttaaaaatcgacacatatactaatattgtagttgctggttttaaaaaaactagcaggagctgaacgaatccaactaaccttatctactcccagacatccttatccccacacttgctcccactccttcctcctcctccataccgcctccaacgcgcctcgttggcctcatcgtcgcggccctcctcttccctctccctctcgcatctcccccgcgcagcggtggctgtggctccctagcggcgtgacggctcgtgatctggccctcgagctcaggacctccacaacggcgaggagaaggtctagagaggagcagcggcggcctccccgctctcccctcccacccctctcatctcatgtgtgatttattttgtgattttgcctctcctctcattacctaagtgatttattttgtgattttcaattgaattgtctcgtgtcctgtgatttattttgggatgattttttgatgattccgattatattgggatttagtttttaggttagatttttgatgagttgggcttggttgtgggatctttagagcggacccacgttgacacgggcagacgacagatgaagcggataggaggtgcacacgatgcggacgacagactaagatggtcgaaaaacctccctgaagttttacgtattttttaattagatataaatgtatactcgtagtatatacatccagtaaataataccataaaagttgttaaattttaatgggcctaattaatactgataaaataggagcatgtagttatcaaattcaggtggggaaaccctcccctcctgtcaccaataaaaaaaagagtatatctagcataaagttgtcaaatggccagagttgattcacaacaaacctacgaatccaaccatttggaagtacctggtaataaaagagaagaacatcagatgacgtcgttccaaagcttagcaaaagttcggtgtgaatcttattccagcacgcagcagctagcagttgaaagctgaaactaccaggcaaagtgaaaccgatgcacccagccacccacgcacacggctccaaaatttgtaggccaacaaaaatgtaccgctatgctaaacagtaaacataaacgccttccctaacctgcatagccgagccgttgatccaccagaacttttgaagcacatctgaatctgacgtgaatgtatgtacaattgtacaccctgtatccgactagttaggacatgtacaatgaatattttttaacgaatctaacactttagagtgtgccaatttcatgaatataacatgagaaaaattgtacagagtaaaaagtaaaatttttatacgaagagaaaagctgtgatataaattgtgctcggtctcaggcacaactgcaaatgtgtgatgatgatggagtgagcttctgaaagttgcatgtcgcaaacttaagacgacagttatgcaattttttactaactatagatgaagattcacaaatagacttgaataactgttttctcattatcttagtttggtcacttgttttatgctttggtgtgtttaattttatttgaagtaaactctttatttctttattgagtgctagattgtaatatttagctatagctctattaatcaaagggcgggatgtatctattccattatttaaaaaaaaattatgccaggtgttttgctcctactaggacccaagttttggcctctattttcatgaggaataagttcactttgggtccctctatttgtcgcccagtccgattttcgtcccttgactgcaaaaccgggtataactcgtcccccaacttacgaaaaccgggcacataaggtcctaaggtggtttggatagcggttttggctgacgtggcgtctacgtggcaggtttgactaggtatccgtcccatgtggcattgacgtggcgtttacgtggcaattatatctcggaaaaataataaaaaccatgggcccacatgtcaactgcacaaaaaaataattttaaaatggtggggcccacgtggacccacatgtcagctacacaacaaataaatatggtggggggccccacatgtcattccctctcccctctcggctctctctcctcttcttcttccctatgcttccttctctttcttctctatcctctctctctcctgcatacggtcggcacgaagaaggccggcgcggcggcgcgacggcggccagagcggcgacaaagagcctgcgggccggaggaggatggaggcagtgggacggtgagggaggagcctgagtgacggctacgagggcgcgcgggggaaagagggagggagaggcggtggctcggaggtagactgcgccggtggcgtgcgaggtcgctgcccgcctccagtcggccagcgcgtgctgcctcctctcaagcaggtcctcgcgagccgccgctcctctcccgtcggccgccccgacgagctcgcctcatcccttgcggcgctcccgtcggcctgccctctcgccggcgcggcgcgctgcctcttctccagccaacccccgcgagccgccgctcctctcccgccggccgccccgacgagcttgcctcatccctcgcgtcgctcccatcggccgtcctctcgccagcgcggcgcacccccgcccttcttcctcccacccgtcggccggctcgacgagcttgccccctccctcgcggcgctcccgtcggcctcgtctcccaccggccaccctgcgtgtcacaaacgactcctgcggtcagtggagtcgaaggcgtcctcctgctcgtctctaggtccctttgagcgactcctggagtctggcagatacgtctcgccactgcccggctctgtgccactggaactgctgctgctgtggtcgcggctgccactgggagtagcagacaaccaacctccgttgccactggctggacccctggcggctgacgctggagcgaaggagagagcggatgcgggagctggcactggaactggagctggggctggagctagagctgcgggaattgcgggcggaggtgggttcctgggcgcaagctgaatgcgcacgggtgcagtcgtcgtcttgcggggcgtggtgcggatccggactcttcctggcgctgggagacccttcaactgagtattctccttcttcaggcgtgctatctcatccttcagagctatgatcctcactagcttcccatcgttcaaggccttggacgccttgtgcagatccgagtgcatcctgtccattcccctcatcacagcacacatgtgaccaaaggtggtgtcgttctcgccagctgtcggacggaaagtactgacctcatcaccgctggctcgacgagggtgaaatcggtacgccgtgtcgtggaagatgtagttgtggcgctcccgtagtctggccatcatcaggtatgctgcctcctgacaggcgtgatctgctgtgcctccggatgcctcaaccaccatattagctaggtaggtacccacgtagccatggaccttcaggcggacacggtgaggaagctcgccactgagcggtggaacagtcgtgtactctggcgcgttggggtagcccaccaccagcgtcatgcgtgccaattctgccacaaagtcatccatgccttctccgcggtggttgggtgggtggtcggccatctagagaagacaaaggagtaggatcaatgcatgctcaaatccaaatttaaataaagcaataaaggactcaaataagagaaacgaataagagcggaattttattcatagatcattttgcatgagagcgaataaataagacagacttacataacgataaaataaatgaggaaattagatacatactaataataacaataaaaacataaataccttgcaacccatattcctgagctaggacctaatgcatttcacccatcaaatcccaactgactgacgaataaatctcaaataattttactaaaaccctagactgacttgttttgacaaatctcacttaaacgagcgaccaagatttttctcttgaaccacaagaacatatcccaattttcccggaacaaatccaattgcaaagaacatatgcaatgaaaaggattcagagggctcttaggtttttccatttggcttgtcctacggtcaaggtcggctctgataccaacttgtcacgcccggaaattcccgaatagaattccaagcagaatgtgcattaaaatccccgtccaggaccggccgaggtacacaaacaacaattttgacattcagatccacgtcttacaaacatcataaaagtcttacataaatgcagcggaaaaacgaaagataacaggagctaagccttgacttgatctgcagcgggaacaccactccacaggcatcctcgacggcacggatgaagcctactcctcggagaaaccaccatctgacacatactcgtactctggggttggggaaaatagagcaagactgagtactacccactgtactcagcaagtcataccggaataggggtatgatgcagggaattatcaaaggagagctagagtggttcatttgcataaagtgagcatttataaacagaagttgaaagaattaaacagttgtaataattaatcatattattcatccactgtccaacgctataccacgttgcgacaggcccaaccatccacctatactatccaatttcattagactaaactagggtgagactaatcacggtgaatctggttgaccgtccataaccgcgggcacggctattcgaatagttttactctgatcagaggtgtacaactgtacccacaagaggccggacaggacccttcgcataaccccctctaaccaagcacaccacacctcaggtttcacccccactcctcgcaaggcagcgggcagtcccctctcgtgcctaggtgaatctggaagccgcataggccgtcgcagggcccatctaaactccatcacgcccacccttgcctggatgcgtcggctagagaaaagctacactacaagcccagccgttgcccacgctggcttgtggtaagtacgataagttcttccagggcatcccgcgaaccggtccttaactgccatgggtgcgaccaacaaaaccatgcacccacagcccaccatgtgatttattttaattaaccaacaccgaagcggtgtcactaatccaacattaccattagaacctacagtctaaacattaataggatttttccccaatgtgtgctagttgaactaagcatggctaagcaattcctagtccaaagtctattcatgttataccccaagctaacaaaggagcatgatatcaaaatagcatggctgtaacaataggtaaacatcccatagtaacattataaaacaatgtagtatttgaagaaaaacaatagagcatttgcaatataggatcaacatgttcaagtgacaggcatgacttgccttgctctgcagctggaggaacctcggcgactatctcaaagtacaccggagcgttggaagaaccggaatctaagcgacatacaaagcaaacaatgcaaacaggctataagactactgaaacagagaacaaaaccatttttaatggattctacacatttttcttgatttactgagacttgaatgggcttaaacggagcacggatgaattagttatgaattttagaagattcactgtgttgattactataaaaaaagtccttaaatcatttattgcgcattatgtcccagggctgacgtcatcaaaaagggggagtggtgccgacaggcggggcccgcatgtcagcgactcaaggggagagaggggcgccggcaagtggggcccccgggtcagcggctcaaggctgccggtccaccggaccgacggcccagatcgcccctggggccgatcggatgggcggcggcgacccggctcggctcggctcaaggccggccgaccggccacggcgatggcgatggcgacggcgcgcgcgcgcacgcgttgccggcgacggcaaccggcggcgcaaaggcggcggctcgacccggcgcggctaggagggagagggaggggaataaaggagggggaatgcctcaccaagagtggccggcgtggaggaggacgacggcgaacggcgacggcgagccacgggaggacaacgacagcgggcggacgagctccgagatgccctaagagaggcaaagagagagattagagggagaggggtggaccacggcgagcggaaaccatggccgaaggcggcggtagaggtggtgctcaccggagtgcaaggggatgcgggttccggcgacggacctcgatggaggaggggcggacggggtaacccttggccacgcgaacccggcggcggcgacggcgtggtgcggcggcgagcctagcggcggctagcggcggtcggagtagcggaagcggcggcggcgggtggaagcacggcgcgggagcgatggggagcacgagggagttcggcgagatggggaaaaagagagagggagtggcgatggagcttaaataggggaggggaatcccagacgtggccggtaggggcgggattccgccggccaacgcggggaggtggaggtagagagagaggcgggattcggaattcgaatcccagccatctcgggcgcgggcgcgagtgggatagaggaggaatgggtgcgggaggcgcggcgcatgcgcgggcgtggccgacgtggcccggaggtggcggggacgttggcgcggcggcggtttcggcggtggtggcgacgtggggcgggcggccagaggaaggggacgaccccgacaggtggggcccacctgtcggcgtcccggggagagagggaagggaggcttgggccggcccacaagaaggagggcgcgcgcggcggcggggtggactgggcc

SEQ ID NO: 7051 - DNA, 37850 bp, Oryza sativa
ccgcggccttcgtcgacgtgtgcccttgctggaatcgggccgctgcgaagttttctcctgccgacgatggcgttgagatcggtgttccccgctgtagggcgctgtcaaattgtcagggagggcattgccgccgccgccggcgtccgtagaacgcggctacccgctatcccacgttcagggtttttatggtatgtctttcctgagctgaaggctgaaagcactgatctgatcattgaccatccgtaggacatcaatttaattctgaactcgtccagtgtcccgaatattaattctgaactcgcattgtgatctattgtgtttgaacaatagtatatgagctgtgtgagtcatgagttcactgtttgtttttttcaggatgatctgttgagttctaggcttaagaagctgcttcccggctttatttatccacccacaagatgaatacgtgctcccttgaagatacggtgatcatggtgaagagacacgtctcgctgccgtggagaaattgaatgttagcggtacggtgcaggtatgtgccgagtttctgataaaacagtagtatatgcataagtgtgacacctcaagcaaacaacactatctgttcagctgagtggagcaactgaacttaacctgctacctgctcactagtagaaaaagacagtggctttcagacgtgtacaggatctcacgtgcatgaattgatgaatactgcatatagacatgtaactggtatctcccataacaaatcaatcttggcgctatttcgttcatcatcattcgtttgtcatgttcccttgggagtggcagcatcgatttagtaagaaaacatctctgttgtgcttctacagaactccatatggaagctaataaacagtatactgatacatgaaaattagatggaagatagaattcagataatcgtatgtaccactctgatacctgatagaatcaggaagacaccatcgataacgtttataaactgcgtcctattttagtataatcatgttcataaaccaaatggcatgacactctgacagtaacagatgaacttcttctgactgtttggagttctctcacgaattgaccatggaaaagtatcacaaattacaccctttaacttacatcaacagcagttttagtagctgcctgcctctatgcaaattgctaaatttggctatggcatcgtaacttccaaagaacgttgcaaacaagaacttaaaaaaaaatgaaagaaaaggcatacttattacagcatcagctaagcacatctgtgaacttctgaatttctgaaacacgctaatattttgctatcttctcgtcggtcctctgttcagcaatcagcagatgggcagaggctcgccgttccactccttgaggcactcgagcagtgcgtcgatgtgcttgccctggttcatggcgacgaacaccttgttcacctcctcgccgggcgaccgcgtcttctccccggtcaagtactctgtcccgagctcctcgcggacgaaccggtagagcgggtacgacctgcactcggtgatcctgttcgcctttgcggcggtgccgttctccacggccgcacgggcagcctccacctccctgggcagcgccacgcggagctcctcctcgaacgtcgcgaccttggcgaacaccgaggtgtcgacgttgcgctccgcctcgccgttggccagcgcgtgctcgatgaggacggcgcgcatcttctgcatcagcgggtagttggcgctgcaggggtcgtccgcgtacgcgaacacggcctcgcggtcgatcgcctggagcaggtccttctcgcagaaccgggccttgtggaggtcgccggtggcgctggtgctcagggtcttcctcgccaccgtcgtcacgcagcccttgacggcgctcctgacgttctcttcgaggtggcgcaggtcgatggcctggcatagcgcgatcaagaacgtcgaggacatgagcttgagcacgtcgatggcctcggccgtcttcctggacgagatgaggccgagagagttgacgtcttggttgtgctgctccgcgctctggacatggttggtcacagggttggccaagaactggagctcagagcagtacgatgccatggcgatctcggcacccttgaagccgtagtccaagctcgggttgcgcccaccggacaggttggacggcaggccgttgttgtagaaatcgttcacgagctcagagaactgcgcgaacatgagcttaccgatcgcggcaatggcgagcctggtgttgtccatggacacgccgatgggtgtgccctggaagttgccgccgtggagcgccttgccacgggagacgtcaatgagcgggttgtcgttgacggagttgatctcgcgctcgatcgacttggtggcggcacggatgacctcaatctgggggccgagccattgcggcgacgtgcggagcgcgtacctgtcttgcttgggcttcatcagcgggtcgagctcgccgagcttcttcgccagcatcatgtaggagctcccctccaagatgtgctccataatggcggctgcctcaatctgtcccgggtggtgcttaagcttgtgcgtcaggtggtcggtgtactccggcttgccgttcatgacctcgcagaacaccgcggagaggacctccgcgagcacgccaaggacgttcgcctcaaagagcaccatcgaggcgagcccggagccgacggccgtgccgttcaccatggcgaggccttccttgggctggagctcgaagaagccgtgctggatgccggcgatcttgaacgcctccgcggcatccaccttcctgccatcgggcgtcaccgccacagagtttggtcggccggtgacgagtcccgcgatgtaggagagcgggacgaggtcgccggacgcggtgatcgtgccccggagcggcaagcacggcgtcacgttggcgttaagcagcgtggcgatcgtctcgaggatctcgaaccggatgccagagtacccctggagcagagtgttgatgcggacgagcatggctgcccgcgtcgccgcggccggcagcacgtggccgtcgtcgccgttgccgaacgccccggcattaagaaacctgtcatggcaaccattacaggaacacacgttaggcctctgatccacacaagctctcaccagacgaacagcaaactcttgcggcttcttaccggataagctctcgctggagcgcgccgccctccttggtcctccggtgggaggtggcgccgaagccggtggtgacgccgtagctgtcggtgccgttcatcatgctgttcatgacccagtcgctgctggccttgacgcggccgcgggcggactcgtcgagctccaccctggcggcgccggcggaggccaccgccgcgacctgcgcgatggtcaggctggcgccctcgatcgtcaccacgggcctgcggtactcctccaccatgcgcttcaccgcgtccagatggctcccggacagctcctccgccgccttcccccagttgagcgggtcggcacgcggcttagccacgcacaggctgctgccgttggcggcggcggcgacgtgcccgttctcgcactccatcggaacggcgaagcagaggggagatcgatgtgtagctgtaacgagtggtggttgctcgagcggtttgctcccgatggaggtggaggagttgtgtgtgcggaagagccggggatatggaagctgcagtggctttgctcttggaggggaatggagggagttgtggggagtttaaataggaggcgcaggatgggtgggagtggggagtgtgggttcggtgtggccggttgggttgaccacgggattggtgtgccggcgcgagcgagtttgggagcgcaactacgggccgggtgggcgtgtggctacgtagaggtttcgtggtggtcgtggcgtgccctgtgccggttgggctcggggaaccgaagcggccgatgcggccgccagtgccgggagtgcatgcgggggaagagagagagagttgcacgcggcagcggcggcgcgggggaatacggggcgtgaaacacctcgcgtcgtcacgccacgaagccacgtttggcttgggggcgtctctcgccgtttctgcggctgctgacggtcctcgactcgtcgtctttcgtttcgtccgggcgtccgtttatctggaagggctgtgaactcatatccagatatcatttccttggtcccccggcttatctttctctatcgctttctacttcgtgcaacacgtttgtttaggttttgtgttctagttacatattccataggtcattggttctccgcacgtaggtgatgggctgatggtcaagcggtctgtgtacaaacaacaaaatttttctggggttttgggggtgcatgaggggggaaactacggcacaagagaggtaccaatccaattgcgcggtcaccagtcccccgacaaaaactggtgttggcataaccctttcatctgtctttagcaagtcctaatggttcataccaagtgctagtattctctccgagctttcgttctgcgcaatacacacctgacttgactgagaaaatatagacagttttttctcagaactagtataatgtctgtgcgacagaaaatcttttaaaaaatatagtttattgtgtatattttaaagaaaaaaagttaattatactctcaactagctggtggcccgcgcaactgcgcggctagtacacaaacaaaattatatattttttaagtatgattttgcttaaaatttattaaatagctatttcgttgtcttaagactttgaaagaccaaaccttatcatctccatatttctaattatatggtttttaaagtcacaccagctgctacgtcttacttttctcatatcattttttatttgcttgctcaatctaccactatttctattcattctccttgaaacctttaaaaataggatcttatagtttttagagtttagtgtctcgttgggtttcgtttttataatttctataagtcccgtcaaacgctgtcattatactcctctatgccccgtcaattgtcttttctatttattatcattgggattttaaaaatcgaacataattatcattcgggttcattttttactttctagaagtcctgccaaaccgtcagttgctttgccactgtactcctctacggcccgcccgctgccgcccttctttattgtcattgagattttaaaaatcaaatatgattatcattagggtttatttttttattttttagaagcccgaacctttaaaatttgaaccttatagtttttagagtttattgtctcgttgggtttcatgttttttataatttttagaaaacccgtcaaacactgccactatactcctctacgactcgtccgccgcatactctttattgtcattgggattgtaaaaatcaaacataactatcattggaattcattttttactttctagaagacccaccaaccatcggcggctctgtcattgtactcctatacgacccgcctgctgcctctcatttttattgccattgagattttaaaaattaaatatgattatcattgggatttatttttttttactttctagaagtccccgccaaccgcattaaccgattgcttcacgacctgcccgccgtccttccttttaatcgtcattaggattttatctgattatcaaccaccaccactctgcttctctctagccatgttacttaattaatctcgtcatgtgttttagatggtcttttctttcaatagtcttatttttttatcaccaattttagttatttataaatggtatttctagtgagatcttatttttctttttctgatttcagaatttattttatttttcgtattgtgttcttttgatatttttattttttattttcaatttcagttgtttcaaaattgtacatattttaactctctttttaatttgcctaattttggatcttttttttattttttattccgaattttaattaatctattattggattcttatatggactcttattccaatattgcttatatttaattccgaatttaagttaattttaaattgtatttctacttgaactcttcttttttttattttttattcaaagttttaattaatctcatattggattgttgtatggactcttatttcaatattccttatttttaattccgaatttcagttatttttaaattgtattcccactcgaactcttccttttctttttctaattttgagatttattttatttttattctgaattttaattaatcacgtattgggttcctatatggactcctcttttaatattgcatatttttaattccgaatttcagctatttttagattgtatttctatttggattcttcttttctttttctctgattaatgtgggaatttatagcctccacaatgaatgtggtgcatcctttcaagactgttttaatattataatagatagataagatatattatcgtgatgctacttttgctatcggtttctatgcacctactaagctgtttgtggcctatgaggttgggagatagcgaaagtcttgcctcactatgttgtgggtctcgtatgctatttgggtggtggtaaattcatcgccactactccctccgtcccaaaatataagggactttggagggatgtgatatatattccagtactttgtctaaattcatagaattaggaatccctccaaaatcccctgtattacgggacggagggagtactactaggtgaaaccccgcacattgctgcgggaatttagtatgataacaataaaaaaataacgtgtaagatagctagataacatcagattaagtaaattaatgtggtttatgataatttaaatttaaatagtatgtagaatggtgattcaaacgtaaaaagtaaggtggtatcactttatgaaagaagaaaagtagggagatagtttggactgtagattaatcatctaaaggctaaaaacaatcgatgtgatatgacttaattagagaaaaaaaggagaaagataatttataccatagattaattatttaagcactaagtgaggatgaaccatataagtatataggatatcataaaacataataaggatatacattaaaacattatgtgaattatgttggatgataatttaacatgtttgtatttgaaaagctcttaaattataaaaactataaagatatagtatgtttgcatgatgtttaaatgtgattattgttagtggatgatgacgtggcatcttgttagtggatgatgatgtggtatctttgcatgttaaacttaagaagttagtgggggataactttatagcaagataggattagtatagatcttacgggtggggttaggaacacctcctctcaggcacgtaaatcaaagcacacattaacacgtgattaattaagtattatctaaaataaacttgaaaaatatattaaaatgattttttaaataactttattgtagaaaatttttgcaaataaatgcaccgtttagcggtttgggaagccttgtgaaaaactaggtgacgttgttctctcttttcattgaacagtctacaattgcgctgtttgctattacgaagattttttaagtgtacgttgtggacgaactgagtctgaaactgcatcataacttccagtggtttctgttcgtcattttattttccatcttggacttgcagtcgacctcgcccacttggcatgcacatttgcaaagtcatctttccctcttccttctgaatgaatatgcgactatatgcatacttgtttcttgtcagtgagtgcttgagtgttgaatcgcatatttttcctctgcacgcgatggcaccgaaaatgcgagagaaattacaactccatttctccctaattctaaaagcagttggagtgaagttttccattgtgttagttgactaggctagatgctagagtggtcaagtcgtcagacatgtctgaatcgtccaagtctggaatgccgcagagcgtgttttcgcccaggtcagagtcatgtgcttacgagtacatacttttgctgagttgcggtctctcgaaaaagatttcaagttgacctgtggactgtggtggcaacaatgtcattgcaaatgtgcaactgcatgcgtacgacactaggatcaaatgggtcaccgtacgaggaaaaaaaggagggagatttcgtggaagtgcttatggcatttggtgttctagattttctatcgaaagtccttcaactttagttagcactgattgaaaaggctgtactacctcttaggattagtacatgcatgcaatttctctcgaaccagtggcaatgttccggttaattcaggcgtaatttacgtccgtgtgcccatcaaaatgttgacagtaacatgtataccgcaaaatttgtagggcatttacaaaataaacgggcattaagattttcaaaaaatgacaagcatttaaatgtcataccacataataaggggagaaaagatagatcctgccaacgaaatttgaaagggtggaaatcaactggaaccaaccatttcatcccaattttctgaagcttgcatgcaaactgtaggaacatattgacaattttgacattggttgcttcgtgtagtcgtgttggtaaccatgttatatcaagctgagaactgtagtcaaatcatcctctccttttttgccaaaaagacgctcacacttgtctgcagctgtgtgagctgcgacagagaaaaaatttttcgaggaaagctgtgagcctgtgacagagcaaatgtaatcgacttatctgatgtttctcccgttttcagctgtgatttgcaaattactcttcagcatgctttccccctctgggcctctctgggtcaatttttttaccgttgaccttacgtacattggtcaaatcatggacagtaaccaaaatgataaagacaaattaactcctcaattggccgaaacataaccattttcggtatcctcgaaaaaaagaacatttcatgtgttgggttggtgagacacgttcaatagtaatggaggagttcaacgatcagcggcggcctaagcagggaaacggccaccaacgctttcgtctttggtcgtaaaaggccttcaagtgttgactcgaagagcgtcctacgctcctgctcacatctttttttaacacgtcgttttgaatttgtgcagagtcattatttttaaaactatacatgtataaaatatataaaaaatatttatgacaaaattactaatataattaagcttcagtttcatattttaaatcctaatattttaatatttattaatgatttaaagttatgttcgactatatatatttcaccatccttttaaaaacagaagtactttcaagtttttatgtccttgccccctttagaggtcaatcaccatctcgtaattagttagtactcccttcgtcccgttcactaagatgcgcacctattttacaattcgaactctttaaatattttattataaattaaattttattgatgaaaataatatcgttgattgtcatttaatttttctttcagatgattgtgattttgttactataaatatcgtagtatataaaaaaattaaaattaaagagtagttttaaaaattatgttgagtctaaccgtgccttagctagtgagatggaaggagtactagatcacaaggcctatcgtttggcaaatatttatggaaaatcaatcgaatttgattagcttgtgttttcttctgttcttagatgatttttcaccaatagtatgttttatctcctagctttgtttggtttctcttggtaaacaaaatggatagcggcagccaagaggtacgcaccaacggtccggcgaaaaagaggtacacgcaccaaccttaggacttccagagaaagtttgaagacattaaaacattcaaacttggaaggatgttcatacaagttctggtagctacagcctacaatccttgaaaaatgctggaaaaactagaaagctctacaatgcttggtaggtaatcaaatgtgttcatctgttaggtgttgcatggactcgtgttaaaccgcaccagacaaccctctcatctgcgcctctgttcttcagaaaattgacatggagatgtagcacttgtaaatcacaatggtctacgtgaaagcctccaaaacaatgtatagcacgtcatcactgaatctacgtaccttaattgggtggtcacactataacttccacaaaaacaagagcctcactccggtgctttctacttatagtagaaaataatccgagccgttgatcgtatataatcgtagggttgagatctaattctactaccaccactcatagtggtagtagaaacgtggaggtgtatatttgtccatagataataattcatgtaagggtattatcgtaaattattattcagtaactctaaaccttcgccattctcaagcgcctgaccccatccatcgttgacttcgtcgcttgtccatctccctctccgcctccatcatttccagcgcgatcgacatctcctccccctccagcgaccaagggtggcccttctcctcttcgccaagccgctgaaggtccttgcccacggcggacgactagtcctgccatgtagctttgaccaagacaggagatcgccgggcaattggacggcggacgaaattcaacgggttccggcgaacggcggcgaggtaggaggaatgggcaactgggaatgaacgagtgtagtatggggatgtggtggacggctcggattggccaagaaatgagctatggcagccggcgacgtgcggtggcggagctcgagtgaggcggtggcatttggtcgccgccggcgaccgtacgagcggctaagggacttgggaatgaggtgtttggatgctacatgaatagggactgtgcatgacttcacaagctgccgcggagctaatgcaaatgcttttgcataaacacgacagtagaccagggagtttgcagcaaagagtgaatcaagatgttctaagcccccattagtagacattgtcctatgactgaaaaaaaatcaatttagtggcaattgagggcttagctacccccatatgagcacaagaaaggaatcatgtagcgatgattcagagcgccagaatatgacagaatgcagttagatgtttcgatggtatgaaatataaaacaaatcctgaattacagctctgactgaaatgcaatttacatatgggcaaaactctaatagtgaaaaatctcatttaagcagtttatcagattttttcagtctcactctttcaggagcaaaacaacttgtttactgatccaggagcaggatgacatatttcagttcaaattgcttggattcatctcaccccatcacagttgcacacaaaaaaaatgcacaacacactgacatggtcaacacattgacattactagtagtccatcactattcaccttttcttttttacttaaaccattactgaacaatgaatatattgggacagtcacaagatccaataaacatcagtatctcaaagctcatcaattagtcaatgaagtattcgacacaccatacaactgaatattacaagcagaatgaactgggcaggccttcttgttgtcacggagccacttcgcgatgttgcaatcctcgtggaagtcatgcccgcaggagagcgtgcggacagtcgccggccaccatcctgagctagcagatcgggcatgccacatgcatcgttcagcgtccgatccagtgtcctgacgccgccgcgagcacggatgtgctgaaacctctgagcattgcggtctatcaggttcgccggcgacgccttccacggcaacacgcagcaagcgacactgttgcatattctgcatctcatgccgtgctcgcggtcgaggaggtgctcgccgatgcaagccacaagactcgggcacgcacggagggggaccggggatacggcgctagaatgtatcgcagctgcctcccaagtggccgcagcccacacaatcggagcaacacggaatggagatcactacccgccggcggaatggattgaatcctccaaagtgggcgctgccaagaatctcaggtcttgcgcaggggctccggcggaatcggacgcgcgcggaaggccactcgcagcggacagaaggccacgatggcgaaccaggatgccgacgtggaatactggagaggaggaggaacggatagacaggtgagaggtgggaggaggggacgcctgagggtttcgccgcaccgcgccacggcgtgccgggaggagtagcgataagcaacgtgcgtcgggcgagatgcagtgcttttcgtcggacctgatgcgatcaagccaagaccgaccgagacagagaaaatagatcctgccaaaattgcccctaatatatattaggagattactaatctaccctttaaaatgaacggtcgagattaattttacctgtagtataatactccaagtagaaagcaccggagcattgctccaaaaacaatgatggtgactacagtaccattattgcctagttctgtttctttggacgcaaggtgcttttctttaaagaaacgtatttttgaattaaaaatgtcaatacatgtttttttaaaattacacggtacaacgcagatattcataacgcacgcacgctcacctctataaacacacgcatcaatacatgtcgttgaacagaggtcacattctcggtatctccacgacggcgccttccctgctctgcttagctagcctgatctcgacaccgttgatgaacaaggcgtgtgcctgcgtggcccatatgcgattttgcaactacgagagtatccagcgtggataacttgacacttccgctgtgccgggcggcaactgcaactctgcaagcacgtaactagagctaggccggggcgacgcggccacggctgcgtcgatcgctgcctctaccacagaaccgcatcgatgcggaggtcggtaggtagtaaagatcggtaggtggtagcgagtggcggacatgggcgggtgggggtttgagctggcttggcacgccgcggatccacgcattccaccaaacacacatcccccccaacgggcaacgggtagctgcgctgctagcgaccagcccggccgggacgcgtgcacggcgatgttcacgctttgcgcgcgcgctacacgcccacacgacgcagacgcagcacagcaccaccaagcccttgcctctgctgcgtgccaaattcagcacgatttttttatttaaaatatttaaaaataaattactgtttcgacgttttgcaaaaatatactcctcccgccctaccataggacgtgccatataaatcgtcctatagtagagttatagagcaatctatataacgtggcgcctcgctaaaggagtgtgcaatgacaattttgtagacagccccttcccggagatagtgtgatttatcgctgggagggggaccgtctacaaaattaacacggtgcaaagtttggtgatgcatgggacgtaccatagaaattttgcaggtgacgaccttcgagtgataaagcgtcatttcttaggtcaatttatcctcttgggccgcctgcaaaattattatggcgcaccttccaacttccacaagatgtcacatcatatatattaccttaatgtagagcgatttatatgtccaagccctgcaaaagggcgcgagaagtatatttcaaactttgatatgagaatttattttttaaatcttttaaaaataaatcttttgccaatacttttggtacgtcatccgtgtttgaatcggtttttaagttcaatttctttaggaaatatagatccgtgttagagtcggtttttaattttgtttgtttttagaaatacagaaggagtcgtataaaaaatcttttttaaaaaacttgcatgctaacttgagacgatcggacccctaattgtggctcatgattttgtaaaaagaatatccaagtgaattcttacggtgaattcaccttagctaaaccgtacaacaataataagactaaaatagtattcacccgttgcaacgcacgggtatttttctagtaaacattaaaaaaatcagcccaagcaatgtgccagtgtggccgtttgggtgtccatttgcgagtgtgaagcaccgtactacagcacaggccgacctgggcaaccatcggttttccaaggcccaaaaggagttctttattaggccggtaaagtactaatgggttgtacacaaggccggtccatttaaactaggaataagttcaccggagatccctcaacttaacagcgagattttttaggtcccttaaccacaaaaccagaaatgtctacccctaaacttactcaaaccgttcaccggaggtcccttggcagtatttttgccccgttttgctgacgtggtatcctagtaagcaaaaaaattttaaaaagtatgtggggcccacatgttagttgcacatctttttctcttttcttctccttctcttctcttttcgcttctgtcctctctcttctccttcaggctggcggcgggcgcagccgcgatggccgagcgcaaatgcgggcggccggcgagcgcggcagcagagcggtggcaggctgtgggcggagcggacggcgggcgagcccggcgacggagcggaggctacgggcggagcagccgcgcgccgtgtccgccgtcgtcatcggctctccactgtcgtcgtcgccgtgggcgaggctacacggtgcggccgttcggcggcatcggccaggcgtcgcagtggccgtgcataggtggctcgaagtgccggctgacgatgcaccccagtcgctcgcgctcctcctgtgccgcggcagcggcagtggtggtggcggcagcgtcgccggcctgatcccatggtcctcccggacgcccagctcgtgcagctgtagcaggagcgtgtccacgctcggcgtgccatcggcatcgtgaacggtggtcggcgcgggcgcggtgaccctcgtcgtcttcgccggcgtcgcggtagcacttgacgtcgtagctcatacgcatatacgccgggtacagacggccgcatgtacatgcgtcttcgtacgagcatatatatgcatgcatggagacgaccagctatagcctagctagcttcttgttggtttgccgcccgataacatgcagacgtatatattagccaagcatgtgtatatggctgagcacactcgcatgtatatatgccattacgtgaagcggaggagcgcggatgcggggggtgcagcggaaggcgagcgcggcagaggagcggcggcgggcgagcacggcggtgggcaaagcagcggagggcgagctaggcgaagcggaagacagtggatgggacgaggagctcccccgtgctcggccgccaccaccgccgtgcccccgcgggtggccgacgatgctaggagaggcaccaccggcgggagaaggggaagaggcagaggaagagattgtttcttggtcaccggccgcctccccttccctcctaaactcgctggtcgccgctccgcagccgcgctcgcgctctgctactctgtccgcggcctgctcgcgctctactgctcggcccgccaccgcgcttgcgccttccgctgctatgtgcagttgacatgtgggccccacgtgttttttaaaattttttttgttgactaggatgccacgtcagtaaaaccgggcaaaaatactgccgagggacctccggtgaacggtttgagtgagtttaggggtacacatttctggttttgtgattaagggacctcaaaaaatctcgctgttaagttgtgggacctccggtgaacttattcctttaaactaaaccagggacactgttatatttttgcgaaaagagtccactttaggtctcccttcttgtttactgaatttcaaaaacatccctgaaccacaaaaccagatacaacacatctcctaacttacaaaactaatgtacacgaggtcactcgacagtattgtctctagttgtggttgacgagacgtctgcgtggagttgacgtggcattgagtaaaattaaaatttgcagaattgaaattaaatatatggagacctatatgccagtcaatcaaaaagattaaaagaatatgacccatatgtcagtaggtcctactttctccagctcaccctctctactcctatctcctctcttcattgggatcaagactaaggcagctgttgaatggaggcggagagggaggaggccaacgagcaaggtggaaaaagaggaggtggggaggccgacaagggaggtagggaggccagcgagccggacggagagggaggaggccgccggcctcgcgccttcttccacccaactctctctctctctctctctctcccccccttcctgtgccctagagagcaagggcgctcggtggcgaggttgatgcctaacgcgatgaggttcggtgcggtgatggtggagatcaagcgacatcgcctgggagctcctacgctatcacaacctcctgacgatatgggtacaacgtccatgggatgagaaccaagttaaactagacatgtagctaccatgtcagccgaaaccatcgtccaaactgcttttggaacctttttcattccggttttgagggacgaggaatacgttgtagccggttttgcggttcaaggatattttaagaactcaacaacaagatgagggacataaagtggaccttttccccctatttttgctcctttggactttatcctattttcgctcctttggaacaagggattttcataggaagtttgtagaattgaaaccccatagaaaattttcatattgggccctttgatttgaaggattgggctagaaatttcccatagaaatgcatcatttccttcactttttggtggactttaaagagctcaaaccttatggtcttgatttcctttggaaagtccaataccctatctttcttcatctctcctctcaactctattcttaaataatgtttttcatatgaagtttctgtgtggagtatccaaacggtttatttgacaaattcctgtgttttcaatttgttagagttgtatatgctatgacattcaattcctatattttttttattcatgtatttttcgattactatattctaaatgggtgagagtatgcatagtacacgacatggcactatggcaggtcggtggctgatgcagacatgcaactcccggagtgccggttgctccgctctagaagacgatggctttcttgtgtgatcagtgatcacctttcacccattgattctgtgggggagaggtttttttttttaaaaaaaaaacctttctggaacgtatagcgtgcgtacggagtatagaattaaacgaagtagctcagtgacagtatacatgagtaaatgtaagtctggattttgattcggtttgcactaagacatcattcatctgtaaaaggaaaaaaataggggaagattcaacagaaagattatggcaaaacaacgagtagttcaacacaattcaccactgacaatcatggggaaaaaaaaaggaacaatcctcctactaaagtagtacaaacaaaggagaaattggaagtttcaacagtgtgaaacaaaccaaaacaacacgacgcaccctgttacttgcctacttgggcggggtgggcggtgcgaactgctgcggcggcgcgggcggtgcaaactgctgcggcgatgcggcctccgcgcggccacggttccggccgagcaggtagcaccccagcgcgatgacgagaaccaggaggatcgccgggatcgatatcacgagctcaaacatggatgctgaacaatgaatagccccccgcgcctcctcttcacctcgatccaaccctgcgcttccgcgaccgcgcggtgctagacgaaaccggaaggcgccgacgaacctggagaagacgggcgcgcgaggccctctatggcgagcggtgcaacttcccagcggcagcgatgcggttccccgtcgcgaatggcaagggacgtcgcggcagctggcaacttggcaccgtcgtcacagtggctaaggttgacgctccggaacgaactgtatcaggttagataatctagagaaaatccaacacgccggaagcctctaggaggggggctatagatccagcaacgaaaaggacgcgtaagcaaccacgatttggacgtctttatttaaccaaaactgtttcaggtttctgtcgtcctgattgagcagcgcacgaaggaaaattgacaaatttttaggtccttgagagaggtaccttctggcaagtggcaactgatattgagttgttccaacttttacactagtagatatggtacttcccagtacctcctcaaaaaccatgaaatcacccaaggaaatttgtagttttgtacacttcagatcgcctacagcagagcagagcaatggcttgcagctttgctttatatagtcaatatgaataccggtacaacaattcagtgtatcaaataatgactacggactacctgtatcagtgtatctcattgtgtcaaatgatcgaatccaatctaaaatttagggtagagaattgcaaatacttggcatactaatgcggttttctcggaaaacaatgtgacagcaatcacggacaatactatgggtccaaattacaacaaacatctatttttcacatacacaagtacacaaccaccaaaggcagcatctagagaaggaatagaaaaaggcttctcagtaataaacatacctcatcagttcctctctggttgctcagtttacaactaaataaacaggtgaaattacatgttaaaactggtcaaaatatctcacttgcttactgcaatttcctgccttgcacaagatagttcccaccttgcaaaatggtcttcaggttactgcaaggcatagataaacaacgaaattgtcttacactcggatgaaccagagaagagatatctcatacctcgacagtttccaaagaaacttgtagaagtggaagcttcaatttgaagaaaaaaaaaaggtgattgaaggattcccatgatgggtatatcatactaaaccagcatgtcaaatggagataccgtacttggattggcatactattaaggtatttcctactgtcattatttatgatattgcattttgcttggattcaaattaaatacagattgaaagtatcatactactgaacattggctttacaggaatgttcagggaaaaagggccgggaaactttcagcacattcttaccagccaacaagaaaggtaaatgaatcacggggaagaagattgtacctctgaaagaacccaaggacataccggagaatgtaccatagaaggcaaagcatcaatatatctgttatagtcaagtgattacatactaataactcaaagctcttttcagtttgctgagattagagacaaaccatgtggtttgccaaatagtataagtacagatatttcattcttttgtttcgaataagagatatttcaaacattctttccaagaaatacgaataaagaacatcccaaagctcaactcccacagaatagttgatagtgcaataaagtaaaaagatcactccagattacgaaagaagttttgcaagaaaaacagattaaagaagcagaaaaatcttggttgtaggacaattaaaatagcatacagtttacagaacaaaaggttgctagaaaagaaaatacattgttttgtagtgtcaaaggagagtttccctagcttagttctatgtgctttcaagaatctgttggtgtttcacgttcatttcgcattccatgtcttgctttctttcatgcaaatatgcatgtcatccacacatttcagattttttttaaaaaaaaaacaacaacaactagccaagagcccgtgcattgcaacgaaaaaaaaatagttcctagcttattaagtcaattaagcaaatatttagtccaagtagtatttttatgattttcattgaacaaataggtgatttcaaaatttgggaagagccagcaatgaaacaggagactcattggagggtggattgtgaggcccaaatgtcggtgataggttgtggcagaacgaccaccaccactatgaacattttagctagtatagatacttgtgtggggaaagctcacttatgtaatgcagttagtttatttttagataatagatcaatacccggtctctacatccaacaaggatgtccatgctatgttgttagcggcagtagatattggcccttggttaagaaaaaaaatcaggagaaacgagacttaacttacagaacagttgaccaaaaatccatcaagtacttagctttaaaaccgaatactaatactagtttttgccatacctaatactcctaagagattctacaatcccgaatttgaaaaccaaactaattcctcaaaggggatcctaagattccgaacggcttcaaaagataagatcatacgttcccgataacaagactattcttttttctttcacagacaccacgcggtgaaacggacagatatcagaatccaataatttcacccgcgcgggcttctcagattcagagtcaaaagtaggagataaaactagaccgaacaagcagcagatttgaaggaacaaggaaatcagtacaggggacaagaggaagcaggcagtggaaggatactgaagaggtagcgctcccaccaatcgagcatgtagagaccgacggtgacattgtagatgtggatcttgcgcccaatccagttcatcctccacgaggaacccgacacctgcagatcacctcgctcagatccggagggagggagcggcgccgcggtggggtgtcagattttcagagggggaacagtggcaactggaaggagtagtagatgcgaacgaagagaagggcttatttgtacaattcggatctaaataaggggcatattttaaaattgttggtagtggcccagaaaaataagttcactttagatccttcatcttcacatcgagtttgaattgtatccttaaaccataataatactagataaaacgcatcctttaacttataatacccaagtacctgaggtcgcaaggtagtattgtgcctagtttcgactgacgtggtagctgactccacgtgggacccacatgtcagtggcataatctacttcctcatctttttcttgtctctctccaagcggcctctaaggcatgcggtcgatggggagaagggcggcgagcagtgaccgacgagaaaaagagcggtggccaatagagaggagctaggcagagaggggaaagctcaagttaggacacttgtcctatcctcctaagttaccattgccgctgttgtgaggagctggtggagatggggaagcataggcttgacgaggagagtgggaggtccaggaagcatggtgtcgcctcaccgccgcggcctccaaatccgcacgatgctctgccattgctagcagcattgacgattgagctcaagtgtggccaccctcctcatcgtctatggaggagcgcaaggacttggcagcgtccagggacctccccatcctccgacgtcgataggatccactggacgggaaggagcatcatcgacatccgctaccgccactcccgcctggatctcaggttcttagtaaaggtggcacgacaaatctggcaaatccattgtggccataacacatggaatagtgtcaccctttcatctatcgcctgcaacgatgctgcccttccagtctgatggctggtctgcacagctgcccgctaccatcgcctcgcctcctttctccccgcatcgaccgcaacaaaggcgccccctgccacccaactcttctcccgtcgatcaccgctcttctccccgccggatgccacccggctcctctcccatctaccgcagcccatctccatttccccatcggactgaagacctagagagagatagggaagagagggtagagaggaggaagaaggactaggttactgactcagccaggtttactgcaatcaactcatcatcagctaaaaccaggcatagtactgccaggagatttcggatgtttcggttttagaaattgaggtacgcgttacatttgatactgtggtttataagaatgtataataactcaacctcaacgtgaaagtgaggtacctagaatgaacttattctggcccaaataagaaccggtgcaaaaacgccatcatatgggccgggcaatagcaggtgaatcgatcgatataagctttcatctgggctgttatgggcgggaccgaagcgaactcttcctctagcttcgaactcttgcacggagtaattgatatcctgattctctgcatctttttcagaacatatgacgaattcaaagctcgggcatgacctcatgaatttcatttcacgggttgtaacttgtaagagcaagtataatagtgagctataagattactataaacttatgtggagaagagatgtaccaaaaagttaaaggtgttggctctcatgcaagagctagcttaacacaagctccaagacatatacaattagagcaagtataatagtgggctataagaagtctgaatgctgaggtggatgggagaaaagaggagagagatgagaagcgggctgtaagtttacagccggcttaggcacaataaccaagaaaatttgtgagatagacatgtgcaccatatatttatagtgaagagctaaccattatatgagtgagctgatagataggctataagtaagcagctggctgtattattatccttgctcttaatgtataagtgagagatagaaagatgagaagaaaattgtagtcaaccttataactaatctattagagcaggtacaatagcaagctataaaccagctataaccacatatcgagaaaaaaagagaagaaagagaagaaagcgggctacatatttgtagttagctgcaacatggactccaagacgttatgtgtgatgaaaggtgggaccgggtattaatggtataatatatttttatagttaactattgtataaatgggttattagattagctacagttgttttggagccaataattggctatactattaaacttgatcttatatatgttggctttaagattggctaatagtaggaagtgggctctattattatccttgctctaagcattagtttcacgtaggtaggtgcgtccagttaacttgacagcgtacctgtaaactccacgcaccggcaccgccggggatgttcaggcgctgtccaacttttaggatgtttatctggcatccatacattttcacttatttcaggtggagtctctgtaagtctgtatcgtatcataactctgatgatggttaggtcacacattttcactagttcaaacagagtctctgtaattttaagtctgtatgacatcataactgatgatggttaattaggtcattcattttcactatttcaagtggtctctgtaaatctgtatcatatcataactgatgatggttcagtgcgaccgggccattctacgttcgcgttgaacagttcgtgtggtaaacatctcatcagtaatcacaggaatcaggacacaacatttaaaccaagctcttcctgtgcagtttaaatccgggtcatcactagactactcgaggtcgtcgcagcattgcagcaaccatggcttcgcctctatctgctctagcacctctgatcccgcccgctccgcaggtgccagtgccagtgccactgcttcctcctcctcttcccgtgccggtgccgtcgccgctgaactccggcttgcagaaactgtagtaaatctctcacgcatacccctgtcgatcgttgaaacggggggtttttttttaacaacattcggtagctcgtcttgtttgaagaaaggctacagttttactcgcttatatatgcatctgtttggttgtttgttggttgcaggtcgaggttcttgtgctgcggttggcttgttctcatgctgctgctgctgctgcccaccaaagcgtgagctaggatacctcttctgtagcagcggttgcagccttgcaggactgaagaaggtgacggggctgaggaatcagtcatatatccgctgctgatcgatgcattgacgctgtcgcacctgcaggctatactctgttgcggatatatgatttctgtgtttctaaaccgttaagtcgttaactgtgtgcactgtggtgctccttataattctgttcgtttgagtacctgtgaattgtgatgcatatctgtgaataaaaggagacgtgcttgctagcgtagtgtgaggagtgttcattgactcattgttcaacacttcaactcctaacacaagttcctctttattgcttatttttcacccgtaaataaataaaacgccattatcttggtcttattagaatatctttagcatgctactagctgttgatttttttttgagtaaattgccatttggtccaccttttattacccaaatttcaatttggaccacccttaaacctatctttttaatttggacagggtaaatttaccattgttgcggtttggactaccatgacaacttttctcgtcatgtttaactttcctttcggcaaacatatgaaccatatatagaggagattggccgtatactagagctgatgtgtttaaggtcgttgattgcatgagaaaaaaaatcattcgtggtagtccaaatcgcaacaatggcaaatttatccggtccaaagtaaaaacatatgtttaagggtggtccaaagtgaaacataggtaataaaatgtggcccaaagtgtaattcactctttttttttcaatgaaaaacgcgacttgctaagttagatcgttacctcaagtccacatcccttgcacattttcacatcttgttacactggtgatcaaatatcgaactctgttgacgagtcttgactctttgggccgatctatgagttggacaggatcctgttaaaaatatagttcgccttcgtcacggggaataagtccacttttaaccccccccacccccacccccaccccctacgcaatatgatttgtaccctcaatcacaacatatgatattttacaccccaactattaaaaccaataaaattttattctcaagatagtattcacagctaatatcatttgtttggtccacccagctaaatcagtatgtgaggccaaacatcgcctcttatttgttttgtatgtctcaaataccaattcaaatagtaatttaaaaaaatctaaaaacttgacaacattgatacattactcatctatcatcctgatccacagaccgaggaaaaaaatacagctcggttagtaataatactagaactaaaaaaggcacccttctctagtagtggactatgggcaatcataacccatagtgtctataagcagtgtctatggtgccatgtcaataagacatcacaataaaaactacactctacaacctatggtttcttaaaatggactattaataaatacatcatctctcttctctaccaatcatatttattcttcatttattatgaagacattattctctcccaatgtaaaacttgatagtgtctagtgcataggttctcgtgttgaagctgtgtcttgcatgagacccagtttcttcctctcttcactctctctcttaattaatatagtgccaaataagctaaaagtcctatatggcaatgtagttaaatgctatagacactatcctaggtggaggattgagactgccctaagcgagtagttcatgagctggtttgtttaacttaacaagttaattaaaatactaactcggcttattaattatgactacagatttaagctgatccataccgaactcgaatactcgatacgagcttcgagcttttctattccacttacttccagtactagtcaaataatctgctttagttatcacactatccaatcgatagaaaaaactagagaaaattcaagaaatactattgacaagcgttcaattccaaaaaatatcatttataaatatgtgttacatgaaatgtcatcgtacaaacgattatgttccaaaaatcatcgccgttagggttccgttaacaactctgttaaatgctatatgatgaacaatatatttaacgacgcgggatggacggaaaccttaacagtaatggcatttctgggacaatttgtatgatgacatttctggtatttcttggaatttagcgcttgtcaatgacatttcttgaatttttctccaatactaaacttaattgaaagactttgttcaggagcagtgctaagtaaaagattaagcacttgtctggcttattatcatttcaaaccttaccaatattttggtaacactaagatttggtattgtcaaaattttgataagaggcgtacgtgattgtttggtttggatcaatttttttttaagagcaaggctcttgttcgtttttcttggcaaaacttcagccgtgccaattttttgggtagcaatttaaattccatctaactttgttgacaatgtcattttttaattttggcacggtaagtttggacaccaaacaattgcttctagtacgatgcaattgtcggggtccaactcagtagaagtaggactgcgctaactaattaaagttctgaaccgatcagcctcataattggttgattcacacaatttattattggtccccttaagtatatattcgctgtaattctgcctcccccactggctatgctctgggctgacatggatcagcttgccactagaattttgcagttttgtccttactaactattaatgaatgcgttcccggtttttaaaacggggccactgctaccacacgggagggacgaagcacgtgcatgcttaatttggaaccagtggcactgtggtctgtggatcgttatctgtactacctccatctcaaaatacaacatctcaaaatacaacagtatattccccgtaaaaaaaatacaacaatatatagaataacatgttagaaaattgatagaaaactttaaaacatttaaataatttgtggttcatatttaatttaattgggagtacccgatcctcgatctcatcgtgccctacctaggggagagaagcatcctgactgccgtttgatgatgatgcacaagatggcagtatgatttgatgatagaataacaaaaagaaaagacaaagttacccttttaatccataccgtttgatcacgtatacttgtagtaatatattgtaccataaaaactctcaaatacaaatatataacttagctactaaactggatatatatttatccaaattttcatatagctaaaagttgcgtatcatattctacgacgaggcgagtacgtactatgtacctacattaaagatcgatcagtacagtagagcagtagtagtactccaaagaagtgtacagcttaacatgcaaacggcgagaattgcacgtacatgtgcctacctgcctgcctgcgtgcctgccaagccacgtgaaggccacagccagacgacgctcgctcgatcgatcgatcattcatggtcttgccaacaaaagcgttctccagtactcctatagtgcccgaccattagcttggctagctaggcgcagccgtttgctgttgcagtaattcggcgagctgatcgagcgcgtgtacacgcacagtcacacgcgcgtaagtgcgctactgctagatgcacgtgatatgcccttgattcaacatacgaatgacgaaaaaaaaacatgtagcgtaaattttatatgtagggtaaatctggaagctacagtaaaatatacagataaacacttgttataaaaactaggaaggttagttccaacaaaataagttgaaattaaagtaaggaatttttctttttaattcaattctcattgtttattttttccataaaaagtctcgagaaacttttattgctagtaatttttttaccaacgtgcttagctttctttttaattgatcaaatatacgtatcttatttaaggcttctctgtaatatgtgagactctatggtattttaaagaaaagacctagtcaatataaatcttaaagtaataatttattagaaaaaagtatagattataagaaaagctactgatttttgccgccttagaggcttatacatgaaggttgtggagaaacccatggagctactttgaagaatatgaatttactgaattttgttgatttattattgaccttcatctcttggattgcttaatatgacttgtatgaagacaaatataaaacaaattgaaagaataaaatattattacgttgtaaaatgagctatgttttactataacgaaaggagtagattgattcaatactatcttacgtgttaagtgctccactaaaatagttttatgtgtaaaagcttcaatgctacattgctggttaagcaccccataaaatagttatgtgtaaaaggattgcaaaagttattttcaaagatgaaccttgagtttgaggcaagaggcttggcacataggaggctgcacatttgagtcacatgtgaaaagaatgctcgcaagaaccatttgtgtagtagtgggatgaaaataattatttatacaattaaaaggttggaaaagtgaaaataatggtacttgtgcccatattattgtttgccaacaaccgatagaacttgatagaacttgatagttctttttgttatgtggtataattggctagatattttagaacttactattgtatcgtgtagctgatgtacctactaatatttctctatatgctgcattttctcattgttgattaatgcattccttggtgcatgtgacacaataaatatttcaaaaaaaaaagtctagtcgagtctaaattgattttggattgtgggaaataactcattgtttcatgtagagtgcgtgggacttcaaatagactacgaatataatttcatagataaaaataactctgcaagcataattattattgtaatgtggacttttcatgattgccgtcatgatttaaaaatttttactctaaaatttataattcaaggaatttatatactcgaaacaatcactctttgtaactttcttttagctaacatgcattaggcatttagtattacacttatgtgtaaagtattactttaaattcatagccgtataataaaagggataaaaattttgacagtataaggagtataaatgtataaaatttgacgatctaaaagtacaaacaataatttttgtacaatttttagtgagatatgtgtgtgtatgtgtgttagttggtttacaccatgtgttcacgtagtctgtgcataatcttcaatgcgaagcctgcaatacctaccctattttatcttctttctttgaaacaattaggcatttaaacaatcatggtagtttattatgtccattgctataagatggcataagtacactgaaagtaaaagttttactcatgatgatagtttttaggtttgcaatatatgtggtttatactacatattttaccttataattaattaaacctctgtttatatgcatcgcgccgccctcggtcccggcggtgcacatgtaaaatcgtttgcttgaactaaccagaaaacaaattcactccaagttgtttgttgcttatgtatggcattatatatatctatggcctgtgtttatgagtatgcttaagtatatatatcaatcgttagtttgttctagccaacgaacaatttagcacaatacagtatgaatcgggacatatccatcttcataaagttgaagttgtgttgtatacaatataaagtgtagctcatcaaacaaacctgacaccgtgacagcgatctcctgcaacgttggagatgtcgtagaatttgtttacaccgtgcatcgcatgcacttggtaggtgacgtgggtttgaccgcttgaggctctgattagttagatctttctaatctaacggtgaaggccctggttgttctctttcgataatataaatccggtttcatcaatttaagtgaaaatcaaggatgatatatttttgctttttatcataatttatatgattttctaaaactattaaagtatcatgtgatgtcttagaagcgtatgtagaatgtcatgtgatggttcagaagcatttgtagaaagtttgaaggacttttatataaagtcatgtgtttgtgcaagtatattaccccctattaaatttacaataataatgaacaatgtacatatgtgttcgtagaacacatttgcacagtagatataaagttagcacaattaattttttctgcaattaacaaaataatttatcaggcattggtgtgatcttggtacatctgatcagtctgtcatgaccaatgctaccatctcggccgaccaatgctaccatctcgatcgatcagcagaaagagaggctgtgaatttgccggggttctgtcgatagatcagtcgaggacttctccggctgccatcaattaatatgcctggacgcgccggattaatggaacgtcgatcgacccaacgttcggcatcacataggagaggattttttttttggcataattgtaacacgcatgggaattcaatttgttggaattaatggatgagccttagcccactcaaagattaattctttggaaaatcacagaagcccacctcatgggatggcatgcatgtggagtttagtaccaccttgcttattctaggagagggggacctccttaaaagagaggatgccctcctagccacttgaagcatgtgtggtggaaagaagagggggaacacgcttgctcgcctgccaaggcaggcggcgcgcgtgcatgacgtacgcgtcgaatgatccgcaaaattgactcctcacccttgcgcagatgcagcctccttttgtagttttgttttgctgcaggaaattcggatttgttttgttctggaaacattccgaaaaatccggtgcgtgaaaacggcgtggagtccggataagtttacgcgcgacttacccggtccggttacacggagtggagacttttgcagttttgttttgctgcaggaaattcagatttgttttgttctggaaacattccgaaaaatccggtgcgtgaaaacggcgtggagtccggataagtttacgcgcgacttacccggtccggttacgcggagtggagatcatgcggacgccctgatcaagcgacctatctctataaaaaccaagccgccgccttcacgcaacacaagcgaaatcaatttagggtttgcctcctactctgtattacgccgtcgctcgtagactactccatcctgcttgccggcgtgcaccggcgatcgggagagcaggtctccggaacctctaccttcgacgtcctgcaccgggagaaggtggcaataaggtttttgggaagcgcttcgcgcgactgctccctgttcatccacaacagctcgcctttctctccgctcgcgtgctgcgcgccttcgtcgacgcccgcaaccgcgagtagttcctgccgagcaaccagtctttccgctacctcggtacgtgttcgtcatgttgcgcatatttgatctgttcatattttactgcttagtttacatgtgtagatctaatgatgtgtttatgctagtttacatctgcaatgtcataatttatttatgaaataaattaaattattatgtgctaaataattcaacaggttcacgaaccagcttgggtattctgacaaatccactcatatttcattgcttacttcaactacccggtacccttttctttacagtgtgcctctcaaaattaagaagcattcttctttgataaaggttatgagtatggcagtgttgaatatatcttctcaatggtcaattatattacatgacctaagttagtcggttgagtgggatgatttgttttaccaactagctaagatgaccctctcagataaaaatgactgctttaattatttggttgctagaaaaagctaatttttggtcaaatccatttacagggcaataatgaatttcaatgtaaaaatccgcaagagaattttaggagttaaaagtatcattaaaaatagaagtctttacatgaatcttttatatataaaaaaaagtaatcctaaataaacatggtaaagagaaaagagggaagggggcaagcaaatgtgttttttaatgcacaagagatcatttaacacattttcttagactgtcatgttgttgcgtgttttgcttcgcggtgtatcttttttccttttagtgcaaaagaaattttgggtggtggtatattttttctttttttctgattatggtcttacagggttgtaattttgcttcttttttttttttttatcaatagaacttcgcatcgtatcaggcgagtcattccaaaaaaaaaaaaaaaacaaatgctcccaggctccctgctttgcctggtcgatcggccgggagactgcctgtgttttcctcgtccttcctcctctagctgtaagcctgtaacctcgctgtaaagaggagcctgtgttcttcatcagagtctggaccgtgaagccattatccactctgaacagttagcccttcaattctactcccaatatttactgatgggatggtccagaaaataaactcccgcactgcgcgcaataacttttcaatggagttgcaaaagtctgctgcaacttaattttgcaacagtagttgcaatttacagctagctcgttgcgatgacagtgcttagacttgaagcataaatgtccaaaagaatttcaatcgagatgatggatcattggaccccctatatattacactggacctgtagatacataatgagcatatagggaagtaagtaaagtggccgccccccctatatgcgttttcgctctgcctaaatgcatcagactacattcagctagtcaggattccctgaacgggttgcatgtgcatgtttcttctcttcttcctttgctcggaagtctgtctatgtcatcttgatgaaccctagctagtgtataacaagcaagcagggttgtgtcgccgacatgcataaagcttttttggacatgcgggcctgcaggccgcagtaagaacgagccggcatggtctcatataaaatctgaactaaccttttgagataagaaatctgaagtagctagcacgaacggtcttcacttctgctaaacaaacaccggaagagatcaactaacagagacggcattattagtttaagtgattccaagtgttctccggatcaatcatattaatttagcccttcttgatgcatgtcctgcgtaattagcacatcacattcagctttctgctttctatacacccagttaggtcgaatcacacaacatgcagctaccaggatatatattataccaacacaaaataatcagatgatcagatggggcctacaagatacctatatataacagcaaagcggtagtgcactcaagtgtgagcaaagccatgctgtagtgggatctctctccatccattcctgcagtgccgccactgctatagctgcgagagctatagctagaaaaatatcaacgtagaaagtgggaggagaagtagatgatggatacagatcacactgagataattaagaagggagaggcagtagtggaagccatggctctactccagtctcggttcaggaggatatgcgtcttctgcgggagcagccagggcaagaagaagagctaccaggacgcagccgttgagcttggcaaggagctggtacgttctactatatttctcaattctcatatatgtaatcgtcttgacaaagcagctgcttcatttttcaaccttgatcatgacatcctttctgagatcttgcttctttaattttctctcgttaatcaaaaacaccatggccatggagctttttactgatattcagcacaacgcgcctggtgatatgtaggtatatagagagtacctgacaaggttttgggtttcttttcaacgtcgtaatcttggagtaatataattatcaagctgtgtagacgtacacttgctgaacaagggctaaaatttatctctctatatatttaagtgacaatatatgcgacattactgctagctgtagacgtactcttgcagtgcatgcagcttgttcttagtagaagatgagagcatatgcatgagctgagcacagcatgtgtaggtctgaattgaatttctgtatcatgcagtaaaacccacttgtattacaaaggagaatgtcatgagggcttgcacatgagcttattaattacttcacatgaaagacaatatgtctgccggtgaacatggaattctatatttatgcagcttgcatagttccatagaaaatgacttactccccaggaacctagtactggattaggttatgatcttgtataaggctgctatattttgaaacggagggagtactagccagcaagttactacgcgcatttgcatttgtatggtgacttttcgccgggattttcggtgctcagcgcatttttctctatccatttcgaggcacggtataaatgcaaaaatgaaatagacaagtcgcatggatcagtcttaaggaaactatatatagtgtgtactgtatgtagtagctagactacatattctagatcacttgatgatatatattatagaagactagattctagaatgtggaaatgcatccccactctccattattatggtttcaccacaggtagcaaggaacattgatctagtgtatggtggaggaagtgtggggctcatgggcctggtctctcaagctgtctacaatggagggaggcatgttattgggtatgtaaaaacgtaataattgttgatcattcttcagcactgatacatggaaagaataactccgtatatagtacactttgtaagatgtcatcttgtcatgacaatagacttggattatggttcctttcctcaggtgctacatgctagtactaatatataatttgccattttgttgtccctatatacacgcagggtgattcccaagactcttatgcctagagaggtaagcacgctcatctcccttccaacaagtcctgacatagtttattcacatgcaacgattcccatgagcttgacatcattgttgctgatcaccggttaaaatctcatcattttcattggaaatgtcacttgaaaaaaaatctagttaatacttattgatcaagcatgttaagtattttgtaagcatgatagtatcactagatgagattgctttttagaaaaaagtcagtagcactgatctaaaattatatcacttataggtattagaaaaacatatatatatggtatgtggatacatactactactggaaaattatgcttgttcattatctttcttgaatcttgatagtggaaagaagaatgcgatcttatctgcttacaaaagatcgcatggaacgttcaaagaaaatcttgtttttcctttccctcgtagatgaaatcctgctgatcttgactgccgcttctagtggctgcccctttgttcttaaggccttgatcctttaagcagatgctgactttattaatcagaaagaaatgtccctcacattttctttttgtcccccaacaacagcaacatgattgcctctcctgaacctttgctgcgttgctctgattaaactatacatgctaccactcctgttaaacagtgctcatccccttgctcgttggctagtttttgcatgctctcttactttttgtggagcagaaagctgcagggtgctcctgtgtctgtgcgagaggctttgtcacatacgcatgcgtgtttgcttgtgtgtgcagattacgggtgagacagtaggggaggtgaaagcagtggcagatatgcatcagaggaaggctgagatggccaggcaatctgatgcgttcatagcactgcctggttagtctctctcaccacctggatatattttttttaagataatgaaaccacctgaatatatagcttcatcaacttgtgttgagtcgacatgtactaatttgctttacttttgttgtcaattgccttgtcatattttttcctttatcatgttatgatacgtggctagtggaagtgtgagtggaaagttgcgtaaaagcaagcacaagcagggtgcatgagtttgactttgacctgctaaattggcttgcatgcatgctgctgccgcccagtcggtgcagaatccttctttatacgcatgagctggtcgatcagattgtcagatactcggataagagaggacctgttgagccacttcgtgctgatattttcagtatcgttcgtagcttatctttttcagttatttgattctttttcctaatcatcagccaactgaatttgtgattcgcccatcagtcttaaaaaaaaattgtgatacgccttgttagcaaggaccaaatttggcccatccccgaggatgggctgggaattttaactagattcaggaccatcctagtgaaatgggctagtattttttctgccttctcaaatcaaacctgacacaacttcatactactatggatttatgaggttcaaactcagcctagaaatattctgaagataatgcaaacatccgacaattatacccaggcagatgctgtatccgcagattccctcaatcaatactcgtatttctggaggagagagagatccagagcgagcactgttcattacttaaatttgtttactgcaggtgggtatggaacacttgaagagctcctggaagtaattgcctgggctcagctcggcattcacgacaagccggtacatactgaaatagttcatgatcagcttttgcacatgcaacatatgtacacgcactgatgaacaatgcacgtatatacacggagagccaaaacttttttttaccttggcttaatgtggacgatcgatgctacgtacaggttggcctgctaaatgtggacggctactacaactctctgctgtcgttcatcgataaagctgtggaggaagagttcatcagcccctctgcgcgccatatcatcgtgttagctccaacaccaaaagaacttctcgagaagctagaggtgtatatacttatatatataatctatcgatttttctgatgcatcatggcacactgcaaaggacagaagaaaacgccggtttcatcggtgaatgagagatcgagctgaactttcctcttgctcgcatgcaggcgtactcccctcggcatgacaaggtcgtgccgaagatgcagtgggagatggagaagatgagctactgcaagagctgcgagatccctggcctgaaagaaggcaacaaggcgaccatccaagcacagcgaggaagcatgctctgaaatttactgtagcactagctagctatagcttagccaatgcgtgcagcaagaagattcaaaacttcttggtgcacatgaactgcaacttttaattcatgtaactcggttcattagaaggcaattgatcactgatcatgcaattagtcgtgtacgtagccctaagaatgaaatcatcagtaagatttgtaaatcacagagctccagagcagcagactgacataaaacgatatgtgggctagatcgatctcctccgtgggctgggccggatttaacattgggccaggttcagcaaaacataccacagttcgacagttcgtgtgaacaaagaaaagagcatgaactattcgtatgcatgtactacgtaccagatgaagaatttttttcgtttttagatttttttaatatttacagaaataatctatcgaccaaaaaaattgcagaaatagtccctgccgccctaatggtgggcggcaagctgacgtggcagacggtgggtcgaccgcgccgtctgccgccgtcggccaaaattgcaattaggcccttgccgcccatacagaaggcggcaaggggctaattgcaattttggccgaccataaagagtttg

SEQ ID NO: 7052 - DNA, 5754 bp, Oryza sativa
ccagatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcacagtctgggccgtagaaacattatatggacttaaacaaggagaattatgtaacatgaagaaatagtagtacaatttgaacatgatacgactattttcattgcggttacatagatgatattagattcgaactaggagggaggtagtgcaatagttgaacacaacgacgatgtagtaatgggacaaggaagcatgatagtagaaatttcaataagccaagttgtccgataatagctaactcctacgtgaggatccctctcctctctcaaaccgcgctttagtaaccctttattgctctggtagttcaagctgcacaacacggctaggtggagttagaacccttctggtgtatatccattctctgtattgacatctccttggtggttcctgggaggaaagaatagatgtaaagcaagcaaagttagtaaatattgtgagaaaataaggattcatgtaatcaaaatattcttaccatgaaatcgtcgtcaagaatatttggacaaacaaagaaccttcgacccaatgttgtaggatttatggagcgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaaacgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctatgccagtttggatcctcaacaccccggcgtctagccattgacgaaagccggtcggatttgtaatgaagcaagaggggaagagagtactgattgtgactgagttctgaaagattgtgaggcctcactcgttaaggaaacttatataggcgcaaaaaatcgagtgatacccctgacatgtgaacgtggtggggtatggtgggtacgcctgattggcgccgaaagatacatgcatgatcggcgccgaaagttacattggtcgtatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagattgctctactggccctgccccgcgccgcgaccacgcttggtcctccgggcctgtgctcgcacgtggtcctgggagtaggtgaaacgatccggtggcatagcacgggtagcacgagtgtcccgcggaggagtggcctgcgcctggtcctgcgtctgcaccggcggtgcgcctcccagctgtgaggggccaatgacgtcctctgtcgagcctgaagcgaagtcgaagtcagtgatgtcaaagagcaaggtggaaggcagcaagcggttcgacgaggtcctagcatagtccagtggtggaccctgactcgacgtgccggctgcctgtgacgaagtcccggtgtactgccagaactgcgctgagtgcgaggtcgacacagctacctgagacgctgaccctgcagcctgggagaagtgggcggcctgcgtcatagcgaactgggcgaaacctacacatcgacaaatgggacctttgtaagctaagacataaaatgtatgtaaattgattgtcgaagtaatgttgtttttttaagtacctgtggggggcacaacagaaggcctagccgaggaaggcggggtgctgaacggtgtacgaaaccctgaagcaatcggcaagtgaaacggctcacttatatgtgcgaggcatgtacagaaatagtaataaaaatacttacctccgtgtggagggggagtcggcctaggaacgtgcgcagctggacggggaccagtcggtatggttggccgctgtacagctgcgtctgctcgagcaacgtcgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaacgacgacccggttgatgtcgtcgacctgcatggttaatttattcgtaaatattcgtaaaatttgacgaagagaaagacatgaaaacataaaggaatggtgcgatgcagggtactcacagcacgagcgaagtcctggtcgcggtgcctggcatagaggtctctagtgctcgcaacgtggggctgctgctccaagggagcgaaggtgaccctagtacaggtgcgtggctagtaccagcgtaggtaggcctggtacgactcctcagtgtgtggctctccctcgtggtccacgacctcctcggttgcgagcaaccagtcctcaacaaaagtcgccaacttggcgggccagtcgccagctgagtgctgacccttgcgcgagtacctgcgaattaatgtgtaatattagtgtgaaacgacagatgttacaaattattgtgaacaggcatattttaatgcaacaacggaaagcgtagtgcaagatcttaccggtgaacagcagctgggatggtggtcggaaacggtactggaaagggctgacggaagccgaactgccgcatcacgcggaaaggggcgtgaggctcaacgcagatgtcgaagaccatcggaaccgtagtcatccagtacacctggtccctggtgcagagtgtggacagacccaacggcgcacgagcctgggtagccgctgcactgtagggctcccacacgatgtcagtcggcagaaggcggtcgaactccataacaaactcaggatacgaccgcctaacctggacgtgagcccatcggcgctgcaatacgagacgatcgatgtgatgtacaatgaacttagcaattagcttaacaatacgataagatcgatgcaacgtacctgacgacggcaccacagagtacccatcgtagggtaatcgacctctggtcgctcctcgtaggtgtgcccatgtaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttattttgacatagtatctcaaacctgtgctgttgggtaccttgcactacagctcgatgtttcatggcctttttacgcaactcctctagctttttctgcatgaaagctccaaacaaaatgctgttgttcagcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcataattccatatctagcaccacctgtgtcatacgccttggcccatttctcttttggttcatgcagaatccactgagaaaatttccgaatctccaatccagtttttctaaccaatgttggactatccgttgggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctctttgttcttgaattgcttgaagaaattagctcccatatgacgcatgcaccacctactctgtacatcttcccaaacaccggggtatcctcgttccatactcccaaattgcaactcttctatcgctcgcagaatgccagcgtacctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacagaacgacagttcacgaatgccatcttgcatgcatgtagagctaagaacgccctttgtagcacactcttgctaggatgttcaattgaggggaatttcttcacttcgtaagagctcccatggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacaagtaatgttcctgtggtatttctgaacaccaggtagaaaacatgtatgcttggtaacgactgacactgtccaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccccgaataacctcattttctttgtactcccatctcacactatcctcttcagagacgatcagcccagaaaaatcctcactagcccattctgctggattaatatccgtctcatcatctgacgaatcaccttcctctacacgctcgttatcagaatcctccctctccatttcatccacaatggcaccgacagtctccccctcgtcggacactccacctggttgattgccaactggagctactacgcccccgtcctctcgtgcgttgacctcctccacagaagtctcgtttaccttagcacttggtccctcgccatcatccatgttcatctgcacacctggatc

SEQ ID NO: 7053 - DNA, 2480 bp, Oryza sativa
cctgtcgccgctttggccgcgaccgccgagcgctagccctctcctttgaccgccctaagtcggttcccaaaccgacattgccatcctataaacccgagctccccccctttttcctttcctctcccattcacctccgcgccattgccgcccctctgtttcgccatcgccgttcgtcgttgcgcgtgtcggaggagccggcacgagcaaggacgcagaaggggacttcggccacgccctctccttcctcttccccggcccgaggccggagagattactcccgcgccgtcggcctctcgtcacagcgccccgacccgcacggtagtgcctctctccgttcttcctcctcgctccatctccccccccttagttttcggtggtagcacgagtagcctccccgtagctagccggcgccgccccgaccgttgccgtcgctcgccgtgtgctcgtcgccgtcgccgctcgagctccgtagcacccgctcgtcgccagcctcgctcggcgtagctccgcccaatccgacgctaacatcggattcccgtagccgcgtagatgctctcaccgccgggaatcggcccctcgtgaccttgtcgccgtttccctcttccctccccgccggttgccgccgccgcgattcgccgccgtcaagcttcctccggcgaatccgagccgttggctcgtctcccctcgtctcgtgcaaccacccggtgtgctcgttttcgccggtatcgccgtggttcgctccgccgctcgccgctgttgtccgccgtccgttccggccggcgtcgtcgtctacctcccgccagcccacgtggcagccacgtaggcgccacgtcggtgccagctcagccgaggtcgggacgggccgaccccggtcagcccctcccgtgcgcgcgttccaccgcgagccgtgaggctgcgcgtgggcccgccgcatccgttcctccgcagaccgtgcgcgtgcaccgcgtccctcccccgcccgcgcgcgtgcgccgcgtactccctccgcacggtgagccgagccgctgacaagcgggtcccacccgggaccgcgcgcggtgagcccggtccaccggctctctctcctccctcccgcgcgcgcgaccgtcttgggccggccggcccatttagctcggccggaccgccccaattctcttgggctgcgccctagccgcccgagaaaagtctattttccctccctcttttcttttcttttcttttcttttcttttccaaaaaggatttaattaaatccttttcctttagaccaaaaatccaataatcttagaaatccaataccttcccaaccgtaaatccgtttgactccgttcaacttccaaaattcctcaagtctcgagatctatctaatggcacgcttagaggtcattaatagggctttattttcgccgtttgttgagttgttccgtttcgcgtgtagtttcggagccggaagacccgcagtgcgaggatttcgaggatcaagctccagatctcgagcaaggcaagccacctttgaacatcttgagcctatatttgaaatttaattatgttgcttgaaaaatattatgcactgataggatcgcacttaatctgttgtcccgtctgcaaggcagtttggcggacatacctaatttgttgcattgatcctccctttgttaattgttatatcatgtccccttgtaaccatctagatgcgtctcgatattcgtgcaccctgtgcgagtatcgacggacgccttcaaacttaaaatctgaaaaacaacttgggtaaaacttgggttttacaaaagacttggaaaccccgacacctgggtcggtgcttgcgaactaaatgaatttccaaaaccacggaccggggaacgtaccgggtgtacggtttcccgctctcgcacttaaggaccgattccttggaatttcatccaaacataagtcaagtacgaccacatgggtggaatgggacacccctggctgagtaactagcttatcaggggagccttgatgccgagagacatgtggatttgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcacgggcggatgtgaggtgattcctagcgtagttttgtttgactactgcttgtgaaattgctgttgtggaaaggggttcgatgtttgaaaaatcagcagctgacgggatcagctaggcccgggtggccgtctgaaagttgttggcccgggtggccgtttgaaagttgttggccgggtgccaatcttgatcaattctaaag

SEQ ID NO: 7054 - DNA, 7419 bp, Oryza sativa
  unsure (1)..(7419): unsure at all n locations
nnnnnnnnnnnnnnnnnnnnnnnnnnnnnnnnnnnnnnnnnnnnnnnnnnnnnnnaattctaaagactgatacattgcacaaactctgaccggacgagacgcactgtctcaaccgtgtcgtttgagaagcactcacttagttgctttcagaaaagagttcaaataaaatcaattgcaaaaacaacagcctttccttgaagcctgcattaaacacttaattcccatggcttgctgagtactcccgtactcacccttgctctatataaatatccccccccctcagttgctgaagaagatgaagcggatcctgttgatgaggagttcttccaggagcaagccagctacgatgagttttagggtttcggcctagttcccaagtcgcgcctgtgttgattggtccaagtcctggcttccgttttccttttgtaatgcagttgtgagcttgggatctgtccgcagcccaacatgactgtacctctactctataataaagagacctctgttgctgtgatattctgtcttcctgtgataccagcactatttcctgggactggtatcgattaacaggttaatttggagcgtcacgggctagttccggtcggaactagttcggggcgtgacagactccctcagtggttttgaaggacagtttttgctaatgtggcgatgttgtcctagtcttagtcccacgtgacgcttacgtggtattagaatttaaaaaaatatctatacgacccatctgtaattcacacataaaaaatattgtgggccccactgaccatgtgggccccacatatcatcctctctctatcttcttcctcatccctctctctcccttctctctctttatctcccctttctcttcaccttctctctcgtggcgcaatcggcgggcaggggcggtgacagcggcagatgatggccggagcggtggggagggcgggcgctgcagttgcggacctgtaggccagagtagcgggagagggggaaggtgatgtggccccgccaggctacttccctctcgccatcgacctcgcccttgccgcctcctcctcatcctcctcctcccggtacgaactctgcgctcgcgccgaggggtggactttttggtggtgagaggggacacagagagtgggtcatggtggcactacaagaatcctgttaatccgtgatgaaaaatatctgtcacggatcactagaaaaccatcaccaaacagcatctgtgatggtttaagaaatcatcacggattgagcgtcatggattgacatgcgtgatgatttgtcgaaaaccatcacagagtaccagaatcggtgacggttttaaaccgtcacgatattgcccaagacctagttagtccagcccaagcacatttcctgtgacgaaaaataaccgtcacggatgaattgccacatcatcatagatgcttgcatggttgcttacatggatgatgacatggacactacctcagcccatttgttaacaggccagaatcaaagatgggccaattttggcccaatttcagccattttcgcagcaatttttcagccttttttgcaagcccatttcagcatactgcagcccaaattcgtcactaatttttagcccactcttcagcccactactgcagcacatatagcccatatacacagcccattatcaaacattcagcccacatacacagcccacaaggaattattgtagcagcacattaaataaaaaaaaaccttatgtttccatccaacaacatatcacatgaattttcatccagcatcacattacacaagtcttcatccaacaacagttaccatacaaaagtgcacacagctaataacacagactcaggaaatgcatacaagtccagcagcttgattcatgcagcatgcagtagcagcaaaatgcaagtagcagcaacaaaatatataccaccatgtatgacttaacttggtcgaaattgacttgacacaagttagcagcagcaaaatgcatgtagttagaggcaaaagatatgcaccatgcatgtcttaacttggtcgaatttgactgagcaaaagattaagttttgcttccatctcagattgactcctcttcatctcctctcggtctttaatccttgcctgctcagattcttgcactttgtttgacaaatcagccacctgtgcacgaagctcagcattggtccttttctccgcttctagttctgtctcagtgctctgctcactgaatctaggctgggcattatggaaccccacattcttcaagaaccgattcttcttggtgttctcagcaagcacatcagcaacaacttgagccgctgacttaagttcttcaccttctgttgttgtagatagcttgttttccatccgagtctagcaagaaagtagcaaacatggttgatgttgagagaattaaaaataagcactacaaagatcaaagtctgaaaattatcttacaatagcctcctgtacaacaggggtgtagcattttttttcttgctgtagtggaactccttgaacaaatcaaatgcattaggttcttcatcattgtatttgtcatcctgagaacaacatatatgcattaggtctagcatgaattaagatgttacgaaaatctgggcagctactgttcaattgagaatctaaaagaacatgttcaactaatttctagcctcatttgttgcacacagtcacactatgttttccacttagacaaacaactgcaacagaggtctttcactgcatacacagacataaaaacaataacttttaatctattaacacactcaacttagacatagatggaaacctaactcatcacctttcacacaatgtattggcatcggatcagatatagtgtccttgaacattccacaaactaatggactctcatgaacataacaacatgagcatggacatcatcttgtttaggctgaggcagacgtatttaagcagtagcttgttcatacaaaaaattatatggtgcttaaaatggcccacttaccaaattttcaacatgaaccatgtaggcacgagatccggttgtgtgatggtacttaacattccctcggttttctttgttcttttgacacatctcctacattaaagacaacaatacatgtaaggttggtgatagattagcatgcacaaggcatcaatctggttttgcagagagaacataccatcttttggggactcttccatgattctaggagttgagtccactgttcattactcatgaatttgacaggagaagtttttgtaaccaaatgtagtggaaaaggatcaaaatatttttgcttcagcctgtatctttgttggcgaactgcggacttcatcatctcagtacaagccattttaactgtatcatcctctatgtttatgtcaaacttggcctaatcgaatggaagaacatttatagaaaagaatatcaattcagtaatttatggcttaaaataacaaacaatggatcttctattgagactaaatgtggaaaggaccagagaatgcatgtacctttagttttcctaagaacagattaacgtacgcagatgcaggtttttccttgtatagcttccaatgcgggagtataggcacatggttcctaactatgatgttgcattcagttgcaaactttgcagcaacaagaggaaccactggccttatattcccttcagttatgacaacttgcagcttgccacggcacgctcggtttaacctttggagacaacgtcccatattatttccccggtcccttctctccactccccctagttgtaaatgtacattgcagttgaaattaaaactaaaattattgaggtgaagcaaacattgatccaagatgatcatgaattgaaagctttgcatacaaatattgatcaactgagacaatatgaaatatggaaaatagatgaacaaactcaccttcgttggtaatctggttgtggtcaccgtgttgagtaatgccatcaactacatcagccacaagggtgttgtcatcatgctgggtgaagccatctaaaaaagggcagcaagtaagaaaagcattcatcatacaaacaaaacttacataacgacagtaagaattcatcacctccattgtccatatggttgtgctgattatgttggtcgatagcatcatacccggtggtcatgtgagtgttgtcaagtaaaaatgtgaaaattggtttcattaattttttttattcttaaaactcaagttaatattttcaaaaggtaaacaagcaataaacttagatcagcaagttaaacatttttatagctgactcatgttaatggaatgtaaccaagaaatgtggcagtagaactggccttcaacagcagcctgtgtgtggtcatctaagttgccatcgagatctccagcgttagcttgtgatgtagctggcatacaaatatcacttggtatgagacttgcatcttgttgggcaatgcttttctttaaccttgtaactttaggagtcatttgctctgcataaactctcttgcgagaccgaaacttgactccaccagtctggatgcttgaagttttgttgttacagttcttgcgagtcttctccttagagcactgctggaaagaaaagcatggattggtcaacatagtattacattgaattaggaagaaaaataacaagttaagacttgtcaacataaaggaattacaacctttgcattctcatcatcaatctaagggtggcggctggaagatgggttttggaggatgggtggcggctaggtttttggaggaattgggaagtgctgtttcataattaccgatgtacccttgagaaattttctgatggaagtgttctctatattttatattttatgaacctaagggtagtaaggtaattcggactgtgaaatatttcgggctggcgcacatcaagcgcgccaagccgcttgggcgcgcgggatttccccttatcctgaaaactcaaagcccctgttttgtttggaaccttctagatgagtatatattataataagtcttatatttgagatttgctactatgtaaaatttgttccccttgaatgattgaatctgtctcattccttcatactccattaattttttttgttggaattagaaaatcaggttagacaagcaccatatatgatacacatagttcatcatgttatgatcccttatgttgatgattattatcttaaaaaaatgttgataatgattaataaaactatataggtgttgataatttcccaattagtgcttctagctagtaagtggtataaaacaatgcatgaagcaaatttgttcccttgaatctatcttattccatcggtattagtcatattccactaatctaaatttaggaattaggaattttggccaaacaagccccatgatcccattactttttcgcgaacacgcaaaaggattgcacttcaatatgtacagagtttatgttacacaacatgatcagccgggaggagacagcacaccgtactaaacctacggagcgaacgcacagagtcaatgttgctttctctctctagtgctgaggagagagatgcgaattttttttttgatatttttttcgagtctcggagcacactgcaaccaaccatagaaattcttagctcaaacggacaaaagatgaagcatgaggaattttttcaaagttctatccaaggggttccggagcttctcgcctagaaaacataattttgtaagcggaatttggtagttctaatttcactgaacccggcaaagcggggagaatcggatgtaactttttctgtagatgtctgtggatatattatatgtctaatttcgagtccgtatgaaaaagatatgattgttttaaagaaggtcagtcgaatcaggcactaaaagcactaaaaacaataggtcactcgcccaacgccaaacaaggcgatccccgatgtccggcgagagctgtatgtgaagcaccgcacatggtttatcatgtcatgtggtgctgtacatatcctaggtgagtggtgcatcacgattatatttttaaaaacatttttaggctcaactagtacccatcacaaagtgtctactattataaaaattgaagatgtttttgctggtactttggtatgtcatccgtatatgagtcgtttttaagtttgttcggttttgaaaatacaaatccgtatttgagtcggtttataagtttgtttgcttttggaaatacaaaaggaaccgtataggaaatctctataaaaaactcgcacactaagtaagttgagacgatcggattccttcacccgttgcaacgcacgggtattttttctagttaataaaaaaataaaggctcaactagtagagactaaatctgtagtttcattgacacaggcaagttgaaatgccatttaggccaacaaagaatcaaaacttgaaaaacggatatgaatagtttggcatcgaaccaattatacataaattccatagatgaacatgatctcaaatacaaattgaggctatctgaaataatagaacatatggtctcaaataagtagaacatggtctcaaatactaattgagccttacgacaaaatattaaaacataaaattcaaacagaactattcgtcgtcactatcgacctccataactgagtcgtcttcttcgttaaaatactccataagtgtgtcatcttcttcatcttcatcttcatcaccaatgacattcacttctttgctagattctttcatcaaccgagcaatttcagcagcttcaaaaacagggccacgctcatcatctctatttaaaggcgtatcatatataatgctagaaactggtcggcgtggatcctcctcatcatagcactcgtcttcttgatatgcagcagcactaacctccatctgacttacgttataaagatgcctatggtcaaatgtctgtacaacttgccaattttcacccagctttgtatctggcaaatagaaaaccttcgtagcatgagtggccaatatgaaacaatcattcttgtaccacaaacttccaacattgatgcttttaaaaaagccatcatctttaagtgcagtcctctttccatccagtttgaaccagtcacactcaaacaaaactacggacctctcctctaagttatagtccaactgaattatctcttttatgtttccaaaaaaatcaattaactgaccattatgtgtagcttgtgacattactccactattcagtgtcttcttgttcttgtcacggttaactgtgttaaaccgcacaccattcactatgcacgaggagtattttctaactctcaaatcaggaccgcatgccaaggagaagatatcaacatccacctcttctggatttgtactatgcttcttcaaaatctgccacatgcatacaacacacatatattannnnnnnnnnnnnnnnnnnnnnnnnnnnnnnn

SEQ ID NO: 7055 - DNA, 1154 bp, Oryza sativa
gcgtatcatatataatgttagaacttgtcggccgtggatcctcctcatcatagcactcgtcttcttgatatgcagcagcactaccctccatctgacttacgtaataaaaatgcctatggtcaaatgtctgtacaacttgccaattttcacccagctttgtatctggcaaatagaaaaccttcgtagcatgagtggccaatatgaaacaatcattcttgtaccacaaacttccaacattgatgcttttaaaaaagccatcatctttaagtgcagtcctctttccatccagtttgaaccagtcacactcaaacaaaactacggacctctcctctaagttatagtccaactgaattatctcttttatgtttccaaaaaaatcaattaactgaccattatgtgtagcttgtgacattactccactattcagtgtcttcttgttcttgtcacggttaactgtgttaaaccgcacaccattcactatgcacgaggagtattttctaactctcaaatcaggaccgcatgccaaggagaagatatcaacatccacctcttctggatttgtactatgcttcttcaaaatctgccacatgcatacaacacacatatattagaaaaatagaagttacattatgcaatatataacttgacaatgaacactaacatggttcctaaaccaggtctgaaatccttgtcaaagcattctttcaatgttaggcaccccttgtgtctctaactcttctatgaacaaactgcagaaaaaaaaataaattagtgtgcaacacaaaggtagcatatagaagaagtctaaaagtaagtatatagaacatacttgacgtaatactcaacttgggcacagttgtttagcacaaaccacaccatttgatcaatgccattttcatcatatacatattcaggtgcagaagtaaaattaactccatgcccaaaaacatcaacaccataagcttcttcattggagaaacctttatttcttggctcccgattaaatcttgtttcaacatcgtccatgtatttagagcaaaatgtcagacactcatcagcaatataagcctcggcaattgaaccttctggtcgtgacctattcctcacatatcgcttcaaagtatatagtcgcctttcaattgggtacatccacc

SEQ ID NO: 7056 - DNA, 710 bp, Oryza sativa
  unsure (1)..(710): unsure at all n locations
nnnnnnnnnnnnnnnnnnnnnnnnnnnnnnnnnnnnttttgatagatgaagccgggtataaaatatccattatctaaaaaaaagatgttgtaacccatcgatagtgaatcgtttgtactgatttcatctatactaatataaaaaggaggagttgcccccctccaatgctacaggccaaatcacccggattaatctgagccgtccatccgcgcacaacttttttcacctcacgatttggcacccgaggattgcacgcgcgaagacattgctcctcatccacccgcagccccgaagaccgcacctctcctcctcgctcgctcctcctcctccccgcgtcctggcaggagctcctccccgctgccgccgctccttcgcgccatgccgtagccgccgccgggtccttcttctttcccacctccgggtcttgcttcttccccatccccaccgacacggccgacctcttcgctcatgccttctncctcctgctgccgncgatctgacgcatacttgccggagctctgccggagctccgccggactcttactcggagccgcgccggagcaggcctcggcccctcatcaagtaaggtcctcaataaagtcctcaaatgctgtctctttcctaaatactaatcttctccgtacgaacacgatctaaaacaagtgaccataattttccatttttgtgaagttgatatgtttctatgcgct

SEQ ID NO: 7057 - DNA, 438 bp, Oryza sativa
tacggtaacattccaaatatgccctaaaaaataataaaattgtattttaccaatcttggagattttaatcttgtatagttttcaatataaaaagatttgataactattgatatttatataaaaaaaatatagagcacagtacaaaatcgccctcccccagggcggcaagggggccgcctgcaaaattccatgccccctcgccgcccatttgcaggcgggcccccgcacagtgcaaaatcgccctcgcggagggtggcaagggggcctcctgcaaatttccatgccccccctcgccgcccatttgcaggcggccccccgcacagtacaaaatcgggctcgcggagggcggcaagggggccgcctgcaaatttcgttgacggccgtcgcccgagagcgaacggacggctgccacgtcattttcgccgccctctgggaggg

SEQ ID NO: 7058 - DNA, 22515 bp, Oryza sativa
  unsure (1)..(22515): unsure at all n locations
gcctgaaaatgggtggagagggggaatgaaattttgaaggcggcccccttgccgccctgggggagggcgatttttgcctcccccctataaagcccagcccctcccctatgaaatttcattatattcactaaaaatccaaaaaaaacgaaagagagagagaggggagggcagcagaaggggagcggcgaagccatgttggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcccggtgaaggaaatattagatttggtccagatggtgttgatctgtcagattttgtatgacatcttagggcatcgataggcgtcgggagagaacatttcagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagtacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttgttatgataatttgcctcgtttgttagccaccattgcccagaggaataataatacttactatgacctacatacatttacatcggttgaagatagaacaaagagtgtgctgcaaagagcctttttctcattgggtgcttgcatcaatgcttttgtgcattgtcgacctgttctatgcatagatggaacttttatgacaggtaaataccgacgtcagatattgacagcaattgggtgtgatgggaacaaccaggttctacctatggcttttgcatttgtagagagtgagaacactgaaaagatgtactggttcctatagagagtgcacattgcagtggtgcgtatgaggcccaacgtttgccttatacatgatcgtcatgcgggtatgttgcgggctattgactacttgtagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctacagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagtttagggtgaaaaagggtcgacgccaaactagacgcatcagaaatgatatggatgagtcagaagcaggtgggaggactttacgctgcagcaagtgtgatctgcgcggccatacttacaagacatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacaacaccggtttcgcacggtacagttcagcccagatattagttcatttttatttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcaggcgcgttcgccagctctttctctcacggagcgtcgatccctcgcccacacggtactttactttttattaatactgttaaatacctatacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactccccggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccaatcttggagattttaatcttgtatagttttcaatataaaaagatttgataactattgatatttatataaaaaaaatatagagcacagtacaaaatcgccctcccccagggcggcaagggggccgcctgcaaaattccatgccccctcgccgcccatttgcaggcgggcccccgcacagtgcaaaatcgccctcgcggagggtggcaagggggcctcctgcaaatttccatgccccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagagcgatttttaaaaatcgccctcccagagggcggtaggcgactatttccgtcaattttcaaaatggaaaattatttttgtaaaacttttaataaaaaaaattataaataaaaaaaattcggcgtttagctgcaggccaagccacatgnnagatgggccttatgggccccatctatctcgagggccggcnccatgtacaaagccttgatctggcatacggccgagagatcctgaccgtcgaaagtaaatcaacgtccgtgatctgcgcacgtcaccggcttgagccttcacaatcgaaacggcaaacgatatccatcgcactactcgtctcgtctactcctcccccatctctctctacctcgccggtggcacacggcgagcccttctcctccgcgccgcctcgcttcgcctccgcgcgcgctctcgccgccggcgaaccggcccgggaggcacggtgcggactgcctcgtcctcttacctgaaccctgccctgctcttatcccccttggtgcggcgcaaggacggcgatcaatcgatcatctcggttcgaatcggattgcaggtattcaatctcatatcctccgcggatcgcttgatgaggcgtcgtggattaggttggtgagcttgttcgggctttggatggatttatttgcctccgattgatttttttttgtttcatccagttttgtcccgaatttaggggttaagtgaatcgatgtgatatggtggtaatcgatggtacagaaggggggaaatcatttcgtttggatgttgcttcaattctttttgaggtgttagtttggtaggttgggttgggggatggataagattgctaggggtgatgaacttcacttccaaaaggtcaaaacacgtttttacaagattgttttatcacagttacagtatctgagtatccccggggttgcaattttggtgcgacattaaggattgttacaagttctaaccaagaagattggtgaaattatttggtccctctggcactatgaatgaattctttagttcatttatttgacacatattttacaaagcatgagtactgctcagggcatgtgttacagacctacaagagctcagcgtgctaataagttgtttttctgcattagtaatccaagaatgtaactcagtttaatttattacttgttggtgctggtaatagttgctataaaacatttatagctagtaaggtgtttatgttccttttgcctcgtatgcatatgataaatttagttttcattgcttcaaggatatttactgctattatttattacataaacactatatatatgactatgggtgaaaacagtcgcggaaattcccacactgacgctcaattctggcaattaccatttccgatggattcgctcgctaggaatcggaaatggtcactggtgaatgcacaattgaaatttaggggggcgcgagagaaataaaaaacacaaggctaacgaagtgaaagtaatccattttatggatccagatttatacatgaattgcatataaacatatcaaatcatgcaaaagaacaactgaagaaagtaattcagcaatggaaagcatagtcctacaaactgataaatatgcttaaatatctatttaattactttgtaattgtataaaaataaattagaaaattggaagcaatgatagatgaaatatttaaactaagcacaagttgccttcatcctcacaaccacacaagaggcaccaacgcctgcgcaactgagcttaagtaagcggcatgcacaccagagccggcttgcacacacacgctgcaaccctgccacctacctgtatgaatggtggaccagtgggtttggtcgcagccatagttattaggaccggactagacatcgaaccagtcaaggcctcagttcatggtttgtttggtccagccggttgaaccactagtccaacctggttcaaatggaaaaaagatatgtatcaaatcactagtctatatatagcctagtggtagatgcgcacctcctcaacatggatgcgcacctccccatgcacaggccctgcctttttggcttaatttctcctccctcccacttccactcccacatacccatcttgtgccattcaagctgagtcagcgtcgtgcaccggcccatttagccggtttattgtcctgtattcaaccagtttcaatgtaaaaaccagcagttcaacctgtttattccggttcaattgcacactcgatcttttaggtggaccggctaaggccctggttccgattttttccggtcagaccaccgattcgatcctaataactatggtcgcagcagggaatgctcaggaacccatgctgtgtccacccctagaaatggtaagagccattcaaaaacggaggcagaaatggttttgctgttctaccgaccgttttctcggtttaccattttgttctggaaatcattgttttggggaaatcagtaattactatataccacgccaactagaggcccatcatgatcctctccaagtagagggccaccatagcaaccaggacatggcccagccacccagcccacttctttcacaaaaataggcgccggttagggagattcaaacagctaactgtaggttagaaaagacatgctccaaccaccatccttgttgctgatgttgatggatagccaattctgtaaagtatgtaaactttgatatgcaccatatatacaactattttattatttgacatatatttttagttcaatagtaaatgactatatgtaaaaacatgtttgagttatattacgtgtatatgtatgttggtcgagtgtgtgaaaacatacggtgtcacagtttccaaatgataccgcatgtttccaacatgaattgccgatttccttatgatgcaaagcatgtttctgtttccggctctaccatttaaaattctatttccaggaaaagtgtgattcagaaaatggttgaagctgttttcaaaccgttttcacccctagatatgaccgtgtgggtactttatttacattactgattgcaaactgtgtcatgtttattttgaaaatagtttcatgagagcttccttttcaataacatattgtgtcaacttgctctatcgtcttctaatttcttctgattacttgccacattttgtcatccttttaatgttgaggttactcattattttcactttgcatgttcagggggagaaaaattgtgaatacacttttgctggtattctcatcgttcctaggttcagctacaaaaggttgaagcaaagtaccaaagatgacatctgaagagaataaagctgttacacctaatgaacccatagaggcatcaagctctggttctaagcgtaagcgtggtcgtccacggaagtctgagtatggcatgcatgaaaaaccatatagtgtacagcccattcagagcgtcccacctcttcacagcacagaagatagctcaaatatccaacaggatgggatacagatcaatcataaatcaggtggtagtgttggtccgtctgccaatctggttaagacttctctcagccaagcctccacttatactagtgcttccttgcaaagtaattcagtcaaagatggtattgttggcaagtattttgttggtaagatgtccaacaaagttcctgggttttctctcattacggtgaaagtgaaggacaatctggtcctcaaaggttggattccagatgaaagtgacctccgcccaataacaccaaaggatgacctcgccccagatcttcccatgcttcggccaagtcaagttcgaaagaggccatctactatttacaagcaagctgctggtccaattccagtccccttggaggatgttacatttgcaaagcctctacagatgaggaagcctgttgagaaatctgtcgctaagtgagagaacctgaacttctgtagaaattctgaagtctggagaagttcaaagaaggcaaaggctagtttagattaagggaacagaacctgcggttgtgatttctctgtactgctccatatggcattggacggttggaattgattgatgtaatcactgttgctgtaatctcttttcttaaatactgaggtgtcagcatttatgtctgaggctttgacgaatcggttgccggatctgaagctggatgcactagttgcatttacaagtgtgtatggcaccttgtagaagctttgtagaactgtacttaaagtaaactccatattttgtgaactatgatgttcagtgttcgctccacatgatttgtgttcgctccacatgatgttgcggttgaaaaaaatttcacatgatgtttgtgttcgctccacatgatgttgcgattgaagaaaatttagtttagtgttcgctccacatgatatgttgcggttgaagaaaatttgtgttcgctcacataatgttgcggttgaagaaaatttagtttgatgtttgtgttcgctccacatagtttgatgtttgtgttcgctccacatgatgttgcggttgaagaaattttagtttagtgttagctccacatgatatgttgtgattgaagaaaatttgtgttcgctccacatgatgttgcggttgaagaaaatttagtttagtgttagctacacatgatatgttgtggttgaagaaaaatttgtgttgcggttgaagaaaatttagtttgtagtttctcttattataagatgctccacgctttgctgcgaatatatgatagatatgggagaaataatgaaatactctctccgtttcaaaatgtttgacaccgttgactttttaagcacgtgtttgaccattcaaatttaaataattatttattattttcatatcattttattcattgttaaatatactttcatgtacacatatagttttatatatttcataattttttttaataagacgaacggtcaaacacgtgctaaaaagtcaacggtgtcaaacattttgaaacggagggagtaatttggattaaaatattatgaaaataatttgagaatgatgatttagcatgtgtatgcttacttttagaatgaaataaattatagatataattaatatatgtttgcatgttgaactttgtgtgttaaatgagttgatgtgacatgtttgcatgtagattttaggagtgttaataaatattatgtttgcatgttgagttttagatatttagtggacattagttttatagaaaaaatggatgaaccgtttagcatccagaaacccttactttagatgtactactcttgcgtgtgttatcagaggaaaactttacccaaattataagatttattataatgaaccgtttagcatctagaaaccttactttagatgtactacaaactgcttaggaagagaggataaagagaaaaaatctctcagtttttttattgagattgacttatgcacaacaaacaagagagaaaaatgaaaactcaaaacgtttggagaggataaagagaaaaagtccctcagttttttatgcgcacatttcctgaatggtgtgtattttggaaaaaatctataaaaattattttaaaaaatcatattaatttttaatttaaaataattaatacttaattaattatgtgaaaatggttcatctcgttttgagcatcttttcaacattctcctttcccctactcaaacacgccaatgatgggcctcgtggacccatatgtagcttatgggtcggcccacacgttaatgccaacgctggcccgatggctcggcccccttcgaaacctcgagttggtagccatccatcatcatcaaaacagacaacctctcagaaaaaaaaaagggaaaagaaaaccaataccaacaaatccaaaccgtccaaactaaatccatcggctgggatcgacggacggcacggcttcgccttcacgatcgaaacggcaaacgatttccatccacgcctcgcatcgcctccccccctccctctcgcgttttcctccccatctctcctcctcctcctcctccgtgtctccgccggtggtgccccggcgagctctcctccgccgcctcggcgcgccacctctcctctcctcgcgccgcgggggagaagccgaacgggcgccggagacacggcgcggattgcctcaccccccttagtggccgtatcaactatcacccttggtgcgcggcctcctcgcgcgcgcgggaacggcgatcgtatcggggtcggatcggattggaggtatccatttttttctctcttgggcatctgcgtcatttcatgagacggcgttgattggatttgtgacccattcggaattagatggatttttttttttttgccctctgattagctcatccagtttttttcccggaatttaggagctcagttaatcgatgttatgtgttgatgtaatatggtaatcaatggtacaggaggaggggaaatcatttcatttggttattgctttcaacaaagctgtgcctcggcctttaattttacttaaaaaatgcattgctgcattttttttaggttttagtgtggtaggttgggtaggaattggataagattgctagtggtaatgaacttcacctccaactcatctttatacgattctttttgttgcttgagcccaggcttgcaattttggtgcaacatttagggattattacaagttccaacgaacaagtttggtgatattagttggtccctctagttcatctgtttgacacatattttacaaagcttgagtgtttgtgctcagggcatgtgttacagatctacaagagctcaacgccgtaataagttggtttctgcatttgtaatccaagaatataacccagtttaatttattacatgttgatgctagtaatagttgctatagaacatttatagccaggaaggtatttatgttccttttgcctcgtatgcatctgacaaatttcattttcattgcttcatggatatttactgttatttattatataaacattagatatgactagggcttcgtggaaattcctcctccaatgctcgtttttggcaattactgtttccaatggatttggtcactaggaatggtaaccgacgcacacaggattaaaatgtaggggttgccagtgaaataaaaaacacattagtaacgactgaagtgaaaggaatcatttttttggatccaaatttatacatgaaccgcatgtaaacaaaccaatcgtgcaaaagaaaattgaagatagtaattcggcaatgcacagcgaagtcctgagaactgataaatgtgcttaaatatctatttgtgtactaatatcatcataattaatggtgattttgaagtgctacttcataattttataaatgtaaatttggaaactgaacacaaattgccttcatttatcacagccacagcccacagcagaggcaccaacacctgagcagctgaactcaactaagcggcatgcacaccagagtcggcttgcactcacacgctacaaccctgccacttgtacgaatggaagaatggttggaccgcagcaggggatgctcgggcccccctgttgtgtctgccccttgaaacggttacggaaacggtaagagccattcgaaacggtggcagaaatggttttgctgttcaatcgaccattttcttggtttatcatattgttccagaaattatcattttggggaaatcggtaattagcatatacagctccaactagaggctgactatagcaacgcgtagaggcccatgatccacgccaagtagaggaccacttcaggccacatcaccgtgtagagagccactacgtcaatcaggacttgaccaagctaccctgcccacttctttcacaaaaatggttccagctaggggattcaaacagctgacctataagttagaaaagacatgcaccaaccaccatattaaatatttaaacttcattatgcacctcgtatacaactattttattagttcataaatgtttttagtacaattgtcaatggctatatgtaaacatgccatcatattaaataaattgagttatattacgtgtatatgtgtgttggtcaagtgtgtgaaaacatatgttgttactatttgatgtttccgacatgaattgttggtttcctaatgattccaacacatttccgcccggattattccctttttgatttttcaatatcatttccatttccatttccggctctactgctttcaattatattttcgagaaaagtacggttacagaaatggttgaagctgttttccgaccattttctcccctagatatgaccctgtgggtactttatttattgcaaactgtgctatgtctcttttgaaaataattccatgagagcttcctttttagttacgttcttagcagacttaattaatttcattcttagcggatatgaaagtaggcttctatcttcctgattgtcgacttgctctatcatcttctaatcttcttgtgattacttgccatattttgccatcctttcgctattgaggttgctcattgcgctcactttgcatgttcaaggggagaaaaactcatcaagtaattgaaggtggtgaatacacttttacggggcattatcatcgttcctaggttcagctgcaaaaagttaaagcaaattgccaaagatgacatctgaagagaataaagctgttgcacataatgaaccactacccatggagcagacattaagctctggtgctaagcgtaagcgtggtcgtccacggaagtatgagtacggcatgcatgaattaccatatagtgtgcagcacattcagagcgtcccacctcttcacagcacacaagatagctcaaacatccgacaggatgggatacagatcaaccatacatcaggtggtagctttggccctaatataggcacaattcaggctttgcctacaaagcaaggcccagctaatagatccagtggacctagagattctgtcaatctggttaagacttctctcagccaagcctccatttatactagtgctcctttgcaaggtaattcagtcaaagatgatattgttggcaagtattttgttggtaagatgtcgaagaaatttcctgggttttctctgattacggtgaaagtgaaggacaatcaggttctcaaaggttggattccagatgaaaataacctccgcccaataacaccaaaagatgatcttgccccagatctccctatgcttcgaccaagtcaagttcgaaagaggccatctactgtttacagacaagcttctggtcctattccagtccccttggaggatgttacatttgcaaagcctctacagatgaggaggcctgtagagaaatccttcactaagcacacggtcccttccgttccaagacctcacatgggttctggggttgttgcagcagtacctatctcagtttcacccagtaatgctgaatcaaggattttctccgagcagggtactgaacatgtgaatccacaaccgttatctgctgtggtacctattaaatcaggtcaacctgtattggcatcatgcaaggaagtcgctggagggaaaactgtcaatgagattcaaacagtctctgaatcttcaaagcacactgaagagtcatcaggtatgttcgttggaggaatgcaatttgatctactttgaataatatattacctctggatagaaataaagcttaaataatagatcacattttttgtgtcattataggggaaaggcatctgcttaatgttccagtaatggatgctataaaggaatctttgggtaagatttagatgttgtatgctcgattcatgtgtgtcacacacaagtagattcagttattttattttggggcatgacaaattcagcacgctcgttgtcaagatagcatctgtacaacactatatatgccccttctgccctcgatgacttattttctatcaagaacaatcactaaatggatttgtatctttaggtcccaaagagcagcctaatgctacaaatagcaagcaacaaacttttatggaaccaccgggtaatacataattccattatttgacatgcttagtattaaccctctagttaatgctgttgatatgaatatttagaaagcacagaacaagctgtgcagctggacacagagagagacatttccaaaggagctgatgactcaaagtcagaagcctcaggaggtaaaaatgtgataccctctacttttaatgtttttattggcacctagagtaacgttaaaagctttgattctatgggcatatgttctgagcaaatatgtttgtttattggctcaaagataatcctttgcctgcacaagcttttttttccttgtgtgtaaccattgatttgctgttagtactttgttgtgtgccatacataagctagattgtgttgctaacataaatccttttcctcgtgtgtaaccattgatttgctgctagtactatgttgtgttccccatacataagctagattgtgttgctaacataaatccttctccttagtcgtgtgtaaccattgattttctgctagttctttgttgtgtgccttacataagcagtgatgctaacaataaccattttccttggattgtgttctaaacataaacccctcttttatttcaggaactgcacctccggtagaggcttcaaccgcagtacataatccccaaggtaaccttctacacctcttgggaacattttattattatctattatttactgcaagaactaacaaacttgctgttacattgaaaatcaaaattccagatgacagtcatgaaatgaaggttgacaacaaatgaaagcagcgcttgagaaagacaaaatgattcttaatgttaggtgaaagcttcaaatccagattgtttctgccaagtcttactataaatggctggatgccaaaggcgtagactcgtactctaggatatatacttgtctttcgcttttatttgtcttccttataaggatacttgagctatctttcattttcattcgtcttccatttaaggatacttgaaccttttaataatgatgtaaagccatacaaaaaagttacttcatacttggaacaaaaagaaatgagaaaaaacttggaaggactaggccccatataggaaaatggcatatctgaatcgaaagcatttgtaccatggcccttgtgataattaagtaacagaaggcaagctgttattgtcaaaatctattacagtatctcagaaaccggaagatgtatctttcgactttgctttttcattactgacatgtgcatccggtattgttgtccttgcggaatctggcagaagttaatattaaatcaattgaattctactcagggctggacttattttgggacagatgaagtagttttttttttttaaaaaaaaagtcaattgaagtctatcatggtgcagtctgagaatacttggatggtattcacactttgccacaaaatcttcagcaaatgcggtatgccacgtgaaagcatctagcccctctggttgttttggtggttgatgacaatatgatcatcggaactatttacttttgctaagtttgaaaaaaaaaggattttgatgatacaaacaatgctacaccgttttgtccatttggagatagcttacggtcatcaagagatcggaagttggctacaaccctcttcaaggtaaaaacacgttcaaggagttagggacttggggtgaacgtgcttacaaataggttgtttttacattcaaagaccgtactatatatagctagcgggatgaaacttgtagtttgaggtattaaggtactaatcatctcggtgtgatgcacgttagatggtgtaacatctaaatcgctaaagtgctcagtggatacatgtggagccaaccagggttattcgtttttgtgattcaaagtttgccttgggagttggcctagccggacaatcagatggtaagctgattagggaagcaccagcggcggtatgatggtgaagttatatatgggtgatgactccatccaccaatatttaaatcttggtgtccacaaatattacgcacacgtaggtttcaataggaatttagtgagatcaggaggtgccgctggtttctattgtttagagcatgtgttatgtggacgcattcgcggggatatggagtgtggtgttgccaatcgtattatcttgcccttttatagctcaacggctatagtatcagttaccattgcaaaaaaaagaaaaaaaaaggacagactattcacgaaaagggccttgagtattgttgttgtcgcctagagggtagaatagatgtttcctgaaatttcaagaaacttttagcagaattagaactaaccggacagtccaactatggtcttgtttagttcacaccaaacttcctccaaactcccaactttccatcacaccacatcacatccaaaactttcctactcacataaactctaaactttttttccaaactaccaactttccctaaacttctccccaatttcagaaactaaacacagcctatactggagttggattatcttacagctataggacagtctggtcaatgcaacaacggtagaaaacaactatagaaccggacaatccgattatcgtagggcattccagtcgacagtatgaaaataacatactccctccggtttcattttaattgacgttttggacaatgacacggtctacaagatatatctttgatcttatttttatatcataatatatataataaataaatgcatgtttacttttattatagtactttaaaagacaaatctatatatattgttctagtttctttaaactaaatatttttaaagttattgatagtctaaatcataaaagtttgacctcaatcttgttcaaaacgtcaattaatatggaaccggagggagtatgcaatataaaatatgcaaactagaagagctactttaggcactctttctacaagaactagcttcttattactcatggacattggcgtgcctggccagtctgagaggcaaatccagtgatttctcaagtagcttgtgaaagacctggtgtgaaggtttcgggcttgaaatttttgtagccgattgaagatcgcgggtgctactgtccaataacgggattcaaaaaataaacagtaaatttagattatgtagtaacactaacatctagtttcacttgcaatttagaagtatagacttaattactcatacatttcaaggtataaaaactacaaagcaacataaataaatgagagaaagaaagcacacgacgttaacttatatcctattcatacacagagaacatcgtgtattcgtgtttaagcgtaatagcaggccaacaaagcctattgtaatatcggtcgccaagttccatttccaatacactatgttggatccactatcttatagcagtagcggacagtagaaatctgtaacctctatatatagcagctgctacaacaaacgctacttggcgcaaataaacactggatcaatcgtcagcacatgctccaaaaaggtaaaactaattcatagcgggattgtccgtcattatatgagaacagttcacaagatcaatgtacattagccctgtgaaaacaatcaatttactatctaactcttttacagtgtctcattgtacatagtacatgctactcttcaaaaagggaaaaggtatttgacatgacaaaaaaaatgcttcaatattctctatttcatttaactgctctcatggaacacccccaccacccccaccccaatgatccaaaaagaaaaaaaaaagaaaaaaggaaaatcgtgatgatgccaaagcattaagaatggtaaaagttgcaagtccttccaacaaaaagacggacacagaccagcaactagcaagagaattaacagattaggcaaaactgcgagtcctcttagatgtaaaccccaacggccaaaggggtaaaaccaagattcttccaacaaaaactgatatcacactgctatgacaagtttacatgtatttgcctggaaccatgctgcttgcagcaggtaccatgatgggacgaacggcctggaatggctgcacaagcggtgcagggcttggtaccaccaatggcaggttcccagttgccatgataggtggggctacatatacaggggctgtgcctggagagtttcgaagtaaaatgttttgattagtgtaatgaataaataaaataaacattttaataccttccattaaaataaaggaagcagtcgacaatgagtacgatttttaccttggaacttctggaggctagcttgatgtgagttcaatggtgcaggaagagaccatccttggggcataacaggtgctccatgcattacatccttcagcggaaagcaaatagtagatcagctaaaagcagttagggcaatttgtatttgcagtaaatataactaggatgagttttttagagggatgataatgtcaaatattaatcattacggttaacaggagagcttcatatgcctaaatgactacgcaatgtatagggttgccaacaaagatgcatgccacgaaatgaagcttcacattatctaatgtgtgaaatgtagctgagtagtttttattttttaaaacagacgaatatccaagttcaatttggataacagtgcctcacttgcactatctactggttgagcgatacaaaagacaaccatgatatcttcaatgaatcagcactatttaatcagttaaaagtattgtatgaaacaacacaaattgtacttgcatcattaattcatcatcttactctcgcagagttccacttgagctattaatagaaataacactgttgcattactcacctgagaaaatgggtgtacataaacaacatgattaaatttcccaccagtaacctatgatgtcataacataaaaataaattagatcagtacaggagcaaatgatagtatatcatgtaaccaataggtacaaatgaacagcattttgaaattaatatcagtatatatatatatatatatatatatatatatatatttatatatatacaactgattagaacttacaggctgaggactagggctaatgtaagcaggtccaacttgcatgggatgataaggtgtgccaattctagcaggatccagcctgctcacattatgccccatggtctgtcattcaaaaaaccatgtataaggattcaggaggcaggatcatatccgaacaaaacgtacatgccagagttatgcagcaataagatcaaagtgaagtagaatctgaaaattcaatgcacagaatataacataacgataaacgatagccagtggcggagccagaaaatttccacgcctaaggctgagctaatgggatctcaaatattttcataaattacatagcatttttcaagattataatggggattatggagctaggcatggggctcaagccctagctgccccatgcctgattccgcccctgacgatagctattagtagttcaatagttaatctcaagataaatggaaaattacaccagagtaaagataatagttaaaatatgtagagatagtagtagtggtcacataaagcaaattatcagcttaaaggaatgtcggtgctgaataggagttggcaccatattgcaatattttccttgtttatcacttcatgactatatgacagcaatctgaagaaagtgatgaactattgaagcaacaatgatattataaaagaattaatcaaagaacttactgactgagtatattgaggtgaaatagcatagtttgcagcagccaggttattataatgaacagccttgctggacagggatgaaccgcctggcactgagttagtttcaaatacaggtaacccggttggaactccagctacagagtttgagatgtagattgggttaacagagggtgcagctgcaagtactggtctggaacttgcaaacgaaggagagaagaccctagcacaagggttgagtttggattcctgcaatagtgaatggactgatgacaatgatgaagcacaggaaggttacaaaggtagaacatctaggacagcagtaaacataaaaacagaattggcacggcttcattccctcaggatgcatagaaatccatgacataggaaggaaagagaactgtgcttgataatacaaaataagaaaataacacactgataacattgataacatagttggcaagccttgcacagattgttatgtacatggacgaaataactgataatgctttccaaatagtactgggctccttaaaaggtaaaatatattagcaaaacatttttctagatctctaattctctagacacagttttccctatgcttacgtatcaagggtccgagagagctcaccttagcaatggttttgctcggcgtggcagttttagcaactgtggctggaggagagattttcacatctgaagacattgtgggtgtagtcaaaactgcactcttagtatttccatcttttgatccaacaaccgcagaactcattatctcgttacaggagaggcgtggccctacatatccagttggagaggctagcataacagttggacgggtttaagtacaaggaagaaaagtggaaaaagaattatcggagtaaaatagtaaagaggttagacataataccaggagaacttctcccaatggagatgttagtctcctcacctggcgtgctgcacttcttaacctctctgttaaagaaatagcatgaattaacctcaagaatgaatagacattgaaatatatatacagaatagattgctagaaatctacattattaaccagcatcattaaagaaacaattgaaagagttttatcctattattggtgaatcaagaatatactttagtggaaacacattcacatgtgaagtttgaggcttcacatatgcactggctgcgacggtatcacaaacaggagttctgcacacatcttttgtatggagtgaaaaatcctgaaaagtagaagcgtccacgagaaggcaatctgttagtataccttttcttttggcgggaaaatttgttagcatgtttaagcacatcaaagctacctttgcaatgacttgaacgagatcatctgggtgaataacaagactatctacaaaagctcccagaggaatattggcattatcattcccgttagcgatctttcgcgctttctttagcacaacacctgttcaacataaatacatcagtatcattttttctccacacagaaaaagaaaactaaattgattgttgaaaccagaaagaacaacattataaacatgatctggcaagaaaaaaaatgcatccctaggatattacaaatccaaaaggagtacgaatcaaacccaaaaatgtgactgctgccagaatgctagaatgcactaaatgaatcataaatttcttcatggcaaattggcatctcaattctagagaagaaaaacaacatatatttgcaatcaaccaggcagttggtttatagcataaccatgatacccgattacattatagagacc

SEQ ID NO: 7059 - DNA, 20456 bp, Oryza sativa
acccaccgtatccgccttcgacggaggcggtgtggaggacgcccgcgtacgcggatccgtcgcggacctgcacctccacggggaggccgaccatgcacaccgtcgcgagcagcagcgcctcggggagggacggcgacggcgacgacgacgaagacgacgtgcgttgtgccgctgcagcatccggctccggcttgagcgacgggggcggcggcttcgtcctcttggggcgggccatgggagggaggaagggagggaaaagacagatagggtggtgggaggggaggctagcgaagcggacaagccgatacgagacgaaagcggaaggggaaaaggccaccgatgcggccgtgcaaacgggaaggttaagttcggagctctctcgatttcaaggccggccgattcgatcgcgcgctaatcttaaagcacattagctaggataagatggtggaaccagattaattaactttaactgggttaataagcgaataatacaactagatttacgggtgcttttacgctgtcggtgtcagtgtagcactagattaatgggagcttttacgttgtctgtgtcaaatttaccatggcatttaacagatctttcctgaagtctttctagtttctactttctaacctcgtaaatagcccgagtgaaaacgattatcatttcgtcttccatggcacacgatcagatagatatacacattttaacagccattcacggtgaaaacaagtagagaaattttaacagccattttcacggtgaaaaaaaacacgagcaaagattttaaccggggtaaagtgtcgaagcaaaagttggcgagattccattgtgcagagcatacactgatgccctgatgcaatgtccgcccacgtggccaatcaggcaaccagaaaactcacttgtccttcacgaaaaaggagaatccaacacgcaaaaaccaacgggaaacaaacggtacatagcaataataataatcgatgataagggtgagatggaaacagaggatatgttttcaaaatacatgactcaatataggaaccacgatatggcagcatccgttgttcataatcataatacagttcatacattaaaacctcaatcgaaatctggagtcttcagaaaccgtctctctattgagaatagcaataacatagctaaagctgtagcttgaaatgggttgtgtgcctcacagcccaaagacgcgatcgatcaaacagggctcactggaagaaagaaaaaataatgcttcaaattaatcgctagaggatatagctatgcaaacgctgattgacatggcagaattcatgataactttcaagaaagttacaatatttgtaaagtgtgtaaatttccaatgttagatgacatcggaaacaagaagggggagtctcacctgctgcggcggctgctgctgtgctacttgttgctgttggtaattgggataaccagcataggctccataaccatacatgttaggatcctgaggttgtgcatacccaccataagcctcataaccttgtccatagccaccatagtaaccaccagcaccagcaccagcaccccactgattcgagtcgtgctgaggctgaagacattcaaaaaccacaatgttatcaactttagctccattatacagctttatagataagaaaattactatgttgagtttgatctggacctgtttgtttgaaaggcttcgaccccacgaaagtctaacattctgcccaccaatcaaggtcccttgtagcactgccagtgcttgctcagcagaaggcctgaatatgcaatgacaagagtaatttgcaagtacctcatcaaaaaaaaaaaatacaaggcagtaagacatctgtggaaatagaacaaacgaacaaagagtcaacctgttaacatattgaacaaaaccacatcttttcccaacaggaatcttaacatggacaacttctccataaggagcgaaaacttgtttcaagacatcttcagtgacgttggggtcaagaccaccaacgaatatctgagctcaacaacaaacatagtcactaaatgaactgaaaagaaattactgttgtacaggaaaaatagaactaagaacgcacggtggtattgttaggatcattctcagactgagctccttgagcatttggtactgtaaatgaaagcaaaaaagtgaagaaaatacaatgtaagatttgtcaaatgctggtaaacatgaatgcttatcatgcaaatgtctcgttcactgatgttcttatagtagtaaatagattattacaagcataagcagtgatattcatatagatccagccatgtcaagccatatgcattaagcagaatatcaagcatcactgaagacaatttagaatagagtaactaggatagctcagcaattcaggaacatgttcatcagaaccatgctaaagtttgataagattatggaggcgaaaccaccaagctaatagtacacatgtagacaagatttcacttaacagacttataatggagttaagtggccaaaaatgctaataagactacccaatcaaggaaaagggcaagcagaacactgttttttaagtattgtatacatagaatctcaaacaagctgaatacacaacacaatacagaatgaaatacagccccaacaatcgattccatgtcaagttagaggcagataaaatgagagatacattgcaagcctatcataatgtatgttgagaaaagaagcagaatattctccagatgtttaaaagaacagataaacagtgtggcaactcgaagtgtaaaatatcacaaaaacaaaaactagaaggcatgaaaaagacaagaatttattcacagaaggtactaacattttgtcattcaaaaatctatttttcaaaaagaaggaaatagaaaatgttaaaaatatcaagcctcaatacatgaagcacggatatgaccctcaatagtcaagcctagcaaataaaagcaagctcgagccaacatgctaatttaactatgtgcatatcacatcaagcatgagtcataaaactttttaaacaaagaaaatgtatagtaaacgtatgcgtgcacaaatgaagtagaatctgaaatagcaagaagaataaatgactgaagtattcggagggcagaaatcgaaagaaacagacttcaaatttagaacataaatgttttacactgacctaaatgaggccatgcattacacaagaaatgcatcacagctcaaatcagttccaaaactccaatacggagagagcctgttgacctcctgcttccagataacacgagtttcataagtctactatttttctagttctagtgcatgaaatgatccaaattcacagggaatgttgtactaaggaataatgacttcttgaagaaaaagggtcacacaagctttggtttattccgtaaaagtaagtaaaaccggaaaaggtaaaagcggaacatcaaaaggaaaaggtatcatcaagcagagtagccagccatacatatagatagaaataaagataactgcccataataatagctaataagtaaaaggtgtcaatgggaaatacgatcagcagcatttacctctctcctgaacccctgttgttttcttatttgccgctggaccaatacgcatcggtctggaagagcaaagcattccattcatttcagtcattgcacgagcttgctctgtaggatcaccaaatttcacaaacccataaccctttgaacgcattgtcattttgtcagttacaacttttgcacccttaaccgaagggtaatggaccctgaatgtctcttgtagtaggtagtctgtaacatctgcagccaaatccccgacaaaaatggtgtagtcaggggtatcatcacgcttctcgccagcactggcccaattcaatcggaagaccatctcaacattcggcatcatctgtccattataagtctgaagaattcgatcagcagctgcacgacttgtaaactcaacaaagccataaccctgaagctgtccactttgtttgtcccggataagcttcacagattgaacctgcaagtaaatgcaaaacgttagatacggtaggtaaatcatgaatgggcggacacaatctgggtatattagatgttgcatttcatccattatcatctgagcaatggcttatgtatattgatagcaaaaccgaatcacataaatagcatttagaatgtacgcaaatgttatatagtctgcaaacttagcatccatgtgaaaacagtaagtaaaaaaccaaacaaaaccttccgaaatcgattcactaaagaaagtagcatgttcataaaatctcaataaaccaaaaagatacattcaacaatcactgataaatcagccgaagcatgaaattttgtttttattgtagacccacaactcatagcctagagcttttgagaagtcagaactaagtcagtcgcaagtcacaacatacagcatcaggaactaaattagtcgcaatacaccacagtacaactccatcagcaacaagccacacaaacaaaaaattacgggcaaccaaatctcacagcagatcaggacccgtacctccccggtggccgcgaagcagttgtagatgtagctctcgtccatccagggctgcaggtcgccgatccagagcgtcttcacctcgtccgcggccgcgggggcgggcatcgcctgcggcggtggcgcggcgtagtacggctggggcgggggcacctgcccgtagtgcgcctgcggcgggggctggccccacatcgccggcggctgctggggcggcggcgcgccgtactggtgcggcggcatcggcggcgggatcgcgccccactgcggcggctgccccgccgcgccctgtggcggcggaggcgggccgcccatgccgggctgcggctgcgacggcggctgctgcatcaatgcgacgagatgccctagctagcacgcacgaacgggagagagagagagagagagactgagagagggggaggagacgtggggggatgcagggttcagatatggccgagaccgagagagaccacttcccgtgggccgtgggaagagcccgtgatttgctcgttgcccgaaaattccttttttttttgtcagcttggggaaaaatgctcctttgctgcttgattggcttttttttattgttttctgcttgattggctttttttgttttgttttcaccagaaaattgagtgtaagtataagtgtgtcgtatattttatttgttttcaaatataagtaattatatttttaaaatttatatgcagtataagcaatttaaggacattgatccctgtacttaggaatctatgcattttcaagtaatcaagtgtttacaagaggaatctaagtagtttaggttactttcgaatagatgtttgggtttagcttattgcaacacgcaaaatgagataagttattaagtattaattgttataagcttataattgatttttttttgaaaaaataaacttgttatagaaaacttatgcacgaaactaccgtgtacttcctccgtccttgaaaaggctttgacactaactaggataatgaatcacttagattggttttttttaagaagaagtagtttgaaaagtgtaccctcgataatctttgctggggaaactaaaaatactaacgaatagagtagttcagtcgtattcaatataattgccatttttctcactttcttttgcttgaattatttctgttaccaggaccgctccacgattcggacaccttgtgcaaaatctccttggtcaccgaagcgccggtcgccatgatgagatcctcgaagccgctcgacgccaggacgggacccagcgtgctcggcgaggcaatgaacgcgacgcaggcgtctctgagctgcgagcaatggtggagctccgccatggcgaggacgtcggcggcgttgtccacgtcgatgccctcgtgcagcttctcctcgcacatcagccgcagcctctccagcccgtacctgtccgccgcggagagcaggcgcaccgtcgccgcgacgtcgacgccggcgagcggccagctgtccgtgtagacgaagcggaggagcgcctcgaaggcggcgggctcgacgccgtggatctcgatgcacggagcggtggtctccatcatcgggcccaggagctccgcgtcgaacaccggcgaccgcgcggcgagcacgcaccggtgcgcgcggagcaccctgccgcccacgcgaaacaccacgtccgagccccgcccgtcgcgcagcatccgcgccaggtgctcgtgaaggctcggcggcggcaccgtgacgcgggggcccctctccttggccggcgcgacgctcaccacgcgcgggccggtgaccacggtgaccacgcaccgtatggtcagggtgtcgtcgtcgaggcacgagtacgacgacgacgacggcgacgacgacaggttggatttctcgacgaacttgaggacgtcggcgctgcggctcgtcggcgtgaagtagtgcgaccgcagcgtgtcgccggcgagcggcgacgccctgccgtccctggccaccaagctcaggctgtacttggctctcacgagcctctccttgccgcggtaggcgaggcaggccgacgcgtagccggcggaatcctggtcgaggccatcggggtagaacgcgacataccagtcatggccggcgacgctgaagtcgccggagcagacgtgccttccggcgccgaagccgtccatcaacgagtagccgaccacctcgaagtcgtgcgtcccggtgatgccctcccacacgctccgtgaggacgtacgggcagccgataaagtcaacatgtctgccactgcaagaattgacaaaaagaggatgcaattgtgctattttgtttgtcaaatctaatctagcaacaaagacacttcttttattggatgaaacaagcgcatgtttaaatcaaatcgattatgttagaataggtgtatatggttatagttggacttagagttataatagatggtaggggtagagttaaagtcggactctggctctgtaaccggcaactctcttaaatagagaggggtaccataatgtaattatgaggactgcaatgtagtgtagacacacagggagaggatggcggcgaggccatgaactcgtagcggctaggtgctatattggttgtggaggattgcccataatcagaaccctagagatgtagactttagctaaagtttgttaacaaatattgtgtgttcctatgtcgtcacctagcatgtcttgtgtggtcaatgactgaagcgatcggaagattagttatcgttccgctatatcgactaatatttataacaaattcaattaagagcaacgagagtttgaaataccgcataccagacgatgcagccaccggtaccctgccgaagagagagcctcgtcgatagactgcaagatgcttttatggtattggataccacgcgttgccgtttaatctctctcgacgagttgatccaagaagagataatttatggtattggatactatagtcctgatccgtttcaacctccaaatcacaactcgggagtcaaaagaagtcctgatcatgcgaacgagacgatacgtgtgacaaggtgacaatctgagcttaatccaactgatcatggcgccactcttgtgtcgcaggctgcccagagacacgagctccggtgctacactgctgctccgcgaacgctatggtggtgaccatgagtccatgtcgatgcctttcatacagcctagcctgctcagtagtacaggggtacgaacagaggcagtctgaatgttcagagaaaaaatggggtgtggttcaggttgcatcctctgaagttttgaacagcatgggacgctatttattgccatctggatgcaccatcgagaaaaaaggggacataaaaggtgtacatcttgttcggaagaaaaaaaacaatatttagtctccgttcggaggagttgacggtctgtttggcaatttaagagaaaagattggagggttagatgagagaattctgtttggcaatttaagagaaaggattggaggtttagatgagagaattgattatgagattaacataagaatttgattttttactctcaatctcttgattggtagaggtggtgggaattgataggaagtttaatgggagattatatcttaaataaaaagagatggttgagatttacgttgattggtagaggtggtgggaattgataggaaatttaattggagattagatcttaaatgaagacagatggttgggatttacgtaggcaaagtaaagccaccctacccaggtattaaaaaagagggagttccttcctccctcacatctcatcattatatttaatgatgaatcaaatgataggaaaagaattaataattacttaaatttttttgaataagatggacggtcaaacatgtttaaaaaagtcatctgcgtcaaatatttagggacggagggagtagctattacaaattttaaaaatagatttatttatttatttatttaagaaagttatatatagaaaacatttgaaaaaaagaacattttgatagcgtgtgctcacgaagtacaaggaagtagctaagccaactaggagcagtctagaacggccctgactgcaaatatctgttcaggttaagtttcagggctgagagcatgcccaacagattacttattctattccctatccttaaattaaagaaattttaaccaaaattctcatccaacaaattccctaaccaacatcccaataatccatgttcccatatccgtatatgtcgttactcatttgcagggaaccattttttcttcccaatcgcggtcgtcgctgcctcgcgcgcgtagggggaaaattgttcccgcgctccttttctcgccctcctcgccagtcgccagcaacaaaattcctcttcctcccaggcgtcggcagcggctttccaggcggcgaagcaacggccaaccccttcctcgcaggcgtcgttgactgagttccacgcggagatgcagcggtcgtccccttcctcttggtcacaggggtcggcgtcggtgttgctccaggcagcgatgcagcggccatgcccttcctctcaggcgcaggcgccggcgttgctccaagcggcgatgcagccgccgtcctcttcctcgcaggcgtcggcggcggcgctgttccagggggcgcccgcacgtcgaccactgcctcctcgatttggggctgacggccctgtgcgccccacaccgccggctcgccgtcgtctcggtctgcctcatcctcaacctccctactccggtgtgcaggcgacagagtccatggagggacatgctccatgggagacactgaatcccctctcacacgaagctcctggcgtcgatttctccacagcttattctgtgagtgatgaagaattcctccataggagcaatttcggtaaggctgtccctgattcgttcgatgtttagattaattttcagagtgttgtagcctgatctgatgtctattctgtgactgacttcccctgctagaaattcaggaattcaggattcagaacacttagaggaaaatatcagaaagtctgaaatttgtactgtattgaatgaaagtctgaaatatgtaggatatgctctaaatttgaaagtctgaacacttagaggaaatcaggtttcagaacatttagtaatgaaggatatgctctaaatgtgtggtatgctctgaaagtctgaaatatgctgtgtcaaatatttttgctatgtcaaatgtactcccaaagtctgaaatatgctctgaaagtctgaaatatttttctctcatcacagcatctttgaaatatgctctgaatttttgcattaagataatgttgttagataatttgacagataatgcaacaagatgcaatccatagtctatttttcaagataaaagaaccacctgcttttgccaattagacttttagtttcatgaaagctgcagctgcagaattctaagtacaacagcataggttcagtaggattataataacttgtacagttcttagctctaagtacaacaactgcttaattgaagtgatcatctgcatttagtatgcctcactttttagattagcagatgaacaaccacatgcttatgccaaagattgaaaatagtgtctgaaagattcaatttcagtatgtatgtgccactgacatacatactaacaaggttcactgtcactgattaattactgcatgacctataacagattcaccatgctttggaacttcatcatcgtcgaactcttcgtgcactatatcaaccgccgaagaaataaattcttcgtcaccatccgatgaaaactcatccaatagcatttgaaggagggtgcttcgacgactcatctcctctttttgtttgccacggggttggagcgtttaccacagggatgaagtgcaatggagggaactgatggcaggaatagaacaataatcaatctgcaaaattaattatcagatcaaacttaatattttccaataatatatatccacatatcaaaatatagacatagagattgactacgacacaagagatcaatgggatttgctaacgattacctccttgatgacacgaattgctacggcatctccttggtgttccgttttttaacaaatcgcagcagtcaggacactggttgactggctggtgatgacggcgctaggtcacggcggcgcaggtccggggaggaagaagtcgatcggcgctggtgcgggagggagaagacgtgcacaagtaccgaactgggccccaccttgcttacgtggcaaactaacaaatgatagggaattgatttttgggcatctcttggaggaggggttcattgttgggcccaatttttattttggtattcctaattcagattttttgggaatcaaatattgggtgattgttgggcatgctctgaggtatgggttggaccaaagaatgtgagatgttcagagttgaaatgatgatttatatcaccaagacagagttgaattaatgattattagtccgtatatattccactcaaaaaactagtcattatacattcaggaaagcatgtgagtatagagtaaatccaacatttcaaaaaagatgaaaaggggaagaatgcccaaacttacaccatggtgctaaggagtcatccatatacataagatttctactgttcatacatattaggcgttggaaggatcacacaacttaaaaagatcaaagtcgcatatagagatgtagataactgatcatgactttcataactactaagatgtactactacaaaagtgatagcttaataaacttctcagcaagacttgtcaatccaaatatgtgaaaccttactcaagatctccttcataatcaacgggcagctttctaccagatgcttaaatccatcgctttctatgactggcccaagcatgtttggagatgccacaaacccaatgcaagcctgtctcagctgcgagcagtgatgttgttctgctaaaacaagagtggttgccactgtttccacatcaatggtttcgctgagccgcctctcacaaatcagcctcagcctgtccactccgtaccgatccgcggcaactagcaagtgctgcattgctgcagccttgccatctctgcagctatctggcagcctatctgtgtaaatgaagtgaagaagagcctcaaaaacctcaggctccatgtcgtcgatcttgatacattgcgtgccattttctttcatcggaccgaaaagctcggccttgaacaccggggaccggaaggcaagaacacatttatgagcacggaactcttggccacccacggtgaatgtcacatctgaaccttcaccatcctggagcatgttctcaaaatcggtatgcaggttggacggtgggacaacaacagaattgacctcaacatccttggtgtgggattccctgacgacggtcagcaagcacctgatggtcaggcagtcgttgtggaggaacggcgagctctgcagcttcgatttctcggcgaatttgatgaatccccaattgtcactcgccggggagaaggtgtgcttcatgtaggaattggtcacctgcgacaatttgccgtccttgccgagcagattcagggtgaacctggtcctgacctccttctccctgccgcagtagtagaggaacgccgacgcgttcccgaggcaggtgacggtggagccgtcggggtagaacctgacggcccagtcgacgccgccgacggtgaaggtggatgagctgacgtacctgccgatgcccagcccctcgatcagcgagtaacccgtcaccttgaaatcgtgcaccgcggtgacggactccgtgacgctcaccgacgacgtcttgggcagccggcagccgcccgccgccgcggggaaagccgggtcgcggtgatcacccatggcggcagcggaggcggcgtgatagagggacggcggcgcgatcagctggatgctatgcggcccgatatccatgacttcatcacaatccaaggcctcagaaatcgatcgattccgacaagcgggatagcccaccccccgcggcggcggcggcggcggcggaggggggatcaccgaagccgagcggaatcgggggagatcatccagattcggggaggatcggaggggagcgcggctctggaaggagagggatcacctgaattcctctcgcgaatggcggaggcggacgccgacgaggctccccactgacggccgccgcggttggaggaggcgcaagaaacggaaacgaaaccctccgtgagtctctctctctctctctctctctctctctctctctctctctctcctctcctcgactcgattcgattgaccctggctccctgccgacctgtactccacagtgcgcacgaccgaaacccccgccacgaggcctgtgatccacgggtgcgcacggacgaagcacgtgccacgtggccgttcatgcgtctgactaggcggcccaactagattagcccatttttggtcagggctgagagagaaattggtgattccggcccaaaactgcagaatctgaacatgcccgccacaggcctgaccaactagattagcccatttttggtcagggctgagagagcctgtgccactaacgaatctgaactttttttttttttggtttctgacgaatctgaacctgctccgccacaggctcacaagttacaaccgggaacaaagttaaagaatttgctcatctcgagttaaactcgaccaaaatgtgtaacagaaacaaaaacttagataataatggcgccaaacagaacaataatcacacctggaaatagaacagcaacacacaggggagaccagagaagaacagagtgactgcttcagagttcagaggaatgcaatttgagtaccgaaacaacaatgtgactctaatcttcagttctttttcgatatgtttccaggcaagcatgaaaccaacaaaaaatagaactactgtgatactgcaaatcatgtcgcgtcgcaaactcagtctcgaactttattactactacagtactactttgctagtcactaataaaagttactcataagatcagaaagactagactatgaatctattattacttgctcatgacgctggcaaccttgtctaaaatgtccaccataatcgacgggcaggtcgtgagcagatgcttaaacccatcagtcctagcgacagcgccaagaacaccccgagagactatgaaaccaaggcaagcatccttgagcgctacacgctgatgctgctctgccaaagccagcgtcgtcgccaccgtctgcacgtcaatgccgcggcacagcttctcctcgcagatcagcacgagcctgtccaggccataccgatcggctgccaccatcaaatgctgcatcgccatgcaatcttgatcatcgccaggtgtgtccgggttttctggcaaggaatccgtgtagatgaagtggaggaatgccgagaagatggagggctccatgtcgtcgacgacgacgcagctcgtccgcctctccctcatgtggccgccgccgaagagctccgccctgaacaccggcgaccgcgcggcgagcacgcagcggtgggcgcggaacggctggtcgcgcaccagcaccaccacgtccgcgccgtcgccgcccctcagcatgttcgccatgtgccggcgcatgtccgacggcggcacggcgacggcggccacgccctcggtgcgaggctccctgatgacggtcagggagcacctgaacgtgacgcagtcgtcgccgccgccggggccgcggcgaagcagccattgccgcagcctgggcctctccatgaacctggggaatccccagaaggcgcccaccgtgtcgaaccgatgcgtcaagctccgttgtacggactcgccgccgttctccgaaaggctcagcgtgtacttcgccctgacgccggttgctccgccgcagaggcacaggaagaccgacacgtagccggcgttcatctcctgcttccacctgtcggggtagacctggatgttccagttgtggccgtcgatggagaaggtgcccgaggtgacgaactcgccggcgcccaccccggcgagcagcgagtaccgtgtcacctcgaaattgtgcgcagcggcgacgctcgccgtcacgcacctcgacagtgtttccggcagccgtggggatcgaccatctgaaggagaagcggtgctgctcgccatggagaacaagctgttgcccatggcgaagatcgaaggagaacaacgaagcttgaacaacaacaaaaaacaacaacatgtaaatacagagtttgtcttgtcgatcaagatgctccaagctgaagttcgcaacaaatcagggtgtttccaaacacatacgtatctgtgtgcatctctttgattatatatagttgttgtgtatacgtgaccggcgccaaagtatatgagttcagaatccagagaaaaacaaaagcggtatccgtgcgagcgacagaatagatggcccaatttgggcagcgattgggccgtgctggagttgtctcgacaggcccaatagcatggcgattcgccggcgacgatcactggacgtgcgacacttcttgcttatcttgcttatatccttcgaaaagaaaaaaaaatggagtagatatatgtacagaggtatacagccaaacaaagcaacgagaaaaagaaataaaatgagagccatatatatatagtactcccaccgttctaaaatatagtaatttgggaatagataggacatatcttaatccaaagatctcggcctgtccagatcgttggtctaatatatatctcatcttgtaatagattgctatattttgggacgaaggtagtaatagattgtctagtacatttttgatattgagggtataggtgatggtacatgatagaatcttcactcattcgggggttgcactttatcgttgcttcccctcgatgcacataaactgataactcacgcacatgtaagggattcgatatcattaccttcgttttcacataattagcatgtcacctagagatttttgaaagtacactataattacatcataattgtattaatcacgtgggttctgccgctcttcagaaaaaagatatagtaaggatcaatgtgttatgtgccatacgcccatacggcgcaaagctgctatatcaggagctattcaacattgggatctgccttagatttgatatagaagtctgctagaactccacatctactctcgaactcaccatgtatatatatcctcgttgtcccttggagattctgctatgggcatgtagtgatgtagccacatgacttctcgtccggttggacgatggcatagctaggaggggtgaatctgaagtcagctgaaacctttcttttgctatatatttgggtgaaaattaactcaattcccatcacctgcctttgatgtcctgtgaccaaccgatggcatatctaggatggggtgaatcagaggtcgaatgaaaccttttgaaccatgccattataattttgtaaagtttgagatatgtcatcggtatctcaatgacatataggacccacatgagtgatacgtgggtcaggatggcatatctcaaattttgcaaaattataatggcatggtttcaatttttcctttgctataagttcgatgtttcatcttggcactgtactatatatgcccatttggatgataacttatttccaaatggtgaaccatcctgacccacatatcactcatttccaacttatgcagtcagctagatggttcacgatttacgcatcatggttcataactcgagctggctgcctggctgcaaagactcgtgtacgttactactagggtttaccaaactgatgtggttattgtcatcgtacggttaccgtaagacatatcgtgattttaaaaattgagaaggttattacacgtgataaccacgataacggtacagtttgtaaacctggttaccacggcatgatatcggctattaaagttcatcagaaacctcgtgagattttgcgttgcagaatcgagatgcccagtagtacagaggtgtaggtacacggcctaaacatcttgacactgatgggttgcttgcctgttggatctgtgacctttcgatctctaaacggcagcatgaaactgactcatttgcatttcttgaggtcatcacatccgaacacacaaatagacaagtaactagaaagatcgagaaacacagataatctctttactcatcgtcgatttatttgctttgaaatgatccagctacaacatacataaggatactgagaaacaaatccatctctccatgaatcatgaacacgaaaatcaccaaaaccaaaccagctctacctgaagaagcaaacaagaaccagaagtgaagaatgggggaactccatctgacgcaaccgctcctacaggctacagcttgaagaagaacagttcttgatgcatcttggctttaggaatgttccttctccaaagctacttatactgcaaatatctctcccctcctcctaaagctggaacctagcctgctatttggacatgctttgaaagtggtcagctggtgggtctgaaagattgtccttgcaatgccaaggatcgcatacattgaacctggacgccttcttcaccttttttttctttcccctttttgagcatatggttttggggtttgggaatatgactcatcgattatcaggtggctgagaaaatgctgccatcccactgtttgtgtgtgtcccaactttttttcatactcacttcattttcaaatataagagattttggatagatgagacacttattagtacttctttttcagatccgtaacactgagaagtgtcacatccgtctaaaatatcttatatttctccgtctcaaaatataagaatttagaaccggatgagataccatgtctagattcgtagtactaaaaaatatttaatctaattctagattcttagtccctcggtctcataaaaaatcaacctagtaccggatgatatacatatgtccagattcatagtattaaaatatgtcatattcaattctagattcgtattttatgggacagagggagtatatatgatggagtagtttaatacttcatccgttttataatataaaactttcttacattactcatatttatatatactggtcgccgacatgcaagtagtttaatacttgctcacaaatatatgtctatattaacatctatataaatatttatataaacaatgctagaaagttgtcttttattatgaaacggggagtagcagtaagaaaaggtgccagattaggtggcttgtttttccattgtttatctgtatgattgctgtcctctatcactggggaacctgtgacacccactggtcgccgacatgcaaaagacaactgaatatatactttaatatgtgctctcatacatgatgatctgacgttcgtagggtaatttcatcatcactagattctcaactcattaagtagtttaagagaatggtactccctcggtcccaaaatataataatttgttctccagatttattagattaggatatgtttcatctaattctaaattgttatattttgggatggtagtagaattcagtaggagcacttcactactgcagtagtaagcactaccggtaaatgggcatattgcaaaccgatcacatcagaaaagaccaggaacaacgcaacgcaacgacgaacgcaatgacgtgctacgaagcctagtacaaactaagcaaattactcgtgatccaatcttacatacacatgtttcctcccggggcttgcaatttgcacgcatttgcagcaagtcaatggtcaggacgatttctctccatctttgttgaggtgaaagaaatgtgcgtggacagaaaccgggcgacgacacagtgctctgctggtgataaggaatttgcagggctgggcacttttttgctccacatatgcatgctttctacgattcggagatcagtgcagcccaaagatcacattggattctcctcactacactccatcttctaacctagtctgcatcacggctaggtgcatccgttgccaagttcatccaatatatgccaaccgcattgcaaggacgaccatatgcacacacacacaccacagtccacaggagacagatagctagctagcttactctttagtcatacatacacttataaatagccaccggctctgtgctcatcagcaaggcagattaaacaagtgaagtggtccacatcaaaaatgaagtaatcaggtctagggagtcaaaatttggttggttgtccactggagttctcctcaatccacttcagtagatagctatggctaggcctcattgcattgcactgttacataactgtgatcatggggccaaaagctagctatgtatagtgaagtgcttgggggaactccagttgacactcagcattttcaagttaggtatgtaagtgcttgtactttatgaatttgtaagtgacagagaatgattaggtttggagtccctaggagttcctttcaagcactttacgacacactgtattgagagttgtcgtgaagtgtttgggggaactcttagtgtcgccaagcatttaagtagatagtgtttaaactacaagaaatgagagaaacgtttggtattatcaagagttctctttaagcacttcatacgacaccattatttatagggttgttgtgaagtgtttggaggaactctcggtgtcatcaaacaattagtagatagtgtttaaaccacaagactgagagccacgtttggtattgtcgtgagttcccttcaagcacttcacgtggcactatctcaatgcctactatgtgaagtgtttgggggaactctcgatatcaccaaacattcaacatatagtgtttaaaccacgagattgagatgggagccacttttggtattatcgagagttcccttcaaccacttcacgtggcactgtttcaaggcctattgtgtgaagtgtttgggggaactctcgatatcaccaaacatttaatgtagtgcttaaaccacaagaatgagatgagagccacgtttggtattatcgcgggttcccttcaatcacttcacatggtactatttcaaggcctactatgtgaattgtttgggggaactctcgatgtcaccaagcacttattacgtgacattttaaactacaaagaggtggagcctagtttggtatcaccgtgagttcccttcgaacacttcacgtggcactatttcaatgcctattgtgaagtgtttgggggaactctcgatgtcatcaggcatttaacatgtgatatttcaaactacgagacacatttggtattcccatgagttctcttcaagctcttcataggaacggttcaagtgatgttgccaagtgtttggaggagctcttggtgtagcaaacatttactagatgatgctaatgaataatgcaggtcaaatgagcatgagaaggatcaatggaagctgttcagtactctagtttttttagaacaagttttactctagtctattatctattaaaaaagttaaagacatttccgcggtccgtcatccgtgtttgagtcagttataaaaattaaagatgtttccgtggttcgtcatccatgtttgagtcagctttaattttatgttttggttttaatctatatctctatgtcatccgtatatgagtcgatttttaagttcgtttgcttttgaaaatacatatccgtatttgagttggttttaagatcgttcatttttggtaatacataaggaatcatataagagatctatttaaaaaaaaaactcccatgctaacttgagatgatcgaactcctaactgcagctcatgattttctaaaaaaaatatatatccaagcgaactcccacaacgaatttcattttaactaaaccatataacaataataagattaaaataaacttcacccattgca

SEQ ID NO: 7060 - DNA, 52633 bp, Oryza sativa
attgcaacgcacgggcattttttctagtacacataaaaataaaacaaaaaaatacattatcaaaatatattcaatgctagatttaatgaagctaatttgatattttagatgtgtataaaattttatataaacttaatcaaatttaacaaagtttaactagaaaaaaatcaaatgacttatattatgaaacggagggagtactaattttttctataaacttgatcaaacaataaaaactttgactaagaataaagttaaatgatttataatataaaacaaaggagtatactcttagaatgagtccttatactcatcggacaaatatatagaaacttagttaggcgcttagatcactctcgttaagttttgatgggaagcattggacaagttcagagttcagaataatactatcacaatactagcatatactccatatagtcattatctaaaaactatactccatgtagtcattatctaaaaaatatgctccatatagtactaataatgcggcactacatgggatatgcagtaactgctcactgacatgtggatctcatatcatcgggcctacatgtcaataagcttattagctggatcaataagcaggatatggattgtaaccgaacatagataaacttcagtgcacagtgtcgttgatcttactgaaatcaagcatgtcagcaaggccaagtactcatcccaggactcccaatcctctccaaagaaaaatccacaccttttcagaatctaggcaccttgtctaaaatctccttcaagacccaagggcagccctccacgagacgcttgaatccatcggttttcctgacgacaccaagaacgttaggtgaagccatgaatccaaggcaagcatccttgagctgcgcgcagtggtgcttctctgcgaattccagggaatccacgaccgtcccaacgctaacgctcttgtacagcttgaccccgcacatcgccctcagcctgtccaccccgtagcgatcggcagccaccagcagacgccgctgcattgccgcgtctttgccgaatccggagtcgttcggcaggtgatccgtgtagatgaagtgaagaagcgccttgaatgtcgcgggctccatgtcgtcgtcgtcgtcgatcttgatgctccgtgcagcagctggtccgaggagctccgccctgaacaccggcgaccgcgccgccagcacgcacgcgtgggcgcggaacggctcgccgccgacgctgaactccacatccgcgatctcgacgccgtgcaacatgccggcgaggtgctggtgcaggttcgacggcgggactgggatcgtgctcacgtcttcagcgcgagactcgcttatgacggtcagcgaacactcgatcttgaagctgtcgttgccagtgaaccgaatccggcgaattgcatgttcctgcaggtcagatttcttgacgaacctggcgatcctgcagtcgctgccggctcgctcgaagttatgcgtcaaacccgtatccgttcagtagggataagcggaatctcaccctaattggcatggcacccgtcgtggtgccaacgagatgcagagaggcggatacataggggttgtttggatggtgatcatactttgccacaactttggcaagctactttgaccaatttagcctagtgtttgcttgattgccacatctttgtcatgccacactttttgattttgtgaccccacttatcataggcacatacatttgccaacatttgcctaacttgtggccaagaatttcttagccacataaattgtggcatgccacaccttagctatagaaatttggtaaactgaagcaagcatccaaacagccccgtagccttcctttctgtcgttgtccgtgatgccgtcggggtagaagcggaggttccagtcgtagccggcgacggagaaggtggtcgagctcacgaacttgccgacccccatgccttcgagcagcgagtagctcgtcacctccaagttgtgcgtcccggtgacgctcgccgtcaggcatctcgacgatgtcgaactgctagccatgggtggcatcgaaaggaaaggaacaggcgggcgggtcatatcatatcgaacgcttccggtgcgggtatttatggactattcgcattctcgcactacgtattaattcgagaattctttacgtcgtttaacccgcccatattccaagctagtagtatgcgaaacaaaaatgaaagctccgtgcatcgatccaagtcatccaactaccgcgcatgccgctacgcgtgacgcaaagccaagaggaaataactcctctataaatcctttagctagctttctaatctgattcatatctgacgttggatgaaccctaggtcaacactatgtaggtgtcacacctctaaatcgtcaagtgagtcaaattgcagcggctttaatagttgagtgttcaaaatatccggtagttttttaggcataccacttgttaagagagtataagtgaacttattctaagccacgaaacgcatgatggtgggccaaacctggtctggtgttcacatatctcagcctttcagcccattaaaatagaagcccacgtagattgagcccatgtaaatagaagcccacgtggatagagcccaagcccatgtaaacggaagtgaaaccctggtctgtctttcatctgctttcccccctcccatcccggccgccgacttcttctccacggcggcgaacgcgcgcgactcgcgccgctgcccgctgctccggcgaccggacgcgactccccttcttccacgagcacccacttcaccggccgtcctcgcctcctccgacgacagcggcggctcgccgggtcctctcctcctccgccgcggggggtctcatcccgttgcagctctataccctcccttaaaccctacccttcgattcgcttaaaccctaccagctcgattccgcattgtgctcgcaatcgctcgccgggagacaaactccgatggactccaccgccgacgttggaggtgaagacgagcatgaaatcgtccaagaggatttatatctcggtgagcacctctagctaccaaaatacttcccggtttttggtgaaatttggtgtaaattcggttcgatttggtgcggatttctcgatggaacactaacatgctcactgttttttttaatgaatcctagatgacgacgacgagcagttcgatgttgatctcaatgaagacaatgagatggaggaagcggaacccaaacgggagcaaaatttggttaaggtggggatggaggcctggaaccagtcattcggagcaacctgtaaggtcaggctaatccatatccttaaaaacctccacaccgccgagatcaaaatctactccgacgcgtcgagggagttcattgagctattggatggtgaccctgagggtgaggtgctgcgggagtatgtgcagcagtcgccacggctcgtggagctggctgaggcatggcgattgcatagggagaagccagggatggcttacatactttcgctctttgctactgtcttaggacaccctggcggtaagttgcggcggcatggtttggttaagaagagcctggatggagttgctaggatgatactggaggataaggagaagatgggcgacgtgtatctggagctgaacagtggtgagttccggaggcagaatgctgcgcttgatttgctggctgcaattgttaggcgtggtggagggttggcgtcggagattgctaagagctttgatttcaagatggctgttttgccgcagctctcgggggtgcggaagaagagaggtggcagagatggggggaatcggaagaagggaactgatttcggatccacaaggcgatcgtttgttgggtttgccatgtcattcttggaggttgggaacccgaggatgctaagatggatccttcaacaaagggagctctattcaggggttcttcgtgggatcggagacgatgatactgataccattgtctatatcctctcaacgttgcggaataatgtcttggtagatgagtcacttgtcccaccagggctccggagtgtcctttttggtagtgccacactggaacaactgagcttgatatctgggaatttggatgcgggggaggcagctgacattgctcatgaggtgttaatcatggtgtgtactgatccaaaaaatggactgatgccaagctcaaacctgagaggtaaccagaaacgtctgctggatctcatgaagaagttgaaagctactgaggtcgttcaccacaagaatttgttgctggctattgtgagtaagagtttgtctctttgttcagcatacatgaatgaattcccttacagcattgaaccacgcccatcctcctcatggttagttctttgagctgagcatctctgtaatttttattggcgtgcagtatactctttcctatctaattactgtttctcaggttttctgccatatccctagcagcggacatgatatcttcagtaaactgtgatggcatctttcaaaatcttttgtccacttcacatgatctggtatctgttgatgatgagcaagtgcaagtactgttgaagtgcattgtgcccaatatgtgcactcgagcagtgataaacagggggcttctgcattctgatgatcttgtaaagcacggtgctctgagacttgtttttgaatcagtcaaccttctgtgcgatgtaattgaagtaatcaatgacatagtatcaaatgctagggtaaagtcagaacacgataattcaacaaaagtgacagtcaaaatagacggttttccaggattaagctgttctacttcagcagatgcatccattgtacatgaggttctacatggagacaaaatgcacgtcgataggtggataactctgagagaatatattcaagatgtagttcgtggagctatacctgatccgcaggttcttctcaagctactctcttctgctagtcagaagcatcaaaattattctcagagtaaacaaaagaaacatgcacagcttgagcctcctcgaaagaaaaggagacgtggagccacagatgaggatgctgatattattattggcgggattgatgttgagttgtctagggatgagcctgaagagcaagagatggacttggcaaatgatcatactactattctgtgtgagatatggggtctaaataagcaagatccgaagatcaaagatgcaaaagtggttggagatgttttccactcaaagttgcttgatgttctcaggttctatctggtaggtacagttaaatttccttccacttcatctatatttgcttatttcattgctcgaattaattaattcctccattcctgctctgtctccttttgttttctgtgactagcaaaaggaaatcgataatgttccttcacaatttatgattttaatgttttgatattcaaatgcatatattaagtttcgttcacaatctactcttttggtattctaacttttaacttcaatttcttttcagagggtaatgcctagctcttttgatggatcatttgacttcttcaaggttatgccgcctaatcctttggatctgtccatggatgaacagcagtcccttttatctcttttagttgagtattcaggtcaatctgatggatattggtgcccagaaaaagttccagaatctatgtacaagtatttgcaacctctgattgacattatgttgcattcgcaagttaagagcatccgtgataaagcatatattttagttaaagctgctgtggcgagttctggcgcttttgatcagaacattgcagagattgatgcatggttggctttcttgccgtgttacaaggccaaaggttttgaaagagagggcttaggagttgaagcatctaatagactgtcacacattgtgatccctttcctttgtgatgccatttcagtagttgggaacaatctgtacaaataccaagagcatatccgtaagcttatctctaaatttaaccagtttgaaggtatggttgtctttgtatgaaaatcaaggagtacaattcctgttttctttaatacgaatgctattggaaatgttggtgccaaacagaaatacaatgtgagctacatatatcacctaaaatacaatgtgagctatcatagtttgtactccctccgtttcatattataagtcgctttgactttcttcctagtcaaacttaaatttatagaaaaatatagtagcattttcaatacaaaacaaacatatgatctaaatatattcaatgctagacttaatgaaactaattcgatgttttagatgttgctaaatttttgtataaatttagtcaaacttaagaaagtttgactaggaaaaaagtcaaaatgacttataatatgaaatggaaggattaacatttgaggggttaaagtcctcccacaatctttcatatgatcatgatattgttaacttcattggaatacaggtttatttatctttctattgtttgtctgtattatgtagttgccatgcacatggatatctaattgaaccacactccttttgttcagtcggagacttggagttttacactttgttctaaacttctggtctccttataacttctttattataaatgtggtactttgttgcatctattattttactttaatttaatacactgagtcttctggcaggttcttatccatgtatgccacgcttttgaattattacctaatgagaaccaacttattcctatgctcaaacttttcttgtgatttgtaggctattctccatctttcagtcctttgattgtttgtgttctccagaaatgtcttaggctactagactcggagtctgcaagtgtgaaattacatgagaagtctacaatttcattatatgtgtgcaacacagtctaccttattatgcagtcacaggtattgcatttatgtcctctctcgcctatttgcctgtcttgcatggtcttctactcttctttcactgatccaatgatcataaacaggtagatgtgcttttattgcctgatcttgtaggcaccatcctaaatgagagactcggtaaattttcatcagaggaaataaattctaggatttgttttgctgaatggaggccactgatgtatttgttgcatatcttgaggagtatttctgaccaaaagagttctagtttgttcagcacccttgagcattcgtctgaagtttatggaaattctttgtgttctgtaactagaacaattgaggaaatgtcaaatcagcaacccaccaatttaccagatgatgtagcaacatcattcttatattcagtcatatgtgcaccaccagatgatgttatcagtagctttccgaagcttcttcatgttctgaagacacattttccttctaatttgccgttcttgtcatcagttctttttctgcaacatgattatctagctaaggttgctagttattgcccagacatgttcttcagcagtctcaggcagatcaagggaaatcttgatgttgatagtgtcaatattgttgaggacaaatggggaaagcactcaacttgttcagaatcagctgtgataagtacttttctaaatgtgactccattttgtgcactcttaccatcagtattaagcctcgcattttcagcaccagatgaaatcacaaaggcacatccattacttcaagatgagcttgtacatcttcttcaagctaagatttctgaaagcccattaagtgagttgacaattttcttgagagtcgtcttattttggagccatcacttgctgtcatcatacactgtgaagtgttcagatattcttgcacagttgtgtggtgtttgcttctctcttattgacagcatcttcgagcgcattcgagttttgactgctgatactgctaactcaaaatcttcagtggcattctatccagttgaatgtcttaatggcattgttgagtctgttgtccagcatcctataattggcctgtctttgtcatgctctttatccaattttcaagacttagcagatgggagtgtggaatatgtgaaagaagattttgctagtttttctaaggaaaagctacaccttgctgatagttttgttttaaatcttctgagtaatctatatggccttgtattattagctggtagttttggagctaactactctaataatgatgatcaatcccttgagtcactgtttggccctccgaagctactgcttgagagaatactactgttgttcaaggagaagtttgaactctgcatggagaaaaggaactttggactgtttttgccaaatttttacatgttccgtacactggcaaaatttgtatctcctgtcagactcctggaacttgcaaactggatgttctcaacgtttgaaggtttcagttccagttcacctgcatatgctcccgctgcattttgttgtctatacactgccgatattgccttcgaaatgctatatgactatttacaacaaattgatcagagatcaggaccctgtcgattatggggcttggagattcataattgtgatattgccaccattcagcaagtttataatatcattcttcattttgctactaaattgaatcttgaatttgctgatctttgcttgctgaagatgttaattcgtatccaccatacagaaatatctgcagttaggaacactgattatattgcattacacatgatgttatcgacaatggtggccaacactcccattgacattcttcatcactgcatgtttcccacatctaaggttaaagctaaagctatacagttgcttttgggagcaaatcctatgcacatgcgcctttttggaaaattgctcacggatattctgaaaaaagacacttctgttatgcaagtcgtgggttccgattctaatgcttcatggactcatgaggatagttttatacttttgttgcctgctgccttatcatacatagagcatcatagtggtggcaatagacagtgtgttgacttccttgagccagttccagtcttctatcgtgaaattcttttgagtgataatggctttccatgttggaaaagttttgttactagaagtatttttgaggaagattttagtgactttagacacacatcagttgaagatataatgaattatttcggtgacactctcttggggaagtcaataactatgctatgctattatttctattcgaaagagatacctcggaagcaacgattaaagataattgcttcaatttgcccacaatcatctgagctcttagattctgacatcagttttgttactcctgtttcatgcaacggtattatgaagcttactaatgagttatttgcaaagatatcactgattaggatgttgttatctcctcctagaggatcgttgaacaatgaaatagccccagagaaggagtccaagcgagtcaacaatgcaaagctgagttttataagcatattggtcagaacgttggataaaatattcaggaatttccctcatagtgatggcatcttactttcctctcctgaggaacaaaatgtcgtcagttgtttggagtatgcaatcctcaagaacattgttgagttgtcttcggaggttcagtcacatctgaaccagttgaagccaatacctttcctcaaccaattgatcagatcatccctcttacatagattcagtgatcctgttgtaataaaagcaatccgatgcataattgttgtattatctgaagggaagtttcctgctgatgaaattcttgaactcatactgggtcactcccattttgtgtcgacaataacctgcagtggagtttccgagtgcccatctgcttgtaatcccactgggggcctgcttcagccagcaccaagtattttaaaatcagttgattctgcttttgcaaaagaaaacaagttccaagactgcattccagaaaggaagaaagtagaaatcatcaggttactcagggtactgtatgatattaagagtaggcaacataacagtagcctattggatgaatcaagggagcttggtttcttgcttttatctgtttatggtgcaactcttagtgaaacagatctagagatacttcaccttatgaatgagatagagtcatctgagtgcaaagccattactgatgtggatcatctttggggaaaggcagctgtgaaatttagagaagaactgaagctagaattttcagcatctgatacgcacaaaatggaaaatgcggaaattagtgataggcgaaggtcgctattccgcgagaacatacccattgattctaagctctgtgtcatgactgtcttacaattttgctataggagatcttcaagagcttctattttttcactggaacagcttcagcaagataattttggcgatattttcaaggtaatttgtgtcaattgaagttttgactccatttttgttctagattttttttttctttcagaataacactcctttatcttcctggtatatttgtctcccttgtgctcttaaaccacacttgtattggttgacaggcaacatctcaaagcatggatgcggttcggatttatgatcctgtgtttatcttgcacttctcaatccatactcttctgatgggctatattgaacctgttgaattttcccgactagggctacttgcaataacattagttagcatatcatctcccgatgaagacttaaggaagctgggttatgaatctctaggaacattcaaaaaatcattggaggtactgaacagctgctatttattgaatattgatatgatattttgtcatactggtttattgaattcaaatgccactggttattgcctactctggcagtggcagccctactttgatttcttgttgttgtgttatattgctacactgccagctaaacatgtctttgtaatgctaacacattgaatgttctcttaactttctaggcacatatgtaatgtcatgggctcatggttttgatatttatttgtctcaaaccactgtgaaaagataatttgtattgacattctgggagcagtttgatttctggtagatgtgggactaaaattctgtagaaatagactgataatgatggtttgaaggaaaaactggagggtggtgagtagagtcgagaggaaccagactagagagaggaacttgaggggctaattcatttcttccttaactcaaaagagatgaggagttgaggaccctccttaactgatccaactaatacatatgataagcctgacaaataacttaacaagcctgaaaagggataacaaggaaatctgggttaactctttagtcatatcccatgcagaatgaataaagaatggtttcattacagtagatctgagtacagagtggttatcttctatagtagtcactaggtgtaagtgtgtaaagcttgtatgaataaagaatgttttcattacaataatctgtaattttcttgaagaatcactgcttctatataatacaggcttctcagaaaagcaaggaaacatggcagctccagcttcttttgacatatctacagaatgggatatctgaacaatggcagaggataccttctgttattgctatttttgccgcagaagcatctttgacactacttgatagctctcatactcagtttgctacaattagtaagtttttgatgcattctgcctctgtcaaccttcaggtgcgttatgtttatttacacctattaactagctttgaataatgaacacagcgtcatacttatatatactattttgttgtgactgcagagcattccattatttccagcattgtttaggagtaatgctgtgcatttcaaatctgaccgcttgtggatgcttcagttgttatatgctggatcaaacctagcagatgatgctaagatatacaaaagaggaggtgttttagagcttgctctttcctatggttcttcggctgtttcagattctgaaacaaagcttttaaccctccaggtaactctgtaattttctcgttataaaccgatttcaagatggtgcactatagtagttattattattactattactatgcacattagtagttagcctgctgccatttatatctagtaaacctttcatgcttagtatcttgtttgctgcatgcagtctaaaacacaaaacaacataagagcataacaaattagcaatatatgatactttgagtttgacatgtcgcttgacattaatttacctgctacaccacactggaagccatggactatgcagcacttgatgtgtattttttactgtaatttgcttcacttatccattttggctttgtatactttattttgccttccaagaatccagtaactacttcgaattttcaaatattttgtttttatttataatatcccttgtaacttaggtgctaaagaagtgtgtaaaacttcccgttctggctcatcatttaacaaaagactctggccttctgttgtggttatcctctgtaatctcatctcatgtcgaagggctggacagtgtaaaaaactcctattcttctacagtaattgggtcagcgttggaggtaaacactgttttacattactttctataacacttttatagatgagattcttgactgtacgagttggttattgtattttctgcatgtatcactgcagtcaaacatatgccttgagattggtgtaaaatcttcaaaattcaaaccaaaccacccatgttccctatccattcattctatcgtgttacctttgcacagatattgaagcactataactgggcaggacagtgcatgtacccacatatatacacttggagaaccatttctctaggatttgtcatattttttcatgaatcttgattgtaggttgtagcccatcatttctttcatgggatctctgctggtgaccatgaggatcatttcaactaactactttgtgggactgattcttgccgttgcttgatattactagaactgactgatttattaatgttgattttgttccttaagtcaaattcactctgcagtgatatttgctgtttccttgtgtcaatactttaaaagtatatataattattgcagctgtcctagtttagtttataacattaattggtgcatgcagttctaaatatatgtttctcactcattagtaatgctgtttctttagacaagttaagtaggttgcaactcacactcctgataatgccagtcagttgtttctgtcaagcaactactactgaaacatgagtcactaaatcatatctttagaaaacagtcaatgaacccataggattgatacaaacacactattttagccgtttgtcacctgcataccattaaccatcacagattataacatttgtttttctatgagaacgacattgttcaatggtctagtattattttatgatttggagagtttttttagcaatgttttgcacatcattttctttacgatagtattgtgaatctgctttttaatctatacatatgattttatgtcctctctccaggtagtgaatgatttgacatcatcaagattaattgcagaatggctccaagaaaccgcccttgagcaactctcaagaatatctaaatacctttatgtccttgttgaagatatgaaattgttgaaaggaaatgttccattgctaacttcagtgctaaatgtgattgcatcaacgatgaggttgtctatgaaaaggaagatttaccaaccacatttctctttatccctccatggcatacataaattgtgccgaactattggtggcatctcaagaagcatagaagttaagcttgcaatgcaacttggcattgatgtcattcttatgaatggtcctctgccagttttgtctgaaatggtacttcatttgtgccttgccttgtctctatctgtccctattcttgcatactcttgattcatgtggaatttataagattttactgtatatatttttgtgcctaaccatgtggtactgttaataactgagaatgtgcagtgccatgaacaatgtggacctcataattaatataatttgcagtaacatgtttcttttttgtcttcatatgcattttgtgtaatgggatttataaattatattttttgtgacaatggcaggataagtcgatgacagcaactgttgtttcatgggcaacttctaacatcttctggttgtgtgatgaacaaagatctgtactgaaaatgccacatgaagagccactaaaaaacgagtgcctactttctaagatgctgcgctggttagtggcttccataattcttgggaaaatctcctgcatctctcatgaaaagtgtggagaccttacaagggatgccaacaattttggatctcttgaatctttcttgaactatacatatgatgaaaaggttgaaactgttggcagtcacagtgcagatgaggcactagctataattatactgtacctgcaaaaacatctgaaaatgaaccgagattttttgccatctgtggtggctgctctttgcttgttgcttcttgacagatccaataaacaaggtatgtttaccgtgatttgaatttttaatctatcaattctaggtctaacatgcgcccgtcttgctaatgctttgcactcgtattttttttaaccttcttaaagcagttatcagaaacttcattggcgattatggacaaatcgaaatgctgtgctcacagatacaatgtccggctgaagctaatcctgcatggagatggtatggcctctagtgtgtaaaaccacatcatttacatttgtctatgcttctcttatgattagatatttttgtactgcaggatctaaccatgtttattctcccaggcattattatcaaccttggaaggatcctgctatgcatcgcaatgaggcagagcacctagaagaagagcaggcctgccaaagcctcctggttatgttttctaacagcttcagtgctgggctttcaggttttcctgtgttgtcacttggtgatgttgagaagtctggcctatttcagtgggaaagacattccatacttaaatagacgtaaacttcagtttgctgaagttgaaacggttctttaatttcccagagcccaatggcaatcaactgaccaactgactgaacggttacgctaggaggacttggtgtgtttgcgtaactcaaaacagaaattgggataatgatttatttcatcagtcatcactacaggactctatatgatgatgtggtaatatatcactattatccatcatttctattatgcgttgatatttattttgcagttatgaattaatgcgacatttcttcttttgctgctaggttcagggaatccaggtcgataaatgcctggaaagatttccaactctcagttttgaagcaagcatctgccaatacgaacctaacattggtatttgctgcataactgacctgtgtatacatatataatcaaaagaacgcctggtcctcaattggatcgtaaaggttgattgtgcctttttttttcttccttctataaacggctgagtatacctgtaccgagctcatcaatgcaatcgatctcttaatttgtgacaaggacatccattattattgctcactatctcttgcattagtcattttcactgggtaaactttattgatcttggagcatttggtaatgggaatgcttagtgtattaagtgctaaatcgtattttagttgataatattaaaaaaaaatctccatacaatttcaagaaacgaaggctgcagcttgggataatcaaattacataaagggaatccaggcacggagaaaatgagtacaacattgtatcggtctttagctctgttttctttagatagtgtttcgcttggagagcgagcaaagaaaagaacgaaaatatgatccgcagaagggctgaagacagcattggcacccaaatacaagctcaatgcttcatgtgctcacaaaatcaataacctttttttaaccttctgttgcatctacaaatccccaaatcaagcatgtatatcacgcacacaccaatctatacaacaatcagcacagcgcgtatgcacaaaactacacccattgtcaccgtgtgtgcgttaactaaccgtgaacttagctcatcttcttcttcccggtgttcacaggctcgagcggcttctgcgagtccgggaggctgtcggcgtacagcgagtgcaccatctccacatactcgtcgatcctctcctccacccacccgtccgtctcgatcggcggcagcaccttcacggtgagcggcgccggcctgacccgcaggctgttcttcctccacgccaggtgcgtgccggtcaccaccatcggcacgatcggcagcctcgtctgcagggccgtgtgcacgaacccctgcgtgccacgcatcgagattcatcggtgagtttttcagctgatattacgatgatgatgaggagttgctgaatctgtattggtattgtagtaccttcttgaaggggagtagccttccggttttggaccgtgtgtcctctgggaacaggatcagtgataggttgttcttggtaactgcacgagcaacctgggaacagcagggcagaagaaatatgagcatgctacgaaacagcacaaatgcacaagcacaatgatgcatcgacatgaacaggagtgtgtaaacatcactgaacttaattatacctctttcattgactcgattgcagcggcagggttagagcggtggatgcggaggtgattggccagcacgtagagctgcccgaacagtgggtaccagatgatctgcataaattgcaatttcagccacgttattagtacaatctaggcagatgattttctcactctcttgcatgctagcacaactgtgtatatacagttctatctacctcctttttggcgattccgacagtgccggtcggagccagccacatgacgaggaagatgtcgagcggcgaagcgtggttgcagatgaagattcccctcgtgttcaggttctccatcccttccagcttgatcggattccccagaatccacatctgcaagcaaaaaaaaaaagtttattcagcttcgctgaattcgtatagtccaagaaacatcggttggcttctcgcagcgttggttaccagcatgcggccggtgacgtggccgtagaggttgccctgccggatgcgcgcgcagggccacggcagcagcagcagcatcaccaccgcccacgccgccgtggtcgccatcatggacacgaagcacaccacgatccgcaccgccgacgccgcgcacgccgcccacccgtcgtcgcctcccccggccgccgccaggtacgccgccgcctgccgccgcgcccacggcagccaccgtctcgatcccgtcgtcgcggccgccacgacggtgtccatagctattagcttggtccagccagccagccgcagcgcgcgcgcgcgaacgctaaagcagcagagaggcgagagagcgtcgtggcgcgaagctttgtgtggttgtggagagctaatagagaaggttctggcagcaattttgataaattgacccattaagaaaatttattttaagattagaccttgccagaaacttagtgaggttctggagttgaacagcgtgttggttggttttgattgttgatggacacgtatttaaggtggtgcttatttaatccagggagtttgtatttgtgaagtggagcccactgtcagtggctccaagggctttgtttgactatagggagatcatactagaaatgttttgctttgctaggtggctgctagtatgttaggactttgactagtcacatgccataaacatggaaaatatttgttgtgcatctgtgtaggattgcagtatactacagttttttctgaagctggcgccgtaatatcgtagaaatccaactaaggtgtttaaggcctgtctagaatgaaacaacctttttttcacccactcgcacaagacaatacgaaatacgaagttaatagggaataaaaaaatttacaagactacagtcctgaaagatcgtaaccagaaaaaaaaaataataaccaccccacgcgccaacatcgttaacacttaaactcgtgagaaagctaacactggaccgatcattgctaaacgtgaccaatcgtcgcttggccaacaaaaaaactacagtgagattgtccaaaactcaaccctaacaaccgacaccggacttcactctgtccatatttttagggtcattttggtttgaagccaaaatgtgccctaccaaattgtttagcactttgattagtattttaatagtgtttggtttgctaccaatagcacacaaaaagttaccaaaatattgacactacaaaaacttgcctagattttggttaccaatattttggcatagtaacaaaccaagcacaccttagtattgaggaagagagaatgagagagaagaatggaaccgctctccccttaaattctccgacatggtaaacttgtataacccggagcgccgacactgtcagataataaatatgcgaaaacaaagtatcggatgttcagtgtttaatggcgtatccatcaatccatgcatgcatgccgttgttaggggattaattcagcccgtcaggaccacacactgacacacgtacatcacctgccgagaggaagaaaatctggaaagttcgaagagagactgataccacaactccgcaagctaataacaggtcaggtccaccgcaattgtggtgaaggggaacaagttcttcagtagcatttggattcgaaaacgatggaaacctgtcgatggtccatctgccccttctatggacgccatttggagccccctgatgggctgcctcgatccggatcacgtgtatctaagcagtgcccgtttagctacaaacacctggtctagctaactttaaacttgtggcaccgtcgcgtcaggtaacacgtcgtgtctcggtttgctcggccgacccgggtccctttccatcgaaaccccctcgcgaaatttaaagcgagaggggcagagggccactgaaggagccattccgatccaacttggttagagcggtgtagacgtacgtacgggcggcggccttgtgcaaaaaaacgagcgcgcccggtcggctggttgctcactttctcgttcggccactggcccgcacgcagtggcgcaccgatcgatcgatggaatcgcacgcatgagagggtggcaccgcacaacgccgggagacgaagctggcggatcagacgagcgagcgaggggcctcccgcgggaggcacggtggaagtagcagcgtcgcgtcgcgtatgcaacgttttcaccgggcactggccacgcgactgcacgaggggaagcggggtgggaattgggatggggtgtggcagaaacggccgggggacgggcgcgcggcctgtggccagaggaagctagcgcacagcggggaggagcgcgaatgcacgatcggttgggcagcacgcaccgtgacgcccgcgcggatcggtagatgtcgcgcgcgcggtcagcgtcccgcggacgaggggcgaaccgtgcgctgcgccgtgcgcggctcgggccccggccactttgatggtggtggcggctgggagagcaggttgccctgcttgtcacgctctcggtccctcggggtgggatgggcaaagcagatggacgggcgagcggccgctggagaggaggcagtttggatttctcacgttgctgcaaccacgtcactgccgagtaccgactgaactcgggtacaccagaacaaattaatcaaggtcccgaacgcgcgatcaagcaaggtccaacgcaataatggcgagtgaacatataatgtagtactactactgtagcatttggaagatgatgctgttaagggtttcgtattaacagttatacgtaattcgtacagattctgtaatctgtagatacgatccttgggatcaaatcctgattagttacttgcttatttccgagagtactgctacacgtactaaaattttcttacaaaacttttactaacaaatttctcaaccgtttgatttaactagatgaaagttgtaagaaatctagatttactcacagtttgacatatcagagtttgtaaacattttgtaagaaaaatttagtacgtatagactttttctatttccgatagcttaactttcacagcatgtctgatcccgatcatagataacatgtcttctatatactactagtatatactaagagattgtaccgtaaaagttctctttacaccaaatacatcggttgaaaccggtaatcctgcccgtttagccaaaaactgacaaactcctgctctaacatgtggcagcgttgtatcgggtagcatgatcgtctctgttttatcgaccggttcccatccgccaaaacttcctcgcaaaatttagcgctcaggccattgatggagagccgtttcaatccagctttggtgagcatcacattccaaaaaaaaaagtatttttggttttctaaactgaaaataaaaagtgaaagactcatccctccaaccgcctaaattcaaccgtctaaaacttaaaaatgggcccttctgtcaaactactaatagaatattccatttttttctttcacacatgtaaggatcgctatctcccacgcggtaactggagagagagaggcggagtgcaagattgggagtgagtttcacacccgcatataaatagagtgaggaatcgagagaagggaactcaaaattcgggtaggagagtaggtatatattggaactgtttttttaactaaaatctcgaaaaattagttttggaataagataagtagattgttggtgatgctcgatatcgatatggacatgcacccgcccgcacagtgcacggtgcacgcaagcatcggcgcgtcatacgggacaccggccgatcagacgagcgggtgggcggcggatgttggctcgcgcgtggtcactggttaccgacaccgtcgaaagatgacgcgcgcgcagggtggtgtgccatgtgcgggggccggggctcgcgagtcgcgactcgggccatgtacggtcgtggacccgtggtgccatgctacggtgaagttccgtgaaaaaaaataccggtaattggccagttgttgtggacaaaagtttgaatataataacattttgaattgaaaaactggtttccacggataacgagccgatcactgccgataaacccaggttaaaaaataatccgccttcctgacttcaaaacttaaaattcaaacttttggtgttaaactatatataaacataaattatatgctaaaataaaagaggaaaagaaataggagctaaaatatgagggctactactaaagttgatggcatatttaaggttttaaagaattggaggcaacccccatttgattgttaaggcacccacaatggttatatataggctctctacaagagatccatgtcagcatattttcctacttggaagagattaaatgaagagagagagcacagctatctactaacctggagatagtctatagagaaaaacgaggcaatgcattagagagctatagatacccatgtagacatactattgaagtagtttactattatctagtctattgctgagatgtacatgttttatagagagcaccttactttaccattgcgggtgctcttagggactctaaagtagaggatactactagagagtagagatgatgtaatgcataacatttttttctatagatccacctcaacatatatgttgcacggaatctgtagatcatgcaatttaaaatttaaatatggacttgaattgttccggccggtctaccaataatcggtcggcagctcagtgcaggtaaggtaaccgaaccctgcgcgagattagttaggactctggatttcgttggcggttggaggcgttagccgttggacgcgcggcgcgggaacgatgcagctgcacgtcccgtcattgcgctcatcttgatcatagcaaaggcaaaggccactcggccactggaagcaagcgcacggcgtggaagcactcggccactgggcaggccagcacacgagccgcgcctccaggcatttcccttccgcgggtggactgtcaaaacggagagattatggttatggagtggaaagagtggccggcgaaactccggcacaccgcacgcacaagcacaagtgcacaacataaacaaatcgaaggcctgacgcgtgcacgcgtgagaattgctctggcagaagggttggagaacgcgtgagaacgttggggagtgctgaactgctgatggccatgttccgcaaccatgtttgctgtctgcattagctctgtactaacttacgattcggctggcgaacagctcgataccgtgggttcccaaacaattgaccgagggtaaaaacaatagacatggagtgcagcaacaggagagaaccacgggcacgacacgacacgacaaacaactaatcaagggtaagtaaacaattgagtgtggcaacaggagagaaccacgcgtacgacgtactttctccgtccaaaaaaaaaaaagataaactctaagtttctatgtccaactttaactgtccgtcttatataaaaattttttatagttgggtttattttttttttttttggacagagggaagagggagtacaagtcaatcgtcacccaaatcaccttatccaaggagagctgcagttgaagcttttcttgtgaaataaatgttaaggcccatttaggcctactagtttggctgctacgtatcctagcgaattcagctcatctagtgaagaaacaacaccttaagcgcgaaacagggaggccaacaccagtgcgccgcagctatcagccacggtcacgaatgcccaggctgcgcagccgctattgtctgaccgttttcttctctccatgactccatggagacctcgtttgccaatcaaggttcacccagcagtgaacagcttcaaagccccaaggccttgtgttcctgcattagtgctatgagagaaccacgagcacgacgtgtaaaatagtagcaaagcctgatcaagttaacaaataactagtcacccaaattaccttatcaaagaagaacagttgaagctttgttatgtgattatattctccgacataaaccatgtcattctactctgctctatgtttttaacaactccttatgaaatggattgaacaaataatgactatgatttctcattgactaattacattggcaccacctcgtctgtgaatacgaggccagcacgtcttgaattcagcgctttctttttgctctagttttctcttgtttcaccttagtagtggctttctttgctctagttccagccgaacttttcttcttcgactggcgaaatcccttgccactttcctgttccgcacagatttgttaaattagatggcatgccaccatgcagtaaaaataacatcctcatgccaggttcactatgaattccaaactaaatatatttgtgcaactctaggcatatgtaaccactatatgcttaaattgaaaataaatcaaaatatgctaatattgtgtatgaaactagtgtggtgcaaacaaggataatgctttgaaattaatcataaaggaatgagcatatcaccctttggtattgtcggtaagcaacccttccagttaactcctggccatctttggagatatagacctgcagcccaaatccaatggagcacaacgatgaatacgtaaccaaaatacagggggaaacaggtcggcctccataatgaaaaacagtgcatatgcgacagagccttttttccatcaagaaatcaactagagtgttgaaaacaaacatgcaggtttaccttcttcccatcgtctccagtcaaccaatggccagagccagacattccagcaggatttactcttcttctgccaacttgagttgcaacaggcatcctcttgttcggagtcacccaccgatcattttcagcagcacaccggccggtctgactcctgtagaaggatgatgaaacagagtaaccaagatcagcgaagacattgcacagaggactgcaggatatgattgtgaatttgttgatgtgtgaaccgcaattacctgtactggagattttgtgttccatcttgctcatttcctctgctgtctactccaacaggaacaaaatgcttgagtctttgacggaccaggtcacgaaccaactggtcatggtggaaaaaataatgcattgcaggaggatgactatctgtctgattgtcctctagtacagccccacttggagtggattgatgtggaaaatgtcctccagtttcactaacagagtagttagaacgtatgactttggggccacaaaaactgttgccttctttctgctgagatggtctcgagtcttccacggatttgaaatactcattgcagaactcatcaagagcaggtgtcgcccaactgtcattcatctcagccttgcccttatgttgaacagtgctcactttggatttgcagttttgctgcaaaccaggcatttccttgttatcatccgagtcactatctgaatcaagcaaatgaattttcctcattgggctcaatgctgtcttagggagcagtttcttggtgctgctttcttccatagattttgaagcagaataattaggtgtttgtgcaaatttctttgatttacttgttgattggctcatcaggacaccatggttcatcagcgagaactttgaattgctggcatgagagaaccttgagctgctagaagtgatgcagctaccaacagacggcggtacgtctgcaagcagagaagttgttacatgttccacaatccacacaaggaaatgaagaaagttccgtaaaatatagagattagccagctgcagacaaatataccacatacatgatgaatgaataatcacaatagaaattgtgtggataattgggtgctgctggccacattttctttgtttcagcgctctatggcaaatttgcagtgttcctaactctatttctgaattttccaaagaacagatgagacatgggaagctaaaaagttagccaaaaaaactattatgttatacgggctgctagctctttgttgggctctttggctgacaacaaacaggatggtattggaaggggcataagttcctcatccagcagatgtacacagcacatgttggaatgtctagtcaaggggcgataccagaaaaatatattaataggatttcaagcaatcaagcaacaaatacaacaaatctgaaggcataattggtgtgaaatggcagcaagcctggttgaggatatcccagctaatttcttgtctgaagttagttctgaagattgaggaagtactacgggttgttcagtcttcagtgtaatctgaccagtgttattttggagatctactgagtgtgtggttttatggttgactactggattactcttatgttacatgaacaggcatgtgactccaaatcgctagaaatcactctctctatttttcagactgcaagttttggtggatgtctagtgtgtgctgtgctggttccagtaatttggctaaccttcagctttttgaagaagccaaattacaaattcattgaccaggagtgtgtacgtgtgtattactagattcagaataagaaacggaaatgcctagaaagataagtaagcacaaaaattcaagaaagtagggtcagtggttccctcacctcgcatgaatctctcctcgtcggtgaaatcctcgatctcatcctcaaagctcccaatatcccccaagacggccttcgagctcaccaccggagaagcctccatcgtagccggcgctggtgtcctatgaggaggtggtgttggcgcttgagatggcggcgcggggcctctccgcagccgcttgaatcgattcatctctggcggcggcggcgccgggtcggggacaacagtttcgtgccgccgttgctgttgctgttggccgtcggcgaggacgaagtcgtcgtcctcctcctcgacagtcccgagctcgtgacggctgccgccgatgagaacatcgtcttcgtcgtcatcgaacccaagggagaaggagggtgcatcgggcgcctcgtagcgcggagcttggcggcttgcgttggggaggcggggttcgtcgtcgccgtcgccgaagtcgatgccgagggagaaagagggcgcgtcgggcgcctcgtaacgccgctgctgctcctcccggtggcctccgttggtgaggtggggctcgtcgccgccgtcgccatcggagtcgataccgagggagaaggagggcgcgtcgggagcctcgtaacttcgccgttgctcctcccggcggcgctcctcaccgccgtcgctgccggaatcgatgccgacagagaaggatggcgcatcgggagcctcataacgcttctgctcctcccctccattgccggcatcggtgaggtgggactcgtcgccgtcgccctcgaaatcgattccgagagagaaggacggggcatcgggcgccgtataccctaccgcctcctctggctcgtcgaactcggagccgagggagaaggaaggggcagtgaagtccatccgccggcgacggcgagggagggatttggtggatagcttggatccgcgggggaggggggagccggcgagccggaggcggcggcggcggcggcgaggctagggttgcggcagggagatttgagagaggaagcaggaggggatcggcatgggattgggattgagccgcggtcgcaggatgaagatccggtggggaaaatttggccgggggattcacgctttggcgggagaactgttttttgggcaaatttcgtggagggaatcgaacgaattcgaagagtctcgatcgccactgctctttttttcgcagtttttatcgaaccagcaaaaatgtatgcgttttaaccagtgagataacttatacgattgataaaaatcgaaaatagacaaataaaacaacagcaaataaagttagaaaccatgtatagcattgcgggttacacgtgcttcatgcatcatggaacgaacaatcccttatgtacacttttctataatctcacaaatcaatcaagtgtctattacataagttgacgcattttactatacctcgtcaatcaaatgttgaaattttgtttattcattagtaaacattcttttactctagatggaaaggtatttgcaatgtaacaaacttactacatttcacattttaaacaatgataaattcaaaaggaaaatatttatgagaagaggaatttcgaagagaaaaaaaaagaaaagagatgagattggaagtagagggagagggtcaggattagcgagagaaaaagaccgccggtcggagaaggtgcacgtggcgtcgattggagacgcatgggatggtatgggtcggtcgagttagggtgggagagagaaaggttgagctagttgagttgggttgttttactcaacaaccgttggatttgaacgctataccaaaatcaactgatgatttcgtttttttcaattaactgcataataggtggtccctaaaagtatatactagttattttagacattcaaattaagtatggatttataactaactcaaatacggatgacgtactaaaattgtggtagaaatatttttaactttgacagagatagagatacattcagttcgttttccgtgggacccaaaaaccttgaatcctgtatgggccaaagccagttaaatttgtttgggctaagttgggccaacgttctcagccacatcaaggcaggccgaattctagatttttgtactccttccaggaagtttcaagctttgcttctccgcaataataatacaggataaacataaaatacttaaggggaatcctaagcccaaagaacaagcagcgtcgagagcaacacaatacagaacataaatagggggaatccaaagaatacgcaacaaccgagctactaatgcgtactacaccagttgaaaaggcattcctgtacctgcaagaaaaaatcgctcccctttacacatgtaattgctttgtctcctctgcaagcccaactaccatttccgaatcatgatctaaccaccgtgcccccaagattaacaaggcatcgccaaccaccagcatgttacttctacagtagactatacgagtagtacatactgtacgcggtacgccttgaccgatcgatctgcagccataattacggagcaaaacgccgctccaagactaatcatgcgacctgacctgaactacacctacctgatcttcgtcggagctcagaagtcggcaccgagccgaccagcgaggcaaatctatgggcatgttcacattttcaatctaaccaaattttagttaagttataaaaaaaatagctacatttagtttgctattaaattttggtaactatataagaaatcctactgaaattttgacaactttaccaaaaaaggtttttttttacatcaaagtgaacaggctctatactaatctctccgtttcaaaataaaccaatataatattagatgtaacatatttttatacgatgaatttgaacgatgtatcatatccgatacgatattggtttattttgatacaaagagaattattctactactagcctagacccccgtagagcattcgactacgccacatgcatactccacgcagcacgagcacgagaggatctgcagttaaaaatgctcatcttcatgtgtgtgtcgggtcaagcatgctgcacgctgctgctagtgctacatcgtattctttcttcccccttgatgagaaagctcggatgctgctactactgctgcggcatagtattctctcctgctagatccttatcacagacacggcgttattgtttacgaacgagctgtctccacgcttgatgggtgatgaatcggatccatccacatgaaccagggaaagaatctgaagaggagagctccgaacacagagaaaaaaagttgaagaattcacagatcacaatggggttttgccggtttgcgttttttacctttgcggcaaggtttaaattttgaattcaccctccactgttacgctcgcagaagaatcacaggcgctgctgtcaaaaaaaaaaagagaaaaagtcatagcgctgcgtgcgttgcgtcgacacgggcgcacggcctcgtcgtcgtcttcctcccggcgagacccatttttttttttactgctccccgcggccgcgatggatggagaaggacgagatgctgacgcgggcggcaggtggggcccaccaccgcgtgcagccacgtcgtcctctctgacgggtggggccctgggcccgtccggtccgacgtggcggggggtctccccgtaccctcgtgctcctgacctcggatgcctttttcccgcgcggctctcggccggtgctcgcgtccggagtccggacaccggacagcgcggcgctcgtgcgggatgccgccacgtggaggtgtgtcgtggtgtcgaacgtgtggtgtgtgttcggatctgtggtcatctggagaggttagcgaagcagttggatttgggattttgttgatcatttgatgatgggttcttcaatcttcaacggcgacgtgcggggtgtgagggctgttccgttattgccctccgttttggagggggacctgcggcggtgagccggtgacggcgatatgtcatgtgacgtgctgttgcgctttctagagatataggaggcgtcatctgagattggaccttgtcccctaagttaattgatgttcttttatgtgattaatttgcttttgttttgttaacttcgtatattttttctcacacaataaatactagaggacgtaacgtgtttttaagtttgtaaccataccgtaccaacacataaaagttgtctgaatttccaccacggaagatgtaccgtaccaacacatatgctgtgtagatccaaacttccaactttttccatcacatcaacttgtcgtacacacgcaacttttcagtcacatcataccaatttcaacccaaatttataactttggaaggaactaaacacagccatagttcctttccttcacattctgatggagaagtagtaactcgttgttctcgtaataagataagtactacattttataaaggagtggttattgagatattttgtaaagatgtagagaaacgttaacgtagaaatacgaatcaagatcctctgcattacatgttgtaatggagaggatttacaatatccggtattagggggaatggagaccgtccaaatcgtgcgtgctacagtaaatctaccgcaatactcaatagtgctatacaatgtgtttcgttattgttgctacaatgaatcgacattgttcactgcattgcattactgtactcctcacataaacagtgcccctatgcattactatagaggatctgatccgtaaaaacacatatatgctattttgagaccatgcttaaatattgatcaattttgacatgagaacaatggattatttttaagaaaaactcacatgacagcctcttggtgaacctatagtgtactgcagtagatcacacacccaaaaatcgtagacagtttttttttgttgcaacatcaagagagttgataacaaaacaaagccgtgcgtgcatccaaaatctccccatccatttaggctctgtttaaattctaattttttcgtcacatcaaactttaatacacacataaacttctaactttttatcacattattttaatttctttaaacttccaattttattttaacatggaaccaaacacagccttacccacgttaaaccgcggccaggcccagatccgtccttccactatctccacacactccccaaaaactccacacctcccctctctagtttacttctccccaccaccaccccctctctctctctctaatttacctcccgtttcccaacgcctcctcactagccaagtagccagccacccccaacgtctctctcccgtccctgcttctccgctctcctctgctgttcagctccactgcgtgcgcgtctctctccctgtcttgtctccgagccgatgccgccggagcgcgctctccacccgagccgcaccctccgtcgcagatgagctccaagcaccgctccgccgccgccgccgctgctcctgcggcggcgccgccgtctgctgtccggacgcctcgaaggctgcggaggcgcccgctgaagacggcgtcggggtccggtggcggtggcggtggcggtggggggcggcggagcgggcccgccacgccgctgctcaagtgggatgtggggaatggcgcggagaaggggggtggcggcggcgagaaggcaggtggcccgtcggagaaggcggctgcggcgcgggatgtgtcggtgagaaggctcgcggctggagtgtggcggctgcggccgccggaggcggtggcccggggcgcccccgcggggagcggggagaggaggagggttcacgtcggcctcgaggtacgtgcacggaggcttaaaccctttcccctttttcgtttttgattttttcccccaacaaatatgcgttgcagtgctggtgagctcactagaagctcgtgcttcgtctgctttttcgctgagctgatttgctgtatcgttcgtcaatctcctagtcaagtccagctaagaaagcgcgcattttcaatgctttttgatggatttgttccggtctcatgctatttcagcttgaatcaaagaaaaaacaaacaaaaactttggctagggtcatgtttatcctttttttgactaatccattactaccaaaatgctaagattccaggtcaaaacgcactcatttgttgcagagatgttcagatctcacgcaaaacatttcggagttcgccttctgggcgatttcttcattacaccatgcaggagcatgtaccatctgcctgctagcttcatctgcttatttctgccttaaactcgcctgccgactgccgtagtcaaatccattaatccattctcctcattgaagtgcttagcagtactagtgtcagtcgctcagcatcgacgcattcagtggtcgtcgtaagcgcaggatgcgtcgctcagaagcatggacatttatggagagctgccgtgctgagcccattgggcgatggccgtgatccttgtcgcataaatttactgatccaaaaagggcagttgcatttcctgctcccggatcccctcatgtgaacctggtcgggccccagtcattggattctccatgctcgtgcaactagtacaatcgaattgcccgtatggctacaaatgaattgtccgtatggcttaggccatttcgttggtgaaaacggtagtagcttatctccgttttacgaaaatgaatggtgcattggaagtgtgtgatttggaatttggatcttggttgggttgattggtttaagagggatccgatgagccaaatgattgaactcttatcccgtgcagcaacaaacatatgcaagctgggttcagctatgtggtcccttgtgagccactagctgaccatacagcttcttgtctcatccaattggagtctatcctagctacatcaaatggtttttgaactttgaaccttaggtctgatggggaatcctagccaacaaatgagatcgatgttaccaacgctacaagtgtggtcatgtaggttggactttaggttcagtgcatatgtttctgttttagaggggtctatctgtcatgatagtttgggcccctctggattctctgtgtttcggatgacgtcccatgacaattcactgttttgttatatatggaatagccccagtggtaaacagtaacatgaatttatacatatctaggggggaggggcctgctttctggaattctggatggatttgctgtaaaatctggtggatctatttttcttgtaacttatttgtgcatgtgcctttgtgacagcatatcccaagacatctacaagtccagcttattaaacagaataatttggttcatcaccaaacccttaagaatgagatttcaagcccaatttctgttttggaacgaaagagtggagagctccataaggtgaggcactgaggttaaaacctctgtatactttttgctgcaccagcatgtaagatcactgatctatttaattctgcaggtaccgcttcatgctgctacagctgtgctaccagtcaccgctatggagaaggcaacaaaatgggagccagagagcttggagggaatggaagcacatgatgcctatctgatagctagtcaactaaatcttctcaacgagcagcaagatgcaacttatgttgctaacctccagatggagctccagcaagcacgtgatcgggtaagtgaactggaaaccgagcgacgtgcggctaagaagaagctggatcacttgttcaagaaacttgcagaggaaaaggcagcttggcggagtagagagcatgagaaagtgcgcgcaattcttgaagatatgaaggcagatcttgaccatgagaagaaaaacaggagacgcctggagatgattaacttgaagcttgtcaatgagttgaaggaagccaagatgtcagcaaagcagctactgcaagaatatgataatgagaggaaagcacgcgagctcactgaggaggtgtgcaatgaactggcaagggaggtggaggaagacaaagccgagattgaagccttgaaacatgattccctcaagctgcgagaggaggttgatgaggagcgcaagatgctacagatggctgaggtttggcgtgaagaacgggtgcagatgaagcttgttgatgcaaaacttactcttgatgccaaatacacacaattgagcaaactgcaacaggatgttgaggcttttattgctgcatgcagttgtgctagaggagacattatggttgtggaagaagcagagaacataatacaggcgatcaaatctgttagagcacaagatattgaattcagatatgagccaccggcacaatcagaagacatattttccatttttgaagagctgcgtccaagtgaagagcctggcataaaggagattgagccatgctacaagaacaactttgctatgtgctaatcagaaattcaagaggcttgcccaatgactgatatattcctggaaaagccaacccaagtgtactcaaagtaaaagccctagaatgagagtgacactgaagatggcagcagctgggagacaattagccatgaagatatgcaggctttaagtggttcaccggatggaagtgaaccgtcagttaacaagatctgtgatggaagcatctcttggacgagccgaaacgattttgagtacaagggaactgagaaactggaggatgattcgactgatatatacctgacatacatgaaccaacccaagaagaaagaatcagccttatcaaagctctggaagtcgtcccgtccaaagaacaatgacgtctgcaagaaagatgctgtgaagacgatcaatggaagatcatctaatgttcgcctatccgttgggacccattctaccattgacagtggcattcaagaaataggcctcagctcgcgagcatagggcaatggagctccccggattcaatgagcatgcaattcaaccggggcttcaagggctgcatggagtacccacggacatcccagaagcacagcctgaaatccaagctcatggaggcacggatggagagccagaaggtccagctccggcaagtgctcaagcagaagatctagagttgccacgaccaccgaatagggaaaacattgtaagcctagaatttaatccaaggaataattccaagagtatttccatgcttcatttctcttgttttagggtaacttgtaatgtatgcactacagtactgaagaaaaagatcaggttggcctttgtgggccagctggagcattgctgcttctgtatctcactgtagtcctggtgatattgattccatttgataggctactgtgagatccattatgatgtataatatagacataaagaagcagcagtgttcagtcaaattactgttttagccattcatggttatcttccttctccccatgctgcaatgctgctgcagtactcaatggccattgtttgtctgcatgtttttgtttgtgttaaaagatgttcctgcatattactgcatggtgctataatcaagaaacgatctgcaacatatcttgattcttggccttcgtaagtcgttacggctattgattcgtctccagaaaaggaaccatgtgcaacaagaagtaggggtgacaatggagatgcacgcgagcagaagaaagaggaaaaactggatgcgttgcaatcatttgctcaagatggacaactggataggagaatttgtgtacagggccaaatttaggttggcactagaaaatgttgtataaatgtataattttatcagattattatgttagttggggttgggaacctatcatctccgtacggaaaacggagcgatccattagcgcgtgattaattgagtattagctatttttttaaaaaatggattaatttgatttttttaagcaactttcatatataaacttttttttgcaaaaaaacataccgtttagcagtttgaaaatcgtgcgcgcgaaaaacgagagagatgggttgggaaccagcggtaaagaacgcagcctagagatggaataaaaatgagtctctatgagatggtataagtgtatatatgagatggaataaaaatgaatcagttgatggtaattgtagaggtatttgtgatatttctattttgagatatctaagaatgtttaagtcctgaccaaatatatatcactaagatcaacataatcttggctaaaaaaaatctacatccaaaataatttcagcaaaaccaactgtgaaccaaagctttgaaatcacttaaagctgggctttacgtgcaagattggcctgtagcctcatgcatgcatcttgaattcactgagtataccttctgtaaggaaccataaatccactcaatctgtaatttagaacagttccgttacattgaacagagaactgctttttatttagaagcctcattacatttaagattccattttgcaagttgtaacaacgttaacagggtgacagttatttatttcacagaaatgaagagtaaataattttcatagcttggtacagtattagtaatatcgatcaacaatgttgctgagagaattgctgttacctcggatcacaaaggtgtaaatatgaagttgcagcttcattggtctgtcagaaatcgaacgtccccgcctatttcttgtagtcctatgtctagcaaggctatggctgcatgaaattgttaggagttgtgcaaggaatctggaaacattatctatctatgctagtgcttgaatgtttcaaattttctttttatcagttcgtaccatcgagaactttacatctcaaatctaagaacaacatcaaattgactccagtggaaataaattcataatgctaacccgttttcggtttggaatagatatgttatgcgtggtacacatacatagcagaaaaatctaaaatcgggcatatactagttcactccaacacagttcatgtcacacagggacgaactgaatcttacaatctagaatggctaagaaaaaaaacactgaaatagacgcgtaataataccatagctgtagctcgcgagcttgcttcttctcccaactcaagggaggcggccgcggtggaggaggccgagggtgtggcgcgcggcgtccaccaggtcgcggatgttgtggagcgacctctcctcggcgccgaagacgaagatggcgcggcactccgccttcttcgccagccgcgccgcgtgccccagcggcagctccggcgagttcagcgcccgcaggatccgcctgtacagcgacagcgccaccggccggctccgcgccaggtcctccgccgccgctcagatcatccccccacccatccctccgccgcctcggctcgccgccgaccaccggaggaagcgtgtgcttgatgagcgaggcattgggctttgaggcggcccaagagaagaagaaggcccacggcccattggatcgggtcccctgcgcgtcgccacgttgccaacctcctccagggtttcggcatcaccaccactctgatccgacgaaaccggcggcaaaatgcgcgcgcgcaacggatcccgtttccgtcgaccctctccctctccccagttcgagatagcgattggagtccggagcgagcgctgctcggatcggattgggtccgtggaggcgagcgcacaatttctcgtttgaggtgaggaacctaccacccgttgttcctgatgccgtgtgagttcgagatcgaagtgctctcgtcctatgattctttgttggaactcatttggttgcatggttagacattctttagggctcatactttctggtcgttgtgatgtttgtctgaatattattgctgcagcttctcgcatgtgaggaaaagagacagcattggtactctgaaattctggatgtctaaagttcttttttctagtatatgttgatttatttattcctgatgtgctacccgatgcatgttgttttggcaatttgcacaatgtaataccatgattctaagtttctaacatctaatgcatctaaaaaaggttgtctgctgcatagatcggtagtatccttacctgcactataaatctttggcatgtcacattttttttaccactccatcatgatatattttgccagtttataaaatttagaagatcttttaatgtttcattcttcttttagtcttaacatatatgtctgtctcttccatactatattttgttcacagaaatgagcacatgttgactgttccattttcaaaagctgttagaaactgagacccaataatgcatgtaatactggcactccctcttttacttgttaagcaccattcaaatgtattactttcatgaaattgggtgagtttcaaccttatttgatgaagacatgatccattgataacgcttgctgacaagtaacatagttttgcataaaattaatttctcggttgtgtgtctgtgagaaagttcccaaattgattgatccataaaattcatttgtttactaaaagaggaagttcattctacaccgtcctggttttctaactagagaggcatctaaaaatggaaaaccctaaccagtgtgctgattagtgcctttctgtttatgctcttttttgaaagcaagcatggttagcacaataaaggtccacaatgtctcacttgaagcatcagaacaagatatcagggagttcttttccttttccggtgtcatcgtacatgttgaaatgcaaaggttagtgctatgtccttcatgacatctcttattatttatacagagcaactaaccttcaaagacagctcacgaaggaggatatatggctctaacctttttgcaatgcttttcagtggtgacgagcggtctcagtttgcctacatcaccttcgaagatgacgaaggagcagagagggctatgcttctcacggtaatatgtaacggtcttttcttccagtaattgataatgatgtgcttttgtgctttagcacctatacattgcctaattgacttaatgtaataagaagctatggattcaaaatttgtcttattggttgtgctctctatatgatgtaaaactgtacttttctggtgcagggtgcgactatagtggatatgtctgtcatcataacaccggccactaattatcagctgccggcagccgttttagctgatattgaggtagaactatggaatttttgcatctctggtttggttcgcaaattgctttcagtaactagactttattatctttgaactgttagtctaagaacgctggtggcatggaatctgcacttcggaaggcggaggatgctgttgtttccatgttggccaaaggatttgtccttgggaaggatgcccttgaaagggccaagtcttttgatgaaaagcatcagctcacatccaccgcaactgcgaaagttacctcgcttgataggaagatgggtctaagccagaagttcagcactggtaccttagtggtaaatgagaagatgaaagaaatggatcagaaataccaggttgcagagaagaccaaatcagcattagcagctgcagaacagacagtctctactgctggctctgcaatcatgagtaacagatacatccttacaggggcagcatgggtaaccgatgcctatagcaaggttgcaaccactgcaactgatgctggagcaaaatcaaaggaaatggtggtggctgagcaggatgacaagcatcaagatgataaaccggcaaaggactattctcctataagctctaaagagtttgtacaagagggcaagcatcaggaaggtgaacgaccaaagaagaacatgccagaaaaacctgaaatgggtaaacgggagctggaaaatcaggaggccgcaatcccaacagcccatgcgcaagaaaatgcccaaataaccgggaaggagcataagcatcaggaggctgatttacctaaggccgatatacctggaagtttcacgatggccgcgaaaagtgaaaagcacaggaacccgtacagcgaattgtcgaaaacccatatcccaggaagccctgcaacgattcctgtctgcacggccactactgatgtgaacagtaccaaaactccaaagaagccagagaatgccgagggattcatctgatgatgtgttcgattcaaagaatgtaaatatggatgtgggatgccggtgatgtttttgattcagcttataatgtggaacttgccatctttcagatatcgttcacaattgtttcaagattttaagattgtaatgatcaccttttcgttactgtttttgtgcagttttggtccacatttgtattctaggtcccttttttatgcactactttcttatatgtgaaacaaactgtgccggcagttgtatccttagaacaaatcaagtatgccgtctgtttgttgcccgctcaaatgtttttcttatcctagactattgctgcagacacactttgtatccaattcggcaattcctatgcaaatatggcctatggaacatcatgcacttctacttgaactgttgaattgtggatggatttctagtcgaactgttgacttgtggacaaggcttgcatccaattccttgaactgttgaattgtggatggatttctagtcgaactgttgaattgtggacaaggcttgcatccaattcctatgatgcacttttactcgagttgcacagtatacctgattttacgttcaagttatattattaaaactcgatccatttgtaagggatgtaaagtggacttttttcttctcgcgatccaacgctttcaacgaacccggcccatacgatcggtcgggttaccgtgataggcgcgcgatcgatcacgcggcacgcgcgccatccgccgcccgctcgtttcaaaacgtgagcaaccggtccccccaatttactccctccacgtcacgcgccatctatcccaccgccatgtgggacccacatacatacgggacccactcgtcatagtgtaaacgcgtcaccagcaacgaaggcgcgatcccatttttggcacaaacctttttccctcctaaggctcgcgcgtccccgcccaaccctaaccccttcaaatacccccacccgctccctccgcctcccaccaatccgcgcctcccgcatccggctctcactgacacctcgggcccacatggcagccacacgcaagccccgctcctcctcgtcggccgccgccgccgcgggcgtcgtcgaccaccaccgcttcctccgccccggcgccctcgcccgccttcgcgacgccaggctccggcgccggaaccccgccgtctcccgccccgcccctccctcgtcgccttcgccttcccccgccgcgccctcgtcgtctccccctcctgctgcggccggggacggcgagggcggcgcggtgatgccgtacttcgtgcccgtatcgaggctcctcggcccgcggtgcccccagcggaagaagctcgcggcggcgaagagggtgatgctcttcgcgccgccgccgccgagcccggacctgcccgtcgaggtggccatggagttcctcggctcgccggacatggtggtcgccgctcactaggagggcggatcgtgatgtatttgctgcgatagacctgtagatttggggatctagctctcccttgtttcgatagttttgtggtttatgattttttttttccttgtttggttgtactgatatgtgaaaacaaagacaaaaaagaatacttatgctttgatttgctaaaaaaatacgaaagtgacagaaaagagttgcaatatgactggatgctcttactgtgatctattgaatgctctgtgaattgaagctattttgttcttgatttttctatgggtatagcatgttgtatttttcattgccgtgtgaaagtaaagaggagctggtattacttcagaaattgaaagctatttgtctacagtaagtaaatttgtttggcaactaccctcttatctgacataaatcttagtatgctttcttggttgtaactgctagtaaccaaaatcattagtcagagctgccttcgaattaactttggtcatgtttttctcttacatttcgtatgctcttaatagaacttcattctgcccagattgtgaaaatactcttgttatcagttcacttgcagcaatagtggcttatgctaaattcacattgaatggttgggagcatattcaggatgttttccaaattctcgcttggttttgatgatattgccttttctgtgactgatgtattaggttcatttgttctcggtgactactaacatggagcatcttcaactgcagccattagtgtcgtgatgtcgtcatccatagcaatcaatttgatgctttcaagttccaacttctgagaaatgtgagttgggcttatgtcatgcattgctgttatataccatctatgacttgtatacataatggtgttccactgttttgttggaacatgattcgttttcggaccagccatttctactttcttcatttagtttgtatagtgaggtgaatcgtagggtactgctaattaagacaattaagaacggatggtacgttctacttcgcttctttattgtgtttccttcttttgcatcttgttaagtttatagttgatcgctttagtaagcagtggggttttacatattatcaactgatattactgatccatttatgaattggtctggtcgacattgatttccatggtgtgttgctgttgaatcatttacatcttggcataattgctaaaagtttttctgttgaagtgcaaatgtcgcaatccttcgagtatttccctagtaggagctgcttaatgcctatccgccttttgtaattaatgacattattttcttctcagtttatatcacatcttagttaattagtcatgttagcatgatgcttgcaattactgtctgcaagtatggtgataccttgaacaaatctcaagtttcagtctgttagtgctttcgaatttgggccacctgatgtggttaaacccatgaacaatactgatgtggtgattgaatgcttatagtataatggtgcctactgttttttgtgcatttatttttgttctggtctttagctcataagaactcatagaaagcccacaaatgattgtcttgtgactatactgttagggtattatcgttctctagtcaatgtcaggactcaggaaggtctttagacggcctaatattgccatgtgtaatttgcagattggcctgaaatcaaatttcttcactcatgttcttatcttgtctcattaatttgaagacctatttatgttccacggcctcacactacaaaagaaaaataatatggcagaactgttgcattctcttagtctttcagctaacagaatgaaagtggaattctaggcagcaaaattagtattgctaactcatagaactcttccaatgaccatatgctccccatcaatctgtttactgaacttctaagcatgaatcgggtatttgttatgctgcaatgaaaaaggacagacagtttgtgtttcctgagttacgttttttttttcttctgaatttgttatgcactcaactaatctgtttccatgtaactgctactttacggcctacgttctacagttaacctgatacacgcttcagcaataagcaatcttgttcaatgtcgacggtttctctgtacaatgattctggaacttggacgtatttgagtcctgagttgttgctgctactattctgtcttacttccatttggacttgcaggagatggacctaacatgaggacaagaacagcttgcccccctttgctgttattttaggagaggataagccatcaatcaatcaagatctttacaagcaatgattcaggcacaactgctggatgcatcatggacattagacgagtcgagaactgactaggtgagaccgtgagagctgagaagcaactcagatacgtttctttcttcccttatcttttgtttgcttcaaatataacttcagtgttactaaacaataagcaggacgaacttctgtatgaattcttttggctttctcctaaaagctgggccaatgaaaattaatcttttgtctaaaaagttaagcagaatgaatctgacaatgtagtaccacaacgtactaatgcatttgtcatatatgtagaaaagatgaatgtttaatttctcgattgtgttattcatgtcataatgtattcatgctcttggattgtgagacaacactagtgatactttaagacacttcttgctcttatggtggaaatcacgtgtctgattcttgattttgttaaagcactgtagtactaatacactacaactagaagcctagatcagtgtagcagcaatattattaatagatttcactgactaagggtctgtttaggagtttaatattctaagaagtagttagttgatagctagtttctatgaatctggtttctagtttatcttctgaaatctacaactacatatttttatattctagacgaaatgttaaattgcttgggcaaacttttgattctgaaaaaaaagttatagctatcttaaagtcagtatagacgttaacaggtgactgcttgaaactgggcagtcggcgagatctaacatggaatgttccagaacccagcagggagagatgccgatccaccggaacggcgaaggcatacacggctctcgccatccatccgatgtccccatccatatctccccaaccaagagcagccgtccgttgcaacgccccctggcccactcactgacgcgccaggtttggccgtttgcaaccccgcgggcccctcctttgggatttgtagccttttgctcctgtctccctgcgctcagggccccaccaccttggcaccctacaccgttcacacaaatcccgcacaaattcttcctcttcgcgcagaaaataaaaagaaaaagatcgcgaaaatttcacgggaaagcacgggagcctttctttctccttcgatcgagcgtgcgcgcgtgtgtgtgtctgcggccagcacacagctgcgcatttcgatgcgagtttttggaaaccagaaaagaaaaagaagggaagggagtcagctctcagaagggagagggaaaggaaggaagaagaaggggatcagggggacagaaggaaggttttggcgctggcaatggagatggcgcatagcccgctctgctcccggagccggccggtgctcgtcgtccgcccggcgacggccgccactggcttcgcgcaggtgcgtctctgaagctgtttgggtgcggctgtgtcggttttggcctcctccttgttcgtgttctccgggttctgatttaattggtgctaccactgagaggccatgccgctttagaagatgaggccatgcgtggtcgaggcgttttgttccgttcctttgattggtttctactttctaggagtagaatttgttccggtcggttggttcatttcaggctttgtgtgtatctgaagactgaagtgaactttatgacaattttgctgatttgctccacgcattgaacattgtcggaaatttttgtagcttgggtgggaatttggattgtgcggttctgcttcagggatattttcactgaaatgcatgtattaagtacgattagttcaggaaaggtaaatgatctgcactcacacacatgtaccattttctgtttttttttccccagccgatcataaggtgcaggagatttacaaggacaaggcttctccgatgcttggtggcaagtgcaggttggtggaatggttttgttcaaagcacaactgtctttatgtggtacttctttgatcatgttttttttttcctgacattgcattgttcagattattctaagagaaacccaaggagagcctccactccgaaacctaaaggtgctgcctctagaacatatgctccgagacctactgttgaatccagcatgaagaagattggacaaagcggcacagatgaaggtgatcttggcacaagcaatgggaagctcagtagtgaagcaacagagcaaactagtaatgtagaagaatcatcggaggtggacttctctggaaatgtatcgagcagtgtattcttggagggaatggatgatgcttttgaagctgagactgaagaagaggtcgagcaaaatcagtctccagaactgtcttctgaatctatggatgatgatgcaattgacagaaaacttgatgaataccgtggtaaaataagtgcactaataagttcgaaacctgaacctacatcagtttctagcactcatgtacaggacagatcaattgttggttttcatgaacaagaaaaatctgtagttagtttccatgagcaagatagatcaattgtctctgttcccgaacaaagccagccaagtagtggtgtcagtggacaaaatccaacagaagagaaaaccattattagtggacaagatgtcaccgaagaagcaccagaagagataactggcaagagtattgagagggaaccattaagtagagaaactgagaaagttctgtttgctgatgatgaccctaggataatcaaggatgaacagtatgaacctgatatagcaccagtacaggatgatgtggatccacaagtgctcaggaggcggcttgaagagcttgctgagaaaaattatttggctgggaataagtgttttgtttttcctgaagtagtacaggcggattcggtcattgatctttacttgaaccatagcatgtcagccttagccagtgagcctgatattcttatcaaaggggcattcaatggttggagatggaaaaaatttacccaaaaaatgcataaaagtgagttaacaggggattggtggtgctgcaaactccatatacccaagcaggcttacagattagattttgtattctttaatggtgacaccatctacgaaaataacaatcataatgatttcgtcctacaaatagaaagcgaaatcaatgaacactcatttgaggacttcttggttgaagaaaaacaaagagagcttgaaaggcttgctgcagaagaagctgaaaggaaaagacaggctgaggaggagcgtcgtaaggaggaagaaagggctgcaatggaggctgacagggcacaagcaaaggctgaagtcgagatgaacaagaataagttgcaaaatttattaaattcagccagcagatatgctgataatctatggtatatagagcctcacacatacaaagcaggggatagggtcaaattgttctacaacagaagctcaagaccgctaatgcataacactgagatttggatgcatggcggttacaataattggagtgatgggctctctattgctgaaaaattaatcaaatcatatgaaaaggatggtgattggtggtatgcagatggtatgctatttcacacttttcatctcttgagagatgattcgtaacatgatagtatgtacatttaatcatggtatagctttcttaatttagaaatgcaaagagttaaaatgttatcgaattcaatattaagaagttcgttgacttggaaatcgtatatgacttgaagacacctactgatgtttgtttcctagaataaatgtgtatctctcatgagtgaattacatgccttggatctttggtgttttcttgcttttttagtctattactcaggtagcttactccttactttactccatgtatagttactctacctgaaggggcattggtgttagactgggtttttgctgatgggccacctgggaatgcaaggaattatgataacaatggacgccaggatttccatgctgttgttccaaataacatatctgaggacctgttttgggtggaagaagagcacatgatatttaaaaggcttcagaaagaaaggaaagaaagggaggatgctgatcgaagaaaggtcagttcaagagaatgtttgcatattaattaggagcattaaacctatattactgtatatacttggttacttgctactctttgttgataaatggtaatttatggccctggttcaagttcaataacacatccaggagggcatcatttgacttttgccttttgtttgtttcagtctgagataactgcaaaaatgaaagctgagatgaaggaaaagactatgagagactttcttctctcgcagaaacacattgtgtacactgagcctctcgaagtacgtgcaggaaccaccgtggatgttctatacaatccgtctaacacggtgctgaacggaaagccagaggtttggttcagatgttcctttaatcgttggactcatccaagtggtcctttgccgccacagaagatggtgaatgcggagaatggttcacacttaagagcaacaggtgtgtgtccttgttgggggtcttttttctgattgcatttttcatactaatacctcaattaaaaggtcattagacttcttcgagactagttcaaactactcttcctctcttactatggttaccagaaagaatctaataagcatgcaaacctgataaagcaggagttaccttttttcaaacatactaaatttgtgtaaaaatctaatcccacttgttttcaccgcatgcttttgaaattttttgaataatatgtcaatattaatgatattcccaatgacttttagtcccaaagcaaccttgggtaggaatgtaggatcgacatgaaacccaagtggagccacacaagaaaatgaagataataatgataatatataaaaagtaatattgtactactaataagaggtggtaggagctgtaggaaaagaaatttggcttctttgtcatggttctctctctgtctctctgtctctctttctctctctctctctcagatgcacacacacatttttgtatgatgatgttgtttgactttatttcctttgcttgacgtgatctgttcttttttctagttagggttcctttggatgcatatatgatggactttgttttctctgagtcggaagaaggtggaatatatgacaacaggaatggcatggactatcatagtcctgtgactgattccgttgcaaaagaacctcctatgcatattgtgcacattgcagtagaaatggctcctattgcaaaggtaaagacaccttttaccaattcttttggaccacagaaagtgctgaggtactaaaaaatgatctgtcacaggttgggggtcttggtgatgttgttacaagtctttcacgagccgttcaagatttaggccacaatgttgaggttattcttcccaagtatgactgtttaaacctaagcaatgtaaggcatcctggcgtcttccttttcggttgcattcttttcagtgtttcaatggaattctatggaaatgctatgtatatgcacagtgcagatggtttctttcttgttttatctaatatatgtagctctggggttttgtggaatcttaaagatactggcaaaaacaaagtgcaaatatcaaatcaactgtaagtgctggagcaataggtggttcaatggttgcaactagtccctctaaacactttaaattctgtggttttcacttttcacttttgaaagagcactgaagcatttctcgtgaaatcaactatagtccatgcttttatttttacgatcatttgcttccttcgctggtgagagtgtgaacatcgctgtttgtgggggcttttttctcattaatttacttgtcttttggttcaggtgaaagatttacattaccgtcaaagttttacttggggtaatacagagataaaagtatggtttggaaaagttgaagacgtccctgtttacttcttggaaccacagaatgggtatacagcaccttaccttattacacacgtgtagaccattcttgatcactccatcgttttttaatatatgatattgttgacttttggtcatatgtttgaccatttgttttatttgatttttcttttttgcaaatagaagtcatggttaaagtacctttaatgacaaaacaagtcacaacaaaataaatgatagtcgcatatattttttcaaataaaatgaatggttaaacatatgtctaaaagtcaacggcatcatatattaaaaaacggagggtgtacataattctttttccttctgtcaatgcacccttatttatgataagtaatctattaccttgtcttttagcataaaataaggtttgttctgacatttttatttgcaggatgttttgggttggatgtgtctatggaagaaatgacgagagtagatttggcttcttctgccattctgctctagagtttctccgccaaaatggatcttctcctgtaagtgcaagatttgttccataagatttaagcttttatttcgaaaatgggtgcaagagatctgcccctttgattatagtgtaggaaaagatttaagttttttgtaccatgccattttctccgttctcgtacttggccatgaactaatcacaatttatatgtgaactcatcttaaaagaactaatgagtcaattttccagttctgttcatcacaaattgattccaagcagcagctagtttttgctatatcgctgaacgtttgaaccatcactgttcacagattttgtactgttaccttttttttttttttttgcttccacccttctcatacacaagtgctgtcattctgacaggatattatacattgtcatgattggtcaagtgctccagttgcttggctattcaaggaacaatatgctcaaaatggactgtcaaatgggcgggttgtatttaccatccacaaccttgaatttggtgcacatcacatcggcaaagcaatggcacgttgtgataaggctacaactgtgagtgacctgaccgtgttctgtttttactatcgtgtttctttttcaaattcttcaagataccattttctatgtgaacgtatcactaatgtgtgcttctcattgtctgtttttaactgttttggccataacttgcaggtttcatatacgtattcaagggaagtgtcaggacatggtgctattgcccctcacttttccaaattccacggtattcgtaacggaattgatccagatatttgggatccatacagtgacaattttatcccggtatattaatcaccattcagtatattcattcatattccataactgtgcatttactatcttcttggatctgtaaagtgtataaagagtgcatgtctagttaagaagttgattatctgcagctaatttgattagtagcatacatatgcttatattcgctgttgatcaaatatccaattctttgatttagtagttgtacgggtatttgctcacttaacatttttttggggtgtttctttaaggtccactatacctctgagaatgttgttgagggcaagagtgctgccaaaaaggcattgcaacagaggcttggactacagcaaactgatacccctgttgttggaattatcagtcgtctgacagtccagaagggaattcaccttatcaaacatgcaatttatcgaactcttgaacgcaatgggcaggtctatatcttgctcatagatgccacactgtttgatgcatatgtttcttgccatctatctgttattctatttttcaatactgaaacacattggctttcttaaataggtggttttactaggctcagctccagatcatcgcatacaaggtgactttaccaacttagctagtaaactgcatggcgaataccatggtcgtgtaaagctttgtttaacctatgatgagccactatctcatttggtaagtttcacactctaccaatagcaacttatgttagaactggaaaactgatttatagttgtgtactaaatctatggttctactgtattgtagatttatgctggtgccgacttcatccttgttccttccatgtttgaaccttgtggtttaacccagcttactgctatgcgttatggatctatcccaatagttcggaaaactggaggtgcgttgtcatcttgatatctccctgacattgcattgccttttggtatttctagcatcgataaaagatacgccgagcattatgcaggcctttatgacaccgtttttgacgtcgacgatgataaggatcgagctcgagaacaaggtcttgagccaaacgggttcagtttcgaaggagctgacagcaacggtgtggattacgcccttgacaggtaagtataacccataggagttaacacaaattttaatgctacgacgttaataattcattcttttgctatccaatttcagagcgatcaccacatggtatgatgctcgcgattggttccactccctctgcaagagggtgatggagcaagattggacatggaaccgacctgctctggactatatggaattgtaccattccgctcgcaagaactgagacctttctagccccaagaacacatggattttgggaagtaggtttccccaggtttctgggacatgccggcatcccagtacataccctttctctgggtaccattctttagacagaaagaaaatgaggagaatccaatcccggcttctacattgatctccagcgtcagtaagagatcaattaatctttccgttatcctgcggttgtgagttcgccatcgtacggcgcccgtgcgtatgtgacatgcaggaagctcatcgtgcttaaagccagttttgcaaacatgtaccatgcaaatatgttccattttacgattctgcagtgtttcggatgtacatatgtaaggcagattagatttgtagggcggatgttctctctggtttattttctgctcactcggagaaggaatgaagtgcgagcagaatggcatgtgacggcctgtgtagctttttaatttctcgtgctgacatctcaaaattgatttcaaattggcagcgtgaaccaaaccatcaattgaatactctaaaagtttcaaagtttttaagccaatatcatccatgctcattatattactggcattattttgtatacaatcattagtcacacacatatcaaacacaaatccgtctctccatctgggttcacatgtatagatgataaatatacgtccacggttcacgttgtgcttcacttagcgtagccgatgctgacgccggcgacggtgaccgaatcgcagccacacctcggcacgatcgacacgacgatcgtcttgtcgccgtcggcgccgatgtcgtccagcaagtcgcatatg

SEQ ID NO: 7061 - DNA, 6329 bp, Oryza sativa
gcgtgctggctgctcccgtggacggcttggcgttcagccacggaagacccacgtcctggtacgtgaagcgcagcgccgacgggtcgagggtgtcgcggacgcggacgcggacgaggcgggcctcctcgtcgtagaagaagaagctggcgtcgagccagtcggggtcggtgaagtcggtgtcgccggggaagaggaggccgcggcggatgtgccacatgcggtcgacgttgccgtggtgcgcgaagaacaccgggtcgcgcgccgccgagtagaagatgcccatgtcctcgccgttcggctgcctcgggtcgccggtccatctgtggacggggttgtgcggcacgctctcgacggtgcccgcccccggctccggctggtcgccggcgcggtacggctgccccatgaacagctccgccttcctagctcccgaaatcatctgaaacatcataaaattttgttcgtccaatcttaactcataagtcgattaatttggagtttttgtcatctattattatttatatcaaaatttgtatgtgattactggcctggcggtacatgatgttgaggttctgatcgatcagctggtctttcgggatgttcgtgtcggttccactgtagtcgaggtcgagcgggaacggtggcaggtgagcctggttgcgccgcgggtcgtacagcggcgaccacctgttggcgtacatcgcggggaacgacatgccgtccggcgcgtcccagttccagaacggcagcgcgaacgtctcgtcgccgatcagcttgcccagtatcctctcatggaagtacaggtacatcctgcacgtacgttcacacgcatgcgtccagcgttcacagaatctcatgagccactcaaataatcctctcatttttacatgtcaagtaaaaagtcatcaaaaaaattaaaaaaatatagcagtatagatcaatattacatcaatatataatatgttatttcacaaacatacaaattcaaattcaacttatacaagtagaaacaaaaataacaaatttaactgcgtaaatcacggtcaaatttgttgtttttgtttcgaattgtataagtcgaattttaactcgtatgtttgcgaaaaagatataccgtatattgatctatcttgacaaattttttaaattttttgataactttttgaatgacatgtacaaaataagaggaagtcgtaaaaaatccactccccatatatatcatgcatgcaactgtacacgaacaacgcgagacgtgaacgtgatgcagccatgttgtcacaatgtcacgtacctgtgccatgggaaagaagagccagcagctgtgtatctggatctccaagccggggaagccgacctggtcgtacgcgccgtcgcagtaggcgcagtggacgcgccactgctgctcgaagctgcgggggtcgtcggcggggagcttcttcatgagcgacacggccctctcgtacttggccaggtacgccctgtccgccaggtgagccgccggccgcacgcggagcggcgaggacgccggcggcggcgcgaagtcgacggcgacggtgccggcgctgtacgtcgggcagcagttgatcgccggcgccgtggcggggacgtccacgggctggtggcagtcgccgaggtccggggcctggatgggcgccgcgagcgcgccgccgccgccctgcgtggccaccatggcggccgcgccgctgatgccgaggagcacgtcgcggcggtcgaccctgcaggacacgttccgcggcttccaccccttcgtcttgcggtgcaagagcaggttgttgtagcgaagggtactctgaaggttggtgatgcacggcggcggcggcggcggccccatgcgaggcgtagcggttgttcctggtgctacgttgatgctctccatggcggcactgcgctgtgaacttgcacttgcaaagttgcaatagcgtgtgtatttatagggcaatgtgtatactactatactgtagtagcccactggttgtttggtactttggtgtgaccgtttgcagggccgcgcactaacaatttgggagactgactattataaaataggatcttattcataaaaaatactaatcacacatattccctccatcccaaaatataagtatttttagactctaacaagatttccgagatgttactttaactaacaatatctataaaagtaggatgttttaaataaaaaggttatatattataataatttgtttaatgatacatctagtaacatcaattttatatgagtgatatttttttctattaatagttagagttgaaaatgtttgatctatcactatactaaaaatgcttatattctaagacgaagggagtaatgtaccaagactgtataattttttaatatattggaatgggtctctacactaccactgctctttgattaatcttcatgacaactagtggccctccaactatacattaggaaaactagtatcaatctaatgcttagctattgttgtagtaattaagtttctcactaaatagaaaattgagatatgattcttattacctggaaaacacattcttatcatagtcacggaatacagttcatcttatcatcgaacatttattggagcagagagaaaataattctttctactcgattcagtggaacagaaagaggaaatttgaaaaaacgaagtgaaattaaaagatcacatcgaaatatattaattaaaataggaacacacaccgatcaccttctactggtgtcgtgtcacactgtcactttgctacatctctacctagtgcacattagcaccacatataccaagtcaaacatatatccgtcacttaagcaatcccgttgagagatatcatgtcagctcgaagtagttcagagattaacctttcacccagcggctcgaaattgtcaagtgaaccagttaataactatgcacccgtcaacaacagtttcactgtcgttacgcaaatcggaaagctcccaaacgacctgacctacgagagcgttgggcgaaacactccatcatcctgtgcgtgaatcgtctgaatatacacgcaattcatccggccaactccgctacggaatcacggatatgcatggatgatggaggcagttcatcccaggtcaactaacccttgcctaaaacggccggagtttcagttcaggccgggcggcgtacgtcgtttggacgctgcaactagatgactgatgacttgtcggcgtcgttccgccgtccccggcgaaaaaaatggatggctgacaaaaactgcgacggtgaagaacgagcgaacgtcgttgatcatatcgggtcctttaccataataacaatatcattagagacactgatatgtgaaacaataggagagtaagacttattccctccgttctataatataagagatgtgacatatcctagcactatgaatctagacgggctctctatacagattcatgtattagaatgtgtcatactccttccgtttcaaaatgtttgacaccgttgactttttagtacatgtttaaccattcgtcttattcaaaaaattttaagtaattatttattcttttcatatcatttgatttattgttaaatatactttcatgtacacatataattttacatatttcacaaattttttgaataagacgaacggtcaaacatgtgctaaaaagtcaacgatgtcaaatattttaaaacggagggagtatttctttaaaatctcttatattatggaacgaaggaagtacataacagtcattgtaatgatagtgatattatgttagaggatcctcacccaatcagatcagatgtatgcgatgtgtcaaacacgtggcagcaacacttatagagctattttggtttgaagccgtaccaaaattttggtattgccaaatcttgggctagttttggcactaccaaaaattttggtagggctatgttgtttctaactctattgaattagtaagattaacctcaatctaaatagctaacaagtactacaacactactaccaaataattggtagggcaagaattggttttaatccaaacatacctttaagttcttaaaggttgacataaacggggttggtgtgcagtgtgctctgcctcgttgccctgatggcttgtttgggcctcagactggtccttccacatgtataggccaggagattgaacttaaattttggcccatatacataaagagagaattacttatataccactagaatttgaccagttcccttatatgacacttaaaattggcttctctctagttcaagtttttccaaccttttatgcaactcccaccactatagtgttagttgactgttagtaaaggatagttttttttcgtaaatgaccaatatgccctctcaactaaaaaatgtgtaaacttcaaaaaatcataactaatttattttaaatcttttttgagtgaacaaaattttgtcagaactagtgaaaaatgctctttatattaaaaatattgttggaaaactgcatgattcatgcttacattgaaaatttatttgtgatggtaatggctaaaattgcatgtgatgcagaaaaaaatcaattttcatatgttgtatccagtagttatattagtactaaaatacctattattggttgtatactaattcttaagggcaattgcgtctttttacaatgaagttaacggtcaactgacggtggactgacggcaatagcataaaagggaggagaaacttgaaccgatggcataaaagggagaagtcaatttaaagtggcatataagaaaaccggttaatttagagtggcatataaggaattctctcatacataaatggtctgggagtgtggcccatccgaacgaggcctgactagcgaaaaggatagagcactgcagtcagcatagagaataagagagtgggcctagaattgctgctgaatggatcgagctgggccgagccaggtcatcgttgacactcctcgtgaacttaaggaaaaagtgtatttcaaatccttcaactatggtcgaatttaattcacatctctcaactgtaaaaccatatatatgttatcctctaaatttttaaaacggtgcaaataaaatcactcgacaatattatattgatccagttttttagttttcaataaaaaaagttagatgaaaccctcgtataagtctctcgaacaaaaataaagaaaaatagtagaaccttttttcctctccctccctccagtctctctccccttaattttctcaacacctcctagggggtggcattgagggacctaggggataagaggatatcattgccatggaaccgaggagatctgtctgacggtagaggtgggcattagggccaggatgatatcatgatagagatgggttcaggactccacaccttgggcactatagcagtgtgtcccagcctcatcaagaaacccaagtatcaacgtaggaaaaaaaatgatgctccgatatccatagttcgtgtagctttaggtgggcccaccaccattgttttaggttggccccaccacgaaaattactatcatcgtcatctccttcctggagcaacatctcccacacccacctccccaacctccgccgcttgttccccatttctctctcttgtcctctccctcacttggcttcccacgacggtgcctcccgccccctcctcctctccgtcctctcccatggcgacgactcccccgccccccctctcctcccaccggcgccgcttgggagaagacgcggcggcaccgggccctctccccttcctctccctagcggatctgttggcagcgagggtgatgacagcgagcgcctctccccttcctctccggacttctccctcggctatcccgagcccacgcggtggcgacggccttcctgagtctccagtcaatgccgccgtcagtcccctcctcaggtgacacagatcgggagctcggccgacggcagcttcctcgacagtggcatcatcgttctctactgctcaatggtggcggaaatattggaggagaggagctgaagcttcctacccctttccgaaggcgcgacatatatcttcttgcttttttttggcaatgctagctgaccgggaacaagtgtctctcttttaatgtgcgggctttaggtgagtagcatcagaggcaaacatggcacagtatttttcaacgtatcatgctcgggctgaatgacaaatcggcgcgccgtaaacacccataagtagtaacaacggcgttttaggcatagggatgagcaggggagtggtcaacgctcccctacgagctgtgctgctgattggttgcgggtgctcggagtcagttccgttat

SEQ ID NO: 7062 - DNA, 20669 bp, Oryza sativa
  unsure (1)..(20669): unsure at all n locations
tcattagccatccaatggcttttgtctgctattgcaaattcgcgaccatgcgacgccccgtacggatggacatgctgattctgcccaaagttctgcgattctgcagtctcagatctactacatgttaccccttaaaaaaaagtggattaagtcttggatattcatgtcacgcttttcaaactattaaacggcacgttttctgtgaaaattttctatatgaaaattgttctaaaattttctatcagaataatccatttttcaagttcgcaataattaaaactcaattaatcacacgttattaccaactcgttttgtgtgaaacacttcattttcatctttatctttatcttcatattcaggggattcaaacaccacctctgtaactcaaagattagattctttggacgcaggcccggcttagagctacggcgaggagtgcgacggcctagggcccaacgtaagtaggggcccaagatcaggtaagtaagtacgaactggtatgccgtatacgtgcgtttacctttagaaactacatacgtatatactgcgagcaaatgcgtggcgattgtttgtggtgacggagcaaccgtgtccaactgatcacgtcattgctgcctccgtggaaacatgacctcacaaccttcagttttcaggtactattcttgagtgagtttgtattcaagtaagaagtaactaaggagtatgtctcttaactatctcatctgctcggtgaaaggccaaattaccacgagaacatactatgtttaggccctatgacaaggcttggctgtgtgctaagttgagaagaatgtgatggataatattaatctcattacattttttaaagattttgcatcaaaaatgtttaaaggagtgtatttttttcgtgagaagccatggatatttgtaatctctttatttgtgaggtattattgatagagtcgttagacagttagagtttgacctttattcaaggtattcatattagctccattttgatgttctttagttatatacagaagatgttcaatgtttatttcatcagaaaatatatggtttaaaaatatataaatagaaaacacatattaagagcctacaccatcaagctcgccctaaggcccttcaaattgtagagccggccctgtttggacgaatgctctctttagcttatcttctacccatcttaagagcgtgcatgcctaatggcatgccatctgatctctgaagccttaattcctcgggttgttatctgaaaaaatgatttcaaattggcagcggttaccaaatcatcagttcatgcacgctgatgcacgcattatttttatacaatcatatcctataatacaatataagtgatccttacttagtgtagttattagcaattctctttgttcttatgcttccacgtcacctccctcttttctttcagccattcgatgttaattaagcgtctagcgtcacatgctaggaacgttgcacccaacgctacatgcattccgcacgcttgccgctgccgtcttcaattctatcagggaatgatacgttttctgccgcagctcgatgattaatgacatacgggtaactaatgtggccgaaactgccaaggatccaagtagtccaatacgatataagtgattgcactaccgttttccccaagaggagctcaaaagtcatgtctatcctataaaacagaagcatattcattcagggaaaggggttacaagttcaatcgattggatgttcctctcatcaccttgatcatcgttatccctaaaatcctaactaccaccggtgggcattgaggttgccatgcttgcaaagtctgggagcttcgctcaagttgcctcatgtagatcaacatcacatcgccgatcaatcaccggtcaaattgcaatttccttctgacttgggcagttgggggtacaaaattgaaggagataatctctgtaatcatattctatttatttctaccggatatatcaactttaccgatgtacaaatacatggtaacaatatccctttctgttgcattagtttatttttaaaagaaaaaaacaaaaggttgttatacatatattagctagattgttgtttgtcttcaccactatatatatgcagctaagtaaggccgacaacatcatttctgatcactatcggctaaatcgtccattcggtctggtcagataagacatgagaggtgctattttacaccgcggcccttttgttaattattattttacaatttttaagttggtttccttgcaaattatatattctcaatccattaatttgaactgtttgaactgagttttttatttgacaatcgattataacaaaagccagtactgatcgagaccaaattacatcatgtatagtttttatcattgatcaatcatcaacgatgtggaccatcaagtttttcattgagttttatgccttacactcaattggattcatacctactttgttatttggcttttcttttgtaatgatattaatttaatcctgtaaggcagttaaacaagatgttagcggtagttcaacacgatgttagcggcggttcaacaagttcacatctctaaaatgatttgtatatcccgcagcaacgcgcggggtatcattttttaatgacagacccacacgcgcctacaccattacacacgcaacatcacactcatacaatcattaatcacacgtcacacattgtacataaacgtattcttacgttcacgttgtacttcacttagcgtacgtagccgatgctgacgcccgagactctgaccgaatcgcagccggacctcggcacgatcgagacgacgatcgtcttgtggccgtcggcgccgatatcttcgagcaagtcggagatgccgaacctcgccaccgtctttctcggagaacgcttcctctcctcgcggtggaccccgtgtggcgtcagcgcgacgcgacgtcggcgttctcgggcgcgttcacgaacacgtcgaacttaacgtacgcggagtggtcggggacctcgatcccctcgatgacaggcgcctcctcctcggcgtccttctccttgcggctcctcgacgtcttgggcctcgtcaaggccacccgcacggtcttgtccagggtccccggcagggcgccggcgggtcccgtggacggcttggcgttcagccacggcagggggccaacgtcctggtacgtgtaccgcagcgcggcctcgtcgagggagtcgcggacgcgaacgcggactaggcgggcctcctcgtcgtagaacaggaaggtcgcgtcgagccagtcggggtcggtgaagtcggtgtcgcgggggaagaggccgtggcgaatgtaccacatgcggtcgacgttgccgtggtgcgcgaagaacaccgggtcgcgcgccgccgagtagaacatgcccatgtcctcgccgttcggctgcctcgggtcgccggtccagttgtggacggtgttgtgcagcacgaactcgacggtgcccgcccccggtttcggctggtcgccggcgctgtacggatgtcccatgaacagctctttcttcctagcccccgaaatcatctgatacatcataaattatactgttcatattagacacgcgatccaatttaaagtcgactaattaatttggagtttgctatctacggttttcagtagctacttcaattaattcctagtttgtgtcaaactgtgtatgtgattactggcctggcggtacatgatcttgaggttctgatcgatcagctgatcttccgggatggttgggtcgtgtggagattatggatatcccatatctacacggcgatgatatttggactgaatataggataccgaatatagatagaatatcttatgtgtatcctgggtttgtttcttaacttgtacatcaaggaaacaccttgagacttagtcggtcacgactgtattttatctgtatttacatattccgttagggatatagattatcttttgtaacacggactctttcccatatataaggggggtccgggtgcctctaggggcggaggttggattttctccaaatcatacaatcaataacacactcggcggattcatccccggacaggagtagggtattacttcttttgtaagaaggcctgaacctgtataaatcctttgtctccaaacccatacactttcctagcttgatagccacccccttttattattgccgaaatctagtttcgacagttggcgcgccaggtaggggtagcgtcaagcttttcgccgatcagtgcaatgggtttcgtctccggcatcgacgacctcgtcttcccgcccgggcagacgtttcggttcggcagcctcgacttcgtcaccaacaacttcggcaagatttctctcctcgactcggaatcagaccagtcgggagagaaccggatttcggtcccgtttggattcccgaacgcggctgaaagctacttcaagaccatctcaaccgagtcggcttcaaaccactcggccgagatcgcatcttctccaacgacaccagatcaagatgatggggcttacccaccagtcctgatgaagctccccgacgatttagcggccgtttccaccacgacaacgtcttcatcccgtaggcctaggcggaagtcggcttcaacaccgatttcgcctagcttcagggaagtcggcgtcatcctccaaccactcggcacggtttcgacggatcagctggatgactacaacagctctcccaccgtcgactcacgtcctactgacatcgtggagtacgacgaatttagttctcgctacaacgacttcgacgacttcgacggaagccttgatgacaactacacccctctctactttggcgttttcatggccaataatgagacggaggagcaacgccaagcctgggagaccgaagaacgtcgccgactggaggaggagcatcaagcacaagaacaagaacggctacggcgtgagcagcaggaccgtgagcggaccgcgaaggaggctgaggatcgacgtcagcgagctttggaagcagggcgccgagcgcgtgatctcatcgaccagcaagatgtcgaagggacaccggttttccgcacccctcaacagaatgcggttgccgcgatcacccttctcgacaccctcctcaaccaaaacgagctcaatcaatccgatcacgtcgtcaacatcttgaaccagacgaagaccatgattgcggcttcggtcccagttaactccgaaagcgtccacacgccgactggcagccgagtcccccacttccgatctcatgactaccgtcatccaagcctcagcatcaccggcgcgggatccaatcgcaggagcaggggtcacgacgagcggtccattcactcacctcccgaccaatatagggagcgccgagtggaacggcctcgctcaccacctcgtcgccgccccgtcgatcttcgcgacacaatcatacagcgccgagcagctcgaggccatcatcattcgccgaaccgccacgacgacgaccttgacggagtagcagccttcaccgacgacctgcgtcgagtggattggccagccggcttcaagccgactggaatagagaagtacgacggtaccactaacccagaatcgtggcttaccgtctacggtctcgcaatccgcgcagcaggaggagacaacaaggccatggcgaactatttaccagtggctttagcggattcggcccgatcttggctccatggattaccccgtggtacaattggatcttgggctgaattacgcgaccacttcatcgccaacttccaaggcacctttgagcgacccggcacacaatacgacctctacaacgttattcagaagtccggagaatctcttcgagattacatccggcgattttctgagcaacgtaacaagatctccgacatcaccgatgacgtcatcattgccgcattcaccaaagggattcgccacgaagaattggtcggcaagttcgggcgtaagccccccatgacagtcaagcttatgtttgaaaaagccaacgagtacgccaaggctgaagacgccgtcaccgcatcaaagcagtcgggtcccagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgctcgcaccatcctaactccaaccacgtggccaaagattgtttcgtctacaagcaattcgcggatcaatacaccaagactgcacggaagaattctgacgaagaacaaagcacgtcgaggaagaaggacgacggcgacaccccggcaggttttcaagatcaccgcaaggagctcaatcatatcttcggcggccccctggcttatgagtctaaacggaagcagaagttgactgaacgggagatcaatgctgttcagcccgacacgccccaatatcttcgatggtcagagatcgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccctggatgatatgcagatccctcactccgagttaaaaccaagcaatgcgccttttcacggagtgattccaggattatccgcaactccactcggccagatcaccctcccagtcacttttggcactcgggaaaactttcgcacagagaacatcagctttgaagtcgctgatttcgagacagcataccatgccatactcggacgcccggcgttagccaagttcatggccgtcccgcactacacttacatgatgatgaagatgcctggtccccgaggagtcctatccctacggagtgacatcaagcaagccgtcacatgcgacaaggagagttgcgacatggcccaaactcgcgagatggcgtctgcccgagaggatatccgactggctgcagccacggcgagcgaaggagaagagcccgctaccaagatttcaaagagtggagaaagcgaagccaagactaagaagattcccctagatccctctgatcctgctaaaactgctgtaataggcgccgagttagattgtaaataggaaagcgcgctcatcacctttcttcagaacaataaagatatctttgcgtggaaaccatctgatatgcccggtattcctagagaggtgattgagcattccttacatgtcaaagaagacgccaagcctatcaaacaacgactccgccgatttgcacaagacaggaaagacgcgatcaaggaggaattaaccaagctgttagcagcaggcttcatcaaagaagtccttcatcccgactggctggcaaacccggttctagttcggaagaaaacagggcaatggcgcatgtgtgttgattataccgacctcaacaaatcctgccctaaagatccttttgggttgcctcgcattgaccaggtagttgactcgaccgccggccgtgagcttctcagttttttggattgctactcggggtatcatcagatccgactgaaggaatccgactgcttgaagacttcattcatcacgccttttggggcatactgctacgtcaccatgccgttcggactaaaaaacgcaggagcaacttatcaacgcatgattcagagatgcttctcaacgcagatcggccgcaacgttgaagcctatgtggatgacgtagtcgtcaagaccaagcaaaaggatgatttgatctcggatctagaagaaacctttgcgagcatccgtgctttcaggatgaaattgaaccctgaaaagtgcaccttcggagtaccgtcagggaagctggttggctttatggtgtctcataggggcatccaagccaacccggagaaagttactgctatcctcaacatgaaaccgccaagtacccagaaagatgttcagaagctgactggatgcatggcggcgctcagccgatttgtttcacgacttggcgagcgggggatgcccttctttaagctgctgaagaaaacagataacttccagtggggacccgaagcacagaaggccttcgaagatttcaagaaactcctcactgagccaccagtcttagcctcaccacacccgcaggagccgttgttgctgtatgtatcagccacctcccaggttgtgagcacagtcttggttgttgaacgcgaggaagaaggccatgtccagaaagtccaacgaccgatttattttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatatactgcacaaccgcgaagcaaacggacgtattgctaagtgggctttggagttgatgtctttggacatatcattcaagccccgaatttcaatcaagtcccaagcgttagctgattttgtcgccgaatggaccgagtgccaggaggatacccccgcggagaacatggagcactggaccatgcattttgacggatccaaacgactttcgggcactggagcaggagtggttttgatttccccaactggagaaagattgagctacgtgctttggatacatttttcggcgtcccacaacgtcgccgaatatgaggccctccttcatggactgcggattgcaatttccctagggataaagcgtctaatagttcgaggcgattcacagctggttgtcaaccaagttatgaaggagtggtcctgccttgacgacaacatgatggcatatcgacaagaggtacgcaaattggaagataagttcgatggactcgagctcagtcatgttcttcgacataataatgaagccgccgatagacttgccaactttggatccaagcgcgaggtggcgccctctgatgttttcgtcgaacacctttatacgccgacagtacctcacaaagataccactcaagttgcgggcactcatgacgtcgctatggttgaaaccgactggcgagaacccctcatacgatttttgacttctcaagaactccctcaagacaaagatgaagccgagcggatttcaaggcggagcaaactttatgttatgcatgaagctgagttatacaagaaaagcccttcaggaattctgcaacgctgcgtatctttagaggaagggagacaattgctgcaggacatacattctgggatatgcggaaaccatgccgctgcacgcaccattgtcggcaaagcttaccggcagggttttttctggcctactgcagtgtccgacgccgacaagattgtgcgcacgtgcgaaggttgccaatttttcgctagacaaattcacttgccagctcaagagttgcaaactatcccgctgtcttggccgtttgcggtttgggggctcgacatggttggcccgtttaaaaaggcagtcggcggttacacacatctctttgtggccattgacaaattctccaagtggattgaagctaaaccggttgtcacaatcacagcagataatgctcgagacttcttcatcaacattgtgcatagatttggagtgcccaatcggatcatcactgataatggcacacaattcactggtggagtttttaaagacttttgtgaggactttggaattaaaatttgttatgcctcagtggcacaccccatgagcaatggacaggtggagcgagccaatggcatgatacttcaagggattaaagcacgtgtttttgaccggctaaaaccctatgccggcaaatgggtgcaacagctgccatcagtactttggtctttgcgaactacacccagtcgggccacaggccagtcaccttttttccttgtctatggggcagaagcaatgttgccgagtgaagtcgaattcgaatctttgcgctttcgaaatttccgtgaagaacgctacgaagaggaccgagtggatgacttgcaccgattggaagaagtccgcgaagcagctttgattcggtcggctcgatatttacaagggttgcggcgttatcataatcgcaatgttcgatcccgtgcctttctagtcggcgacctggttttgaggaaaattcaaactacacgggatcggcacaagttatctcctttatgggaggggccatttatcatctctgaagtcacccgaccaggttcctaccgactcaagcgcgaagacggtactctcgtcgacaactcttggaacattgaacatcttcgtcgtttctatgcttaagcttatcattgtatttccctatcttgactgtcaacatcaagttttcttcttgccgttgtcagtcgggggctatcatcataataatggagtgtgattttttatcaatttaatttgcttacttggtctatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccagtattgtacaaattgagcctccatttgctacatttacactcagtcagaatcagtcctttcatcatcagagttattattgctcggctgaaggtcgttgttgcggaattgctctacaacatcacttgcaatcttgtcagccgcactttgagcattactgataagatcaagagcagcttcttcacttgtcccgtctgcaaagccatcaatggtatcaatttcgattctcgggtacaaggatttggtcattgccaatgccatgctagctcccatacttccagctttcttgatgttcttgaagtacacatccggtgcaactcttagcttgtcaaagatctcggttgcatcaagtgcactcggaccactgttattaagaaacatagcttggacaagtggtgtagcgacattggcgacttcatctcttgctccttcaagcttcttgatcttaccaaccaggacatcaaactgagcttgagatttgattttacggtctacaaaacacatttataataagaatctgctgccttacagagagggcagttcaaattgtcagctggcagtaccttcaacctccttcaaggctgagtccctttccgcagccagttctaccttgtcttttttcaaggcttctatttgcttctccatttgagtcatcctggtggcttgcgctgtttaaaatccaaatgtttgaggatccagttatgacagcacaaatgggacagatctagagattaccttttgatgaaccactcagctcgaagttggagtcctggagctgtgcaattcgctcccttaattccttctccgttttcttggcatgctccttagcctcgtgtagctgttccctaacggcttcaagagttcccaaatgtggaaccagcttttctaaggttgcagtcttggcttcattacgaagatggattctctgcacggtggttcagggattagttttgctaacaaaaaaacaaagtcatcaaaggcaatcacctagaagacttacattcacaatgcgagtggcttctccaagtactttcttcagctggcacacttcctcgtcttctttttggcgatttataacaatgccggaaacttgagagttctcgtcccaccatttgagtaagataggaggacgagagtcattagctgcctttatgcggagaatttcttcttcgtcgccgcctagtggacctgatgtattcccaagatattagacgaacaagctggagttattcagagtggcatcacttgagaagttgagttacctgaggatgtgcctggctgagcgtgaggggatccttgctctttatctggagacccaatcactgagtcattaccaacttttggtccttgagaagttgtctgcgcttcagcttcaggaatctcttgatttagatctacatccgactggtttccagtcgggggctctcgggttgttgcagtttcagttgctgccgactggtttccagtcggcggctgatcactcggattggccttgtcgtccgaagcttgggcgccagtcggctgactttcggcagtcggctggctttcggcattcggctgattttcggcagtcggctcagcgtctttggataaatttggctctgtcacagccggatcaggatcttttccagttggatctatgtcggatggtttcctgcaaagtgtccttttgacatttagcataatttctataagagaagcatgccgaaataaaatggtatcgagaggtttatacctggaagatgttctaatctttggaatttgacggccagccagttttttcccgggcatggtatgctttgggagtttgttgggagtgcccttgtccccagatttgttgctgtcatcgccctcatcgtcattaagcaccagctttctcttgcgaggacctgtctgcccagccggtttggaggtttgaggttgtgggtctgacctgattgtcggccctccacttccctgaacggtgtgctgacgaggtgaccggcgctgagtgattgggggatcagatttcatcaatgcatattcctaaatgagatgcttccacggttaattaattcaacatgaagacaagataatgttttggtcatagattgaagatttcagatgcatacctgcggaggcggattgaatgcattatatggcacaactggcagctgatgtgagtagctgacgacgatggcatttgagaagattttatacattctctccttcatgattttgaaatccagagagtctggttcttcgcgattaggatcatgcttgccgtcaaactcaaaagctgtacgggatctttctttaattggcgccagtcggcatttgatgaaatgccgagtgatctgctctccttgcaagccttgttctttgagttttaacatgcgatccaacaattccaaagcttgggcagcttcatctccgattggaagagagttccaagtatcttggtacaccggaggaagacaagaatactcgggaagagcaggctcaggattctgaacataaaaccagttcgcatgccaccctttgtttgaggtcttgaagggcatagagaagtacttctgactcagagttcccctcaactgaaatcctgcccctccgactacacatggcttattcttgttcggttggggcttgagaaagaagatccggcaaaacagagcgaagtggggcctaattcccaaaaaggcttcacaaacatggatgaaattggcgatatggactatggaattcgggtttaggtgatgcaagctgattccatagaagcttaatatcccgcggaaaaatttcgaggtcggaagggcgaagccgccatagaagaaatgagagaagaccacaatctcatgtgtatcgggggtcggaaaagtctcaccgcacgctggccgccacccgatgatctccttggcagggagaacgccgtgcgccaccatctccttcaggttctcttccgttacgtcggatggcgcccactggccttcaaagctttctttttcctccgccatcgattttccccgaatgcgctgatttgattcgagggatggcttgggagaggtgaggaattgaggcggtggatcacgggaaggattttgatgcattttttcgaaggtggatttgagtggagtggtgaaccctagttcgccggcgcagttctgcactgtagcaaggagtggggaaaatggcgagagttccggcgggggagacgaagcgttgcttggatctcgggatttcttgttaagggtatcggaggagcaaatgggcctaggcctgaacagtacttcagcccaatacttttaacagcgtggcccattgtgttccttagggacttaggcatattttgctttggcaatattatgcgcacaatagtgttgcccaatgctgataaaatcctttttatgcggtcatataattctttggaattattgcaatgcaaattaaaaggtgcccgacagaaaggtgttatactgctttttgttagctttattaggctacaaaagctgtctgggttaatttggaatgacttgtttttatcatagtcacttccttggtatgttatatacctattttcattatggtaaatagtcatggcccaggctattagacttattcattaccataatttttataatacttggtgggtaatctttagagttttatattcggatgcctgtccagtgtgttcattcgtgaaccttttagagtgtaaaccactcggactcttttcattatggctaaaaagcagtcggctagcatgcctatctaggcgccgtgtatgcttttgtcatatgatgcacaattgtgttattattttgtttctcaactatatgtttagttcgttaactaatcacatagttgggggctacacctaattaggtgcatctattcgatgcaccatatttttatcttttcgccctttacagtcttcgtcttcgctactcggcaggtcttggcatgataagttttgaagcactcggattattatctttgagaaggctatgatggttgactgcaaaggtctcgggggctactgtggagattatggatatcccatatctacacggcgatgatatttggactggatataggataccgaatatagatagaatatcttatgtgtatcctgggtttgtttcttaacttgtacatcaaggaaacaccttgagacttagtcggtcacgactgtattttatctgtatttacatattccgttaggaatatagattatcttttgtaacacggactctttcccatatataaggggggtccgggtgcctctaggggcggaggttggattttctccaaatcatacaatcaataacacactcggcggattcatccccggacaggagtagggtattacttcttttgtaagaaggcctgaacctgtataaatcctttgtctccaaacccatacactttcctagcttgatagccacccccttttattattgccgaaatctagtttcgacaggtcggttccgttgtagttgaggtcgagcgggaacggtggctggtgcgcctgatttcgccttgggtcgtacagcgacgacagcctgcagttggcgtagatcgccgggaacgacatgccggccggcgcgtcccagttccagaacggcagcgcaaacgtctcgtcgccgatgagcttgcccagtattctctcgtggaagtacaggtacatcctgcacgttcatacgcatgggtccagtgcatgcagagaatcacagccacatcagcacatatagctggatgcccgtacacgaaccagacgagacgggatgtatatttggggaaagtgtctttattagccttttgaggggtatcccttctttttcatgtcatttaatttaatatatagttaacagaaaatttaaaaaataagataaattaacgtgagatatactcaaaaggctaatatacccctcaacttctacattttacaacagaaaattttaaaaataagataaattaacattagctggagtattacttttttatataagttcaaacacaacttctatattttacaacagaaaaaaaaataaaggtgcggatgtaagttgactagttttaataatttatctctctcttttttttacaatttgtagatttcaaatttgagcttatgtgttaatttgtgaaatgatatatctcatattttcttattaattattttagaaaatttatagctatttactagtaagtggtaagtggtatgtaagaatcatcgacggacgtctcggtatatacctcctccgtctaataaaatatcaatccaacctacgaatctggacacatgtgtatgtgtctagtttcgtagctagaaatttgtttttttgggacggagtataatgttgttgtcacgtaccgtacctatgccatgaaaaaaagaacaagcagctgtgtatctgaatctccagacccggnnaagccgacctggtcgtacgcgccgtcgcagtaggcgcagtgcacgcgccactgctgcttgaagctgcggggatcatcgcgggaggcttcttcatgagcgacacggccctctcgtacttggtcaagtacgcaatgtccaccaggtgcgccgccggccgcacgcggagcggcgaggacgccggcggcggcgtgaagtcgacggcgacggtgccggcgctgtacgtcgggcagcagctgatctccggcgctgtgtcggggtcggggaggtccacgggctcgtggcagtggccgaggtccggggcctggattggcgccgcgagcgcgccgccgccgccctgcgtggccaccatggcggccgctgcgcctatgccaaggagcacgtcgcggcggtcgaggccgcggccgccgcctcggccggcgctcgccctgcatgacacgctccgcagtttcctcccgttcgtcttgcggttgcggtgcaagagcaggttgtagtgaagggtctggaggttgctgatgcacggcagcgccatgcgaggcgtcacggatgcacctcgtgctacattgatgctctccatggcggcattcagctgtaaactagttcttgcagtggtgtgtgtattttatagggcaatgcgtgtgtatacgagaaactattaatctaaactattgagaatagatcactcgttatttacatctcatctaaatggttataaattttttttaaaaaaaatcaataaaataaattaatatatgatcaatcactccataaacatgcaataccaaaattaacttctacagattgtaatggaaaaaaaacaaaatttaactatgaatatacgttaactatttatagcttaattttttttaacatgtaatggttgaattttaacttgcatgcttatggaatgatctatcacatattaatctatttagttaaatttttttaatttttttcataataatttggatgatatgcaaataacgaaagaatgcctgatcctaagaatttagaatccactctagtgtgtatactgtagtgtagcgcccacttttttctttcttactatgcttctatatttgcaatggtattactaattactccctccattccattttaatcatcccctaaggtttttaggtcttgacattactaattactccttccattccattttaatcatcccctaaggtttttattgaccattgacaccatttaaattcaaagaacgacgagtcaatatttatttccttattaattacaacaagtagtacgggtactaaggaacaacgttacgtcatgggagtctattgacgctattcaatcaaagaacgactaatgacgccatttaatcaaagaacgactagtcagtaattatgtcattatttataccgtattattcattagttacacatcaaacactatggtgaccgaatcgcagccggacctcgtcacgatcgagacgacgatcgtccggtcgccgtcggcgccgatgtcatcgagcaagttgccgatgccgaaccactaatagaaaaatcattttttcagacacggtgtattattttcgcaagcggacatgacccttagaaccaaattaccgcctataaaaatagaaatcgggatgaaatttaatgtccgcctgcgacggcacctgcgaaaatagacttgaactagcaaaaatgcccgtgcgttgcaacgggtgaaaaaattctaatgataatatatatttttcatgaataatcatgtcaatgacaatgtttgtattttaatgagcggcttgtatttttataaacggtgtttttttcttgcccaattttctcaaaccattcagaaatggcgcatttctttcttaaaagttgaatggcgtatttctttcttaaaagtttttttctagcatgtattttttgcttttttatttacaacgaaaaccatatttttctccattttttgcttttcttttctcgtgtgtttttttgccttttttttgccaattattttctcgcgcgtttttttgcttgtttttttttcaaatgttcttttttctttttttttcagtaaggagaatatatgacgaaataaaagccgtgtagtaggtggcaaaaacatcgatggatcatatccgactcagagcgatttttttaatagacggtgtttttttcttgcacggttttttaaaaccatttgttaaattggcgcgttttttctgactgttttttcctcgcatgttttctttaaaaaaattaccgacgatggaaataatttttctcgcccgtttttttattttttttatggaagatggaaaacctttttggagtgtttgtttttttgcactttttctgacttttttctcacgcgtttatttgaaccgtttttattttctcgtgtattttatctttttaaatagttagattatattagagatagagaagagatatatatcgattagaaatcagactttgtttcgccctttcaatttttttctcgtgtgcattttttattttatacgaacaagctttttattttttacgaactatttttttcgccactttcttagggaatcggacaaacttttttagatgtattttcagttttttttttgcttttataggaatcagactttttttccggtttttaaaggaattgaatctagtatttttttttcaccactttttttttgccttttataggactcggatttttttggttcggatctacaatttttttttcgccactaagggaaaacggaacttttgttgttgttatttttcttttttttttgtgcagctttcctttttctttttactagcaatagtgcccgtgcgttgcaacgggagaaacaccgtttgataatgtgacaccttaaaaacctcaaatcggtaaaaatcaagtttaatttgatatattaacaaataggtagaaccgagactaatttgatgaattagtatatgatttagaatttatttttcgagtctactcaggagtttatccaacgggttttaatttaaaaaatcagacccacgttctttgatcaaattagacatattcatttttatttttttcgcctttttttaccgcgtccacatagtcggattttttttgcccggttttttcacccgatttttttcgcccgatttcttttttttttaattcgaccgattctttttttattttttcgcccttttttacacaaaatcggattctttttttcgcctgattttttttcacgggttttttttcgcccgatttcgtttttttagaatcggaccgattcttttttttttatttttttcgccttgtttttcacggaattggattatttttttcgcccatttttttcctcccggttttttcgcccgggatttttttatcggaccgatcttttttttttctttttatcgccctttttttacatttggttttctttttctttttccggttttttttattggaccgatctggtctttttcttttttatcgcccttttttttacgtttggtttttctttttctttttctttttctggtttttttatcggaccgatctggttttttttattgccccctattttacgtttggtttttctttttctggtttttttaatcggatatgtttggtttttttctttttttcgtccactttttttacggacgatggaagcacctcttattttttaagtagtagagatgcacgtttctgtttttgttctctctcttttattattatttttaacaaacacggcctcaagtaccttattgcaggattatagggactcaaatgtaaatataaaaattacagggactcaaaagcaaaagtacaaacccaaaaattgaaatcatataaaaatggaatgctatcgacctgtaggttccgtttattaaacagatcttcaatccgacacatcattttgtttcaccaagatctgtgagatatcacggtatagattgagaatcggatctatagtcggagttttttttccgtttatgagagggaatcggatagaagtcggactttttattttattttttttagcttttttttacggacgaagaaaacatcttttattattttttaagtgtagagatagagatagacaagtagagatagagatagagattttttttcactttttttttgcacggaatcggatttttttttgggatcgggcagttccgttttttttctcgctcgtccggttttcttggggcggttttttgtcgccctttttttcacggaatcggactttttttttgcctttttttatcggacagttacggtttttttcaccggtttttcgccctttttttttcacagaatcggattattttttcgccggacagttacggtttttccgtccggtttttttctctctcgtccggttttttcgctgggttttttcggacgatggaagcatctcttattttttaagtagtagagatagagatataaatagacttgcgggccgtaatttttttctaagtcctcacacatctcctcctttcccctcccctcacttctacactccccgacggcggcaggcggtggcggcgaagggcggcagcggcgagtaggcgaggcggcgcggccaaggagggcgacggaggagggcggcatggcccggcccgtccctcccagatc

SEQ ID NO: 7063 - DNA, 2460 bp, Oryza sativa
  unsure (1)..(2460): unsure at all n locations
cgcatcctctcgtcgtggtggacactgtctgcgttagcacgacgctcccggtgcacgtactcgccgccgcgatgttcccgctctcgctggcgcgttcaacacgaacacgtcgaacttaatgtacgtggagtggtcggctgacctcgatcccctcgatgacaagcacctcctcctcggcgtccttctccttgcggctcctcgacgtcttgggcctcatcactgccacccgcacggtcttgtccagattccccggcaggcgcctgtcgtgggcgccggtgtggacagctggcgttgatcagccacgggagacccacatcttagtacgtgaagcgcagcgcgccgcgtcgagggagtcgcggacgcagatgaggcgggcatcctcgttgtaaaagtggaagctcgcgtcgagcacggtgaagttggtgttgccggggaagagaaggccacggcggatgtaccacaggcgctcgatttttttaaaggaaggcaagggctgccaaatctatcttctatcagtcaatctgaaagacatgggcgccgctgaagtgcaagttcttctcttagctagtcacgtaaaatagagtatggacggcagacaggctagaaaaaagaggatggcaaaaccaaaagatttgcctactttgctacaatgttgatgaatcggccctgtacctcctggccaaatgtgactcacagagaggatatgggcagaaatgcagagatggaccgggactgaccttcagatgaacaactggcatagctatcactcagtcgagtaatggtggacacttgtaacgaaatctccaaacactccacgcaaacctctcaggaccctggtgattttaatctcgtgggaaatctggtgcgaaaggaacgcaagaatcttccgcaacaatgcatattcgctatcctcaatcctagcaaagatcaaggaggaagagagagcatgggtcaaagcaggggcttctatcctccaggagtttgaaattttgggagatatcacttaatctctgccttttgcctctccttttgcaggttatttgttcgtttttttcatctaaccctgtagctcttntgagcataggcccgggatattatattccattatctaaaaaatctaaccatgtatatatctcaatataattttctcctgctctattaataccacaggcgtcgatgttgccgtggtgcgcgaagaaaaccgggtcgcgtgccgccgagtaaggtgcgcgcccatgtcctcgtcgttcggctgcctctgatcgccggtccattggtggacggggccgtgcggcacatgctcgagtgctcaacggtgcccagcctcggttccggctggtcgccggcatggtacggtacggctgccccatgaacagctccgtcttccttgctcccgaaatcatctgatacacatcataattattttgttcgtattaaacaatttgatcttacgtacacatgattacgtaattataggttgattattttggaatttgccgtgcatggttttcattagccagtttagttcgtgacttcctgtgtgatcactggaaaataataatctctgtgcatacgggcccgtncccccccccccccacccaacaccgtncccaacatgtcagacatttcttcttcgccggttctctatttctgttttgcgagcccaccgtcgcctctctcgtccgccgtcgtctgtccgcagctgggagccgtctgcccgtccgctgtcgctcgtatccaaatgcccgagggatccgccgaccacggccgctgccatttttctcgtcgcgcaggatgccaccgacgctgtctgccgtgaatgtgtctgcctgtgcctggccgcttaccatcccgaggtcatcaacagtggattggttcaggaacaaagaactagtttcaaatgtatgctctctctctggtggcttccttaggattgatcctttaaagaaaggacttcagatgtatgattattccatcgtcgtaactgtacatattgttatcggtattggtggttgtcaaattctttggttagaccacatttatagaaaaaaaaaactaacaacatctacaacacggaattagtcccattgaatttaatattgaataaattttgatgcaatgtttgtttatactacctccatcccaaaataagtgcagttgtgggtatccgtgtctaacgtttgaccgtccgttttatttgaaaagtttataaaaaaacaaaaaaaatgttagtactattcgtgttttatcatctaataacaacaaaaaatactaataaaaaaattaaattagacgaacagtcaaacgttgttgatcattgaatataaatagtgtaagactacacattttagaatggagagagtatttttctgtaaactttgatcaaatataaaaatgttcataggggtgagtgtgtgcacgttgtgagcgcctgcgtttgtactgtgtttctaaaaaaat

SEQ ID NO: 7064 - DNA, 8634 bp, Oryza sativa
  unsure (1)..(8634): unsure at all n locations
caaaaaatactaataaaaaaattaaataagacgaacagtcaaacgttgttgatcattgaatataaatagtgtaagactacacattttagaatggagagagtatttttctgtaaactttgatcaaatataaaaatgttcataggggtgagtgtgtgcacgttgtgagcgcctgcgtttgtactgtgtttctaaaaaaattgtttgataaaaaatcaaacgatttttaatatgaaacggttggagtaggtcacatgactgcgactggatgaatgactagcggttggcgtcgttccgctgtcccccagcggaaaatattgatggctgacaaaacggcgacagcgaagaacgagtgaccgtcgtctttgcatcagcgttgatcagatacaaacgtggtacggtggtcggtggtagcctggtaggtgtgctcttctgcagcgttgtagaatttgcgctgccctgatggctagtttgggcctcaatttggcccttccacatgtataggccgggagattgaactaaaattttggcctatacacatgtattgaggcccaccaaaacgaggcctgtctgcgctttgggatgagagctttgcccactgaacacagtgggccgagtattgctgatcagtggattgtgctgggccgatccgggccgtcatcgaatacgtcaatttaaaatgttttgggattgttattgctaggatggagttgtcgtgtctttatcgacaaagactttaaaataaaaaaaacgatctaaataaagttataaacattatgcatcttgagtgcttattggaaaaggacagctgaacattttctcggcgtattgatctcatgttgttgctaatataaaggaaaaaagaattcgtattactgcttgtactcgatataaatttcataaaaaccttatacattacttagtactatgttcgtttcagattacgagacgtttttacaaatcaaactgttttaagtttaactaagtttgtagaaaaaatagtaacattttttaactcaagacaaatttattaagaaaatatattcaattattgatttgatgaaactaatttagtattataaagagggtgtgatcggtaccctcttttcccaacccctctctctcgttttccgcacgcacgcttttcaaactactaaacggtacgttttttttgcaaaaagtttatatacgaaagttgcttaaaaattcaaattaatctttttttttaaaaaaaaatagctaatacttaattaatcacatgctaatagatcgtttcgtttttcgtgcggaaaggattagttcccatccaaacacaaccttagtcaaacttgaaacagtttaatattgactaaagtcaaaatattttataacctgacacagagggagtagctaatataaaggaaaaacaactcgtatattactgcttgtactcgatgtaaatttcataacgaccttatacattactacctcgaaacattgttcatgaattaacgtaagtcacaatattattctcttaaggattacagaagcctaagttttcttggaggaaacgtagaggagtttttaatcaaggtttccttttcgttacgtttcgtgcgcagcgcgtccaagtcgtataaccttttcgttacttaaaaaccaacgcaaccccacaccttttctcctacccaccacccgtctccgcaacccacacatctccattgcgccaaggaagaagaaacccttcccctccctctccccaatccaatccaatccaatccggcgagtcgcgtgagtttccgctcccctcttccgtcgattcggcatcgggttcgccgatcaggggggcttccttgtccgatttggtggttgattcgtgtttttgctcgtgttctccaggaccagctcagtctctcgtaagggtttgatcgagttgttgtgtttcgttgcgcgattggcttcgatcggtgtgtttctggtggttaattttttggggggcgctgatttggtgattgtgtgcaggaaggagcgccatggccaagagctcgttcaagctggaccacacgctcggtcggtttgttttcttatcgtgttcctctttttattttttcctatatgtgctttagtagtgtggctgcgatgattgcgtgttgggtttatttgttcgataattgattgaatgtgtgcgaagacgagagaaagagacacaggaatatgttttttcccccggtttaaggggatggcttaccaaaacatctgaatgtgtgtggtagcaactgtttattgaattgtgcatgttctgtgcgaatctgggagtaggagtaggttgcgattgctacaaagttgtgtgactgatttgaatttggtagtaataatagtagtacatgccttttcataatgggaatagtaggttctgtgcggatggatagagggatggttaatggggaaaatatgtcatcattactgatgaatcaaattataaagagcctcaatgtgtctatctgaatttctgatacaccagttttaactattatgtaaggctgtaaaacccaatatctctagtattgtagactataaattaacagttgacctgacaatccagcatcattagctgattctttgatttgtttttaagacttatgtggtcttgttccttttctgatggatcgtataaggaatagactttccaattcaatcacccaacactttatgcttgagaacatggttttggtagtctattgcatgtttaggggttgctgtaaatcctgcccaatcttctgtgaaagggccctgatgtttagtatcatgctttttttcactgagttatttcttcctgtctaattttttatcttttaccttttgtgcttgaacaatatttaagttgattaatgtgtgtgccaacatgatagcatagattccttttttgagaaatagacagcataagtattgcacttttttggttgccctttcttgtaatcactctgttattatagttttctctacagtgatttgaaatctctgatttctcgttctccatcttctacaaccttgatttatgtatacattttagagatgtttcagccttttagtcagttcataataaccaaaatcttgttcttcttgtgcatgtatttcagagaggaggcaggctgaggctaaccgtatcagagaaaagtacagtgacagaattcctgtaagcttgctcttcatattgctcagttatgttgtttccttcattgtggtttttttgctctaatttgttacatatctaatgtaatgtaggtgattgttgagaaagctgaaagaagtgatattcctgacatcgacaagaaaaagtcagtttccaagcatttacgaaaccatagcatttagatttttatttagttagtctattgaaccgctaaaggaaggaatattgtctttaattgctatcaagtaaatgctagtggaggacttcaggtgttcagatgatagcaactagtagctcttgccattcatttatccttatctaggactgcattgatgcaatggtattgcttgtgggtcctttgggggcatatttcattttattataattgtttcaaggacttaaagtcatgattaacggtgtcctataaacttttttggtactagcagtacagcatcattacagtacttgcatcacattaaatcctttatgctctttttagttaaacatgtagtagtatttactatttatcactgtaaagtcctaactctatgttccaaaagcagctgactgtgtttcaatttattattgcaaggatgccggtatggctatggcattcaagctcgaaacttttgttgctctgaaactttaatacatgttacatcaagtatcaatcaatattaccgtatcatccttagtagcttatgattttctaatataggtacctggtccctgctgatcttaccgttgggcagtttgtctatgttgttcggaagcggatcaagctcagtcctgagaaagcaatcttcatctttgtgaagaatactcttccaccaacaggtctgaaaatcccttgaatcattttcctttgaaaacacaaggactttggtcgaatagtatactactgcatggtttatgatcccagtatctcaaagaacctgcatggttcatgttatctcatttcatcactttgttggatttgcagctgctctgatgtccgcaatttacgaggagaacaaggatgaggatgggttcctctacatgacctacagtggcgagaacacctttgggctgctctaggcgcggcagcaatatcgctctcaactcctgtaaataagacttgccaaacaagtgtatattctttgcttacctcgtggcaaatctttaaactctaatagtagtaatgccaagatcctctcagttgttctgaacatatatacgctgcttgataatactcccaagtaattgtggctctggtgaatgtgttctcttgtggtctcttaacttttaccgttgctgtgacgaggtcaatctagatctcagtgtgtcattaatctggttgctgttgccgctttattgcctgcctgcctggctctaccgacagcagcagcagctgctgatggaaaaggtcgccggcacgaggtccttaaatttactgcgtttgggttctgttgctggtcgcagagcctggatggtggttcttcatcctggcactggcattcaatgtgtgcagtgtcaggatgaagctgcgccgcgagcagggaatcctgattgttttttcctggggttttgtagggatcaatctgctgcatcgatcttatttttggttgctcttgcctgtggcctgggatgatggattaatattggaatgtatattagctagctgctgtgtgcttgatttgttggccaagtagaagcagaagagaacaatgcaggaagcgattcaatttacaaccaactgtgttttggtcaagttgggtggagtgcaaaattgtgcttgtttcattgttaaccttttttctctttttcttttctttttttttttggcttccaagctcgtgaattgggcaagtcatgtccgttgtagcttttttttttttttttttttttttttgaaaacaatgtccgttgtagcttatcaaacatcaatgaggtgtgttccattttcacaagaaactcacccatcaatggaagcctaggaccctaggtcctaccgataagctaagaataatgtgagagccgaatccttttccttaccaaccccagactattagttgtcactttagtagtaattaagagtaagcaagccagaatcagaaaacttaaattaaagctggctggggcttgcaagatcattcattcatgctaagcatgatgtctgcgtgctacacatgcgttcgtacgtatatatatggactgcagatcattcattgccgctactccagttctaaacgtacacgatgcatggccagtacgtatacagtatactgtatactgcatttatgaacgtagcgctgcattgctagctaaagctcgcaatcactgaaagcgccatcacgaaaaaactacagctacttcactgtagacatgtattctttcagaaaaaaaaagagataattaatcatatttcgcccgtgagattgccagcgataaaggttcatatgcatgatgaactgattccctttgtcgatccacatgcctaaagaacattatgagaattatctatgcacagatatcgctgacgacgaaaaattgtttcagaccaaatcgccattggtttggccactggatcgatcaatctccccgtatcattgccattttgactcgattatcgttgtcgacatggccatatatgcagagacatcaaactcatatatatgtcgtgcatgcctgcctgcctgccgtttacataattaattgtactgcgtgttgttgttggcagcagcagcagcccatggcgtcacgcaacacgcaccggccaaacacttcatcaattcacggatgatggatgcacatatggtggtcgtcgtatactccgatcctgactacacgcccgccttcatcgatcgcttcaagaatttaacggcaattaatttcccttttcaagcattctactactagtacgtactacgcagaatcactgagatctgatcgatcagttcttcttcttctagctgctgcagcagcacagctcatcagagatgatcagaattcagaagacattggtcgtcgtcgtcgtcgtcaacgacgacgtagtacaaagactagccggttccttggaagccagccattgccggcaaacgacgcatcacacggcactactcctagctagccattggcgtcacgcgaacctgacgcaacataagaagcgatcgagagatggatgcatggtatgcgtagagaaagagagagagagagaaggcttgggggtggcaatggcaatatggcatgcagatgcaggttgcagctgcagggagagggggggaggcaaacatcccatgccatgcctgcataggctgtagacgggatgggaaatcactgcagtgcattcaagccagccacgcccccacaccgctgctgctgctgctgctgctgccactgccggctattggaatcgatcgaatcgtcgttaatgtcgacgtccacatcgatcgatcgtctctcgctcgaggcatctcctagcgtgacgacctcctctagcgtagtactacttgtactgtgctgcttctctcaccttgttcaaattcattgcgtctcataaatgctccaacctcctctttgtttggttgttggcccattcaattcgttttcccaacaatgccgttgctgttccaactcgcccccccttcctcggctcctcctcctatatgtcatcactcacgttgtagcggctagccatgttgtgcttttgctcctagctaagctctcctcgtcttcttcttcttcttcttcttcttctcatctacaactacctctccctcacttttgcattgcctccaagaagccatattaaaggatcctacgactccttcctctccctcctgctcctcctcttctcatctccttcacttctgcttctgcatgaaaccaagaaaaaaaaactagttgcttacttgctttgcatagttagctagctgttgtgtttctctgatcccatgtcctcatgaactcttgtttgatcctagtgaggtgagagtacttgagagggagtgtattgattggattgctgtttttatctctgatgatttgccttgttttgctgatctgaatgctgatcgttgggggattgttctgctctctatgtgggaacgggatattggtgcggttcaatcagaaagcttgtgctccgaaggcgaggggctccactctttgattgagccgtgccaatatcacgtcgcctttgcagctgctcgtttgtttatgtaaggatgtttttttcattatttcttttaatccgtttagatctttccctgtcaggtttatggttttgtactcgtttattatgagttcaacaatgtgatagagaccttctttttctggttttcagaggaactgatgctagatgtttatgaactgttttctatccatgtactgttagtacgtaggagtaaattaagaaactgttgctgttacgcatgtgctcatccttctctgatttgttaatttgatactccctcttgtcagataagttagttcttgatttcatgctactagcaaactgcagcctctcagactaagttctgttgacatgattcattttaaagcttgtcgatccgtcattagttattcagattttacagtcgcataatttttctagtgtttacatgcatggtgtggctgaaaagaagtgtagttcagtaatatctgattacattcttcaggtatatctgatgtgatatttaggtacttcctctgtttcacaatgtaagatttgattttctagcattccccatattcatttagatgttaatgaatctagacatatgtatgtgtttgattcattaatatctatatgtatgtggacaatgctagaaagttttacattgtaaaacggagggaatagcaatgtcgatgcagtatatatacccctatctgattatacgatgaaattgaggaataaccttgtggccctgtagtttattatatttcccacttccatccaattcatacgacaaagttgttgctgcttttccagctgcttttttggcacaaaagcgcagtgaacacactttaaacttagctaagctctcagtgtagcaatcgtctcatgcggaacggcataaaaggcaatgttgagagtgcacgtaagatcgattagaaggatcaaaagatagtagtagagacaaaagagtgcatgaccattgttctgtgtgctacatagtatttgcagtgtctgaacttgaaaagctgatcacaagtgcccaaagggagacagacagacagatccacatcgatcgcaagtctttgcctacgataaagatcttagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7065 - DNA, 412 bp, Oryza sativa
agagtagctcatgctttgtgcaaggaaaaagtacaccgaaggtccctcaacttgtcatcgagttaaaaatcgtcctcaaaccgcaaaaccagatatccgacgtcccttaactaatcaaaatcggtacaataggtccctcggtagttttgatcccggttttatcctatgtggcgctttgaccacatgtcagcgcgtccacattagcctcatctctctctctctctctctttcccctcttctctcccttcctcctctctctctctctctcactcttctctcttgggctctgggcaggccgaccaccaggtagggaggagaccgatggggcgaggcgggagaggaggtccggtggccggcgacgacacgggagcaggggagcaaggcatcggcggcggcggcggtagtggcgctc

SEQ ID NO: 7066 - DNA, 7064 bp, Oryza sativa
tgaccaaccacagcagaggccacgtccttgcgcaccttgttctgatcttggataggtgtgactaccattatcagcagcagcagcacaggagcatttagagaatcccagccgtttgctggcagctttggcagtgtgggtgacattgaggaagaggttgcgggcgcaaccgccggcgtgctcatcggcggcgtggtaggtgccgtcgagctcgtcctggatgcggaagtagtcgagctcgtccagcacgtcgtcagcgtcgaacgccaggtctcgcagcttctggaggagctccttgagcgcagggctgcgtatgtctttgccctgcgcgttgtcgagcaccccctgcgcgtagagcagctccatcttgagggcgtccacgttgggtccgagctcccggctggccggccacgcctccaccaagccgtccgagacggggccgagggccttgcccaccacccaccgagccgtgctcacggtggaatccatcgatccgatgcgcgcggatgcgcttcagtccaagatgctgcatgcaaaatcgagaagacgaaccattaattctcactcaaatgcaatcgaatgaacagtaatatgacagtggtattcagctattgttgattcgtggctgctgttagaggagagtggatacgtacgttacgacttacccaaggccgtacgtgcttctgcggcgtcggcagtcgggggcacgaaggtggagcgctcaggtattgggggtgaatgcttgagagaaccgtgcaaagagggtcgagttgtggcgcttgctttggagacgggagtccggagggaagatgctggatggaggctgctaaattactccactaaccttgtctgtttttctttttttctaaaaaaatatatttcctcggttttcacaatgctagatgttttgcttttaaataaatttatacatagacatatgtatatgctctatatatgtgtttagatttatatatgagtttttagtaaatttagaaaagagataaagaagctaaaatgtcattttgtggaacggaaggagtagctatttagatgacaagcggaacaaaggtacatcacattaacaggatgaaaaacaacattgagctcgcttccttcgtcggcgggtttgcccagcttgtttgaaactttcgcacggaacaccaccgtttagtagtttgaaaaatgtgctaacgaaaaccgaggtaaaaatctgaatcttaataaaaaaaatctaggtcctttttttttctaattaagatgcagatttcacctcgatttctgttaccacatttttataaagtgctaaatttctggtaagaagttgctttaaaatatcaaataaaaaataaacctccgtgttcacctgcagataacatgtgagataacatgtcaagttaaaaaaaaaggacagataacatgtgagattgagaccgtcttcacgtggataccacacgtcaatttactctctccgtcctagtttatgaaaaaaataaacctagcatggatccggaaaggagtcatattcatatttataggttgcagcgatcaaaccgaaaaagtgttcacctgcgtggacgcattagtccaaacaaagtgtccttgtacgtagattttataaacgttaccaggttggaaacagattcgacccacataaatgagctcttgacccacagaaatgagctctccgcgcgctcctcgctggcagatctcaagaagaggtcccgtgcagagatactaacaacaatgcagtatagaacttttttaaggtacacttggaaaaaaaaaactccacacttcaacaatgcaatatataattactagaagagcgtgactattggcacgcttacaattttataacctgcacaatatgcttaatgagtatgtaggtttaatagactaacatcataccatttaatatattgatggtattaaaatggaaggggttggatattggctaccggaaattatttttctagcagaaaaaaagctgcgatatctaatccatttttttggccggtgaagcagctagaaaccctgcttcacgatgcccaacaatttttatcaatggaaaagtcgacaatagttatccaagagttctgtgtaaaaggattatcatgcaacggatcaaaggtacatcatggatagcacactatgacaccacggagatagccacttctgtcaacgacagcccctgaattcacccttccttgagttggttcgatttggagaaggagattatttttttttttaaaagaaactacatttattttgagatggagaagttaactctagtatgcatatgcactaaaattaacattgcattcacgagtgctcgtcggttttaagtaagaataggtaatttttgacactttatttttttttaaaaaaaacaactttaaagcaagcacttccaatttcaattctagtgattcttaaaaaaaagaatacaaacccaagaaataagtttgatatgaaaattgttgaaaatggagtttttttaaaaaagtttgttgaaaatagaattattatttttgtttgaaaataaaatctagagtaaatttgttcccttttgaaatagcccgggctctatgggcgcagagtagctcatgctttgtgcaaggaaaaagtacaccgaaggtccctcaacttgtcatcgagttaaaaatcgtcctcaaaccgcaaaaccagatatccgacgtcccttaactaatcaaaatcggttacaataggtccctcggtagttttgatcccggttttatcctatgtggcgctttgaccacatgtcagcgcgtccacattagcctcatctctctctctctctctctttcccctcttctctcccttcctcctctctctctctctctcactcttctctcttgggctctgggcaggccgaccaccaggtagggaggagaccgatggggcgaggcgggagaggaggtccggtggccggcgacgacacgggagcaggggagcaaggcatcggcggcggcggcggtagtggcgctctggcgagctcctcgccagcgcggccgatctcgttgtgtatccaaaagagaaaaggtatcctattcaaatgcaaacccgacggtacccttctgcgagttgcatggtcggccttgaagaggatggcgaagaggttggcagccttgaagaggaggagggcgaaccagtcgttggcgaggcggtggaggagatggcgttgggcgtgggtgcagggggcggcggagtcgaaggcggagtcgtcggagtcgatgtgggagaagagggcgtgggagatggcgatgtggacgaggaagaggaggaagagcgggaggacgaaggcggcggcgatgcgggcggtgggtgcggaggatggacgccgcctccccgtagatccctaccacgcccaggaattgcaactcctcccctgctagttgcgccaagctcctcccccatcggccgcgcccgcctctcgagccttttcgacggtgcaaccctgaggtcgcacgcgcgatgatgctctcccttctcctgccaccgccatgtcgtcggcagccgccgcgagccgcctcccttctccagtgtcgcaaccaccgccgcgagcctctcccacctcaccctaatgacctcctccccacccgccgttgccctgcagagaggagaggagagagagaggagaaaggtagagaattggggaaagagaaagggtgctaaggcggacaccctgacatgtggggcccacatgcgtcccacgctgactcagccgccacgtcagacaaaaccggggtcaaaacaaccgaaagacctaaagtgaacggttttgtaagttgaaggatgttctatatctgtttttgcagctgggggacgattgtgtacctcaatgacaagttgaggaaccttcggtgtactttttccctttgtgcaaggccctggcccagctaacggcccgcaggtgatacagggagattgcccacgtgggcgcctcccattggacggcactggatgcgcttctgcctctgcccagaatcatcggtctccagcaattcggctcctctctctctctcccgcacctgcagacatcgaaagccaaaaaccactcaagaagctgcaaccgcgtaatctcgagaaaacggtttactcggcctaagacagtggcagacgacgcgacgcggcggcgggagcaagccatggttctcgctctgctgttgggctcctcctcttcttctcttgcggcgccacaccctgcttgctcttccaggtaacaagcgccagtggcagcaacacgcagttgatttttcttggatcaaagttgtataaggctagatcaggtgctgttctattgtattcactgttcgaagcaggcatgtattttgggtaacattcttgatgtcaaagtcatattccacattcagtgatggcacgtaggaggagtcaggttagtacagtacctggatgaaaatgctgataagtaatcttcttattggtaggagaaaatgcagacccgctggacgaaataatttcagatgctctctgcatgacaaggtgccactgaatgctcatggagtattatccacaaaattgctctcatgccttgctgcttcgcttgttttcatctctccaccttgtcaggtacctataaatgttaacttattgtcagatgtatatacactaaggctgtgtttagttcacaccaaaattggaagtttggttgaaattggaacgatgtgacggaaaagttggaagtttgtgtgtgtaggaaagttttgatgtgatggaaaagttggtagtttgaagaaaaactttggaactaaacacggcgtaattcaaagagataacctcgggatcactaagcaagaacagttttttttaagaaaagatatttttactgttgaggattgagagaattttactgctgcaattttgattggatacataaaacttgttaatttcaattaagagaagagggaaaatggagtgagattaccagttcaggcttgtaacatggtatcgatgtactcttaatctctcatagttgaccaggctatccctgcagagacctttgtacagccaaaattgtgccaggttgctgtggtagcagccatcgacaaggctgcggttcctctgaaattcgatagcccttctgatgatggcggcacaggtttgatgatgaagggtatgactgccaagaactttgacccaattcgctactctggtagatggttcgaagtagcatcgctgaaacgtggctttgctggtcagggacaagaggactgtcactgtactcaggtattgtagtgccagaatcctcacacacaaatactagtagatcttaatctgtatgatgccccagcaatatgtacctctgaatcctgattcctgaaaacaccgatatctgacatctttgtatcaaactgatttggaataggttatcacaggcatgctattttttctatgccatttgcaccatataatgtgtaagaagattgttcagaaatttgttggtactgcagggggtgtattcatttgatgagaaatcacgctcaatccaggtggacacattctgtgttcatggtggacctgatggttacatcaccggtattcggggaagggtgcaatgcctgtccgaagaggacatggcgagtgctgagacagatcttgaaaggcaggagatgatcaaggggaaatgctttctccgtttccccacactaccattcatacccaaggaaccttatgatgtgcttgcaaccgattatgacaattacgccgttgtgtctggtgctaaagacacaagctttatccaggtcagaaactgatctctgaactgcaaatgaccactatttcttagccctctgcatgcttattctgcatattgaaagatcaatctagttacgtaagctgttccatgaaccaaatatagtgtcaaatagagacaacatagggttaagcaaggacttgaccactgagaaatcaagccaatattccttaccttcatatgcctattctgacgcattttgtaaactgaaatatcataacattgtgtcgtctctcggcaatgcatcagatatactcaagaacacctattcctggaccagaattcatcgagaagtacaagtcctacgctgccaacttcggttatgatccgagcaagatcaaggacaccccacaggattgcgaggtgatgtccacggaccagcttggtctgatgatgtcaatgcctgggatgactgaggctttgacgaatcagttcccagacctgaagctgagtgcacctgttgcattcaacccattcacaagtgtgtttgacaccctgaagaaacttgtagaactgtacttcaagtaaactccatattgtaaaacttgtgatcaatgttccctccacatgaagatgcagttgaataaaattctcacacacagatgtctctagtgatttatgttttttcatgcgccttatcagaggaagagtttagcaaaaatcataaaatataaaatgaactgtttagcatctggaaaccttagttcatatcagtatgtactaactaaatagagattagcttatgaagagtcagctcttaaacagtgaccaagaacactgtggctggtaagcagaacgcacaatgagacagattcagggcattatgggacatgttgtgctgttattcgactccattctcgtgtgctcaagcagagagagggaggtgatggcaacacttttttctgtgcgagtctcgcggcatccaagcttggaaatccatgttccaacaggacaaaaacatcatacgctaagactcatgagttcatcaatgtctcaatgcctgcatcaaatcccagcaagaacgctaaagagaaaaccgagaagagaactcaaaaccaagaacacatcaacgaaagaacaagccaaccaacctcgcccgcgtgtctacccacacggcggcgccgagtggaaccctagaaagccgctgatataggcgttttagctgcaggccaagcccacatggtgatgggccttgggccccacctatctcgagggccgggcccatgtacaaagcttgagttagtatacggccgagaaatcccgaccgtcgaaa

SEQ ID NO: 7067 - DNA, 549 bp, Oryza sativa
gttcccgctcgacctcaactacaacggaaccgacctgtcgaaactagatttcggcaataataaaagggggtggctatcaagctaggaaagtgtatgggtttggagacaaaggatttatacaggttcaggccttcttacaaaagaagtaataccctactcctgtccggggatgaatccgccgagtgtgttattgattgtatgatttggagaaaatccaacctccgcccctagaggcacccggaccccccttatatatgggaaagagtccgtgttacaaaagataatctatattcctaacggaatatgtaaatacagataaaatacagtcgtgaccgactaagtctcaaggtgtttccttgatgtacaagttaagaaacaaacccaggatacacataagatattctatctatattcggtatcctatatccagtccaaatatcatcgccgtgtagatatgggatatccataatctccacagtagcccccgagacctttgcagtcaaccatcatagccttctcaaagataataatccgagtgcttcaaaactt

SEQ ID NO: 7068 - DNA, 1560 bp, Oryza sativa
gatggtcttcgtcacagtaggggcattgagtaacgcaattactaccgtagtgtcctatctctccgcaacgactacatgccttaatcttcgaaacttctttggatgggtctggaactctatcctcttccgggttgatctgtgaaggcagtgtttcttgttcttcattggtgtcttgagtacagcctatcgcataatgtccaaattgtccacaagaaaaacaacagccatctctctttcgttgccatagttgtagctcttcaacttcttcaggtaaattaccgatttctattcccattttactgagatcaagttcagcatatgttattagtgatgacgcttttcttttctgttctcctttccaccaatgctgtgtagttctttgtctaggaaatggttgatacggaagttttggattccctgaacagggcattggcgttggtaatattcctggtcttatattgcatattgggtgccaaggcaaattccttcttggtccaactctcaaccttctttgggggcatttattggcataatgtcctttctcaccacaaccgaaagatgtgacatttgtcttccgtcttgccgtagtcagatggcagcttccatttgcagggtattgatttaggtgatttagattgatggtgtagtcttcaggctttagtgaggcttgaactcgtcctttgttcctggaagcttggggaggatcttcaaagggtagcatgggctggtttattcccacattttgggggtcttgtagattggaggaattcttgtttttttttcgatgtcgattggtccatgtcttcatgtcctgtggtaggtttctcttgttacaagttagtaggttgaaagttagtaaactattatactagtcatcaatagtagcatgacaatgctgaattgttgtttttcttcttcatttgttcaatccttcgttccttaatatttattatgaatcttgccgacgagagttaaggtcacaccctttgcagttttactatccaatgatacttcaaattccctgtacaagggcaaatataccttgatatatagtattccttgtccatattttcccataagttattgatttcctcgaggtttctccatcataggctaccccccttaaaataagaaattttgaaagcaatttaaaaggagatatgcttttgcgttcacaaagaagattttttttttcaaaatgattttgcagaaatatcctttggaagtgatgtttgcaaaacatttaaaatattcaagagatgcagtttctcaccaaatataatttgaaaatagatttttcaagcaagattttgtataatcatacatatgtttaacaaaaagcaacatggcaactaaaaacttttgtaatcaaaattttttttttaaacaacatttgattttatttcgcaaaagagcactcttgccaatagggccaaaataccatatagattgtatgcatggttcaaagttgaaacaacaatacttttgaacacctcaaaggaaaactcatgaaagaaaattatttttttactattattattattattattataaatatta

SEQ ID NO: 7069 - DNA, 519 bp, Oryza sativa
cataataggcaagccgtgtaggcggaggcaccactcggcggtgacggaggcaagccggcggtgaagtcgtagacgcccaacagcggcggcataataggccagccgtgtaggcggaggcaccaatctgtggcgactgaggcaggccggcggtgaagtcgccaatcggcggctacggaggcaggccggcggtgaagtcgtagactcccaacagcggcggcataataggccagccgtgtaggcggaggcaccactttgcggtgaccgatgcacgccggcggtgaagtcgtagacgcccaacagcggcggcataataggccagccgtgtaggcggaggcaccaatcggcggcgactgaggcatgccggcggtgaagttgtagacgcccaacaccggcggcataataggccagccgtgtaggcggaggcaccaatcggcggggacggaggcaggccggcggtgaagtcgtagacgcgcaacagcggcggcataataggtcaatcgtgtaggcggaagcaccact

SEQ ID NO: 7070 - DNA, 763 bp, Oryza sativa
  unsure (1)..(763): unsure at all n locations
gggtcggcccgctcccgtttcggccccgagggctgggacgcnccgaccccctgtgttttggcgccacgtgtgtggataggtgagcccagcggggctcacctaccggcatttatagcgggttggacgagcgcgccacgccgcatttaatgcggcgcagcgcacgcttatccggtccgtgaccagtcccggtatgtgaccggtcacagaccggtcagatcgcgggttaggtggcaacaggcgtcctgtcgcacgcctcgcctcgtcccgtcggaatgatgagagtttcctggctctcgtctctagccgaagctggcgtgctgactcctggagttggtatgtcagtcccggtcagatccattttaggcttcagcgcaagcatggcaagaaagtcgctggccattgaatgaaggttgaaacgggcgtcccccgggagagctgacgagcggagcagaaggcgtgtgcagtgcttgtcagaggtcacttccggctgtagactagccctcattgtaaaaagcatgtttcctttcttaggcagctagaggcccatgtggtgacccctgaccacataaaaaggaggcccaggcctaggagagggggctggactctggccacttggttctagagcctgagctctctctggttctctcgagctgtattccttcacacacagatccaccagaacacaggagtagggtattacgcttctcagcggcccgaacctgtctacgtcgcccgtgtcttgtgcgattcttctcgctgacat

SEQ ID NO: 7071 - DNA, 1702 bp, Oryza sativa
tgtgaccgtttgcccaccgatatgcctccccctcctcacctccccaattctaccgcgtgcatgttattctgctctttcaaacatcgctgcatgccccctctctattgctcctccctcctcgacgcagtgtaggagacggtgcagggaccagatctgatatccaaacctcggggctgctcagggttaccaccagatctagtccttgtagcgcttcctccactacgcgggggaggagaactgtttgcctaccgatgtctctcccacttgtatccccaaccctaccgtggggatgtccttttgctgtcccaaacatcgctgcatgcctcctctctcttgctcctccctcctcctcgacgcagtggaggggcgatgcaaggaccagatctaaaacccaaatctcggggctgctcagggttccactagatctggtccttgcagcgcttcctccgctacgtgggcgacgagaagttaggggcggagaatgtagtgatagtgcttgattggtaggaatggcggtgatgacaatggtagcttattgagtaggagtgatggcggagacttggatccgctggttggggatctaaggagagggagtggtggcagatctggtggctccatggtcgatgactgtgtcgtgagatcacgaaggcccgggaagtcagcacggagattgtgacgacggccttgccctatgcttacggtagttcgatccctaggtggtggatctatattcagttgttccgaccctccccactcccttccgctgcgagcttgaggcacgagaccttgctacctcacaagttagattatctcatattctctttttttcttattgttgtgttttctctttgcacagtttttcgtctgctgcttttcttagcttgattgctataaacaaattgtggcaatgtggatttttgaaagcgtatgatttgttgaatgttgaattataacattagtatttatgtacttttgtttccaaagctagtatcactactacagaaaagggaattagtgccggttgggaaacccccttcggtgccggttttctcaaccggcacaagggaggcggcactgatttgaaataaaaaggtgccggttcattagaaccttttaggttcgacgaataaaaaaaagccggctcgatgcgttagctcgatcgagccaacgcatcgagccgagcagtccctcgtcccacatccagaagaatagaaagaacaagaaaattttttttggcaacattcatcccacaacatgcaaagatggaatcatccacatatcaaattttggcaacattcatcccacgacacaaattttggcactcaaatcaaatttatgcaataaaaaaaatcacacctcttcagtcgtcaccgtcgcacggtcagccgttgcgccacctcccatcgcgccgtcttccttcggcgagcccgccggttgccgccaccaacctccccgggagcccgcacccctaccgccggcttcccttccgctagatctagtggaggggagggctcctccccgccggcgagcccttcgccacctcccctttttgagccaccccacccgccgccaacgccagatccggccacccccgcctgtcgctgacgcctcccctcctgccggatctggcggaggggagggcgcagttgccgctaccgcctccgctggctgcgggagagaagggaggggagagagagagaga

SEQ ID NO: 7072 - DNA, 19623 bp, Oryza sativa
tgagttctttttcttataactggtatatatcataatagggataagacattttacgaagaattttccaccttttaagttatttacatagaacgataattaatattataaaaaaacggtgacatgtttccaaaatgttagctttgtaataccatgcatcagtagtaattttaatggtacataagtacaccaagacattatctaacaaaatacaccaagaagcataaaaatataaattattataattataaattataacactacaacagaaaccttaataggaaacggctcatagtcataggtgccaaactgccaattcatttaaaaccggcatctattgaccattttccactttcatgggataaaaaaaaattaaaaaccggcatctttaagaacatacaggtgccgattctagaaaaaaatcgatacctatactgatattatatgtgcatgttctttaaaagaccgcctataattaaaaaaaccggccaaccgagccgactggcgttatcctctgccgcctcctccttctccccgctactgcccttcttcctcctcctcctcatcgtactgccacccctccttcctcttcctcctcctcctccttagccaccaccaccactcctccttcctcctcttcttctccatccaaccaacgccactgtcaacacagggactgatccaccgccacgaccacggggttggcccggtcgtcgatgtgatggtgtcattctttgtctgtttgtgatgatggtgatctcagtgatgattgtgattgtgtttgatgtgaatgatggtgatctcagtgatgacggagagttggtcgaggcatcaagccagttttttttcattcctaggacctcaaaggtgttgctttgctgggtgccgttcgaaaatatggcacctatggtcatctcccaaccagcacaaatttccttttctatactccctccgtttcatattataagacattctagtattgcccacattcatatagatattaatgaatatgtacatatatgtctagatttataatatgaaacagagaaagtagtagtgtatgtgattactagtgatttcaacaatttgaattataaattatgacagtacatgttatttgttctacttataaccttaccagccatcttaattaattgtagcaaaggctcacttgctcatggacaatatatacttgacctattttatcagatccaacacatgttatccatgcatctcgtagataagtgcattataaattatatcttttgaacaaacaaagtatgaaccacagcaacacattattcatcaatccctatacatcatccacatcacacttgagctttccctatgcagtagggtaggaaggctccatggcgaggccacacatgccccttttgtcagaaatgtccttctccatcctcaagaaaccattctcaccccaagtcgtgccccaggagttcttcagcaaccaatacttggtaccatcactagccttgccatagccaatggccacaataccatggtccaagtcagtgccacatgagccggtcatcacaccacctttgtagaactggaatgtcatgtcgcctccatcgacagccacagacacaggttggttagccaccgccttcataagggcagcctcattgttggctggcacatcctcatagcccttgatcgatgcgacgctgttggatacactcttgcacttgtcgtctgctgctgcgtatgggtagttagactcggtggtgaggccgccattcttgatgatgaatttgaaggcgtcatccatgagcccaccttcgcagccctggtcctcaccatggacatcacagtcaacaagctcttgttcagagagtgagataagtttgcccgtgctcagcttgacaataccttccatggctgccacggccgaaaacgcccaacaacaacctgcaataatcattcatgttcaatgcattggacacaatagatgtcatcacaaaacgctatcataaaagatactgaagaatgtcatctgagtagcctgaattttcttaccacattggccttgatccttgatgggagtgaccgcgcccttggttctccagtccacggtcgccggcagcgcatcaatgttaacattctcatacctgaatccagtaggaaccctagtcgtgctaggaatgaatcccttgttggtcttcatccacctgaactcgtcattggtgaggtcggcgaactggttcacaccaagccagaaattgtggttaccagcattgaacgactcgatgaaggcgacattggccttgaacacctcgaaccggcgggccttctcggcatcgtccctgtacacgcgcccgtactgcgccatccacctctcgtgcctcgccgccatggccgcgtcatcgctcagctcacgagctgctagaacagcgctgcagaggcagaggcagccgaggatggcgaagagcagagccttggccatggccatggtcgatcaggctttgtgacctgtgatccagctgctgttggttgctgctctgctgctgcttctgtgaactctgcttttggtttggtgaattggaactaggatgcattggtatatatagtcagtggtacgaacttatgtaagcacatacggtgcgtgtacgatgttgtgtttctgtgtaaacggcagtctgcgtagccgtgaagtatatacgcgtataaataaattattgtgcataggacgtacgtttcctgcagaacacagacgcctacattttaaattatgctgtgggggtttgttgaatgggaatatgaatacaaaattggaatttgagtgctccaaatttgccttggtgaatgtgtggctaaatgagacgtggttcacacggaatgaatgtgtttatcataggtaatggaggattagagtgatgtgtttatcctatggagagttttgcacattggggcaatcgaatttaggataacataactgaaaatagttgtattgcatataatagatagaacatggagtacaatatattttgagtactcgtatttacggctaattatttttttcaattctaggcgacgtacttattaacaacgaggtgctagagataactttatcactctcaagatatacaagttcagtcttttcgaggtgctaataaaggttgggtgtatatgtgcgtttatatgggtgtatgtgtattgtgagtatctacgtttgtaatgttgtttctcaaattaaaaaaaatgtatttttggagtttttttacagagagaaaatacagtattttggttgctcttaatcgaaattaaccagattaacgttactcccaaccaaattactagagtacttttaactctacatgagtccaccaaatcgatgtaatcaaagagaatttctccttgccgtaataaaattaatgtagattttgttctctcgctgttggatatttgggccagcagcaggtggagggcatagagagcacatctgtcagtctctggtctatctatactaatataaaaagtataagttgtgtctagcaatcctacaggtgaaatcacctcctcccatctcatccgtccatctaccatctcatctcatctaattcgtttcgctatcctcctcgctccaccgattccaacgattatagcgaccttatcctctccaccgtccacgcgcgattactccgcatgcgccatctttgccgcgcacctcgcctccgccgcattcaatccgtcgcgcatcatcgccacaacgacaaatcctcatatccgacgctctctcccaagcgtcgtcgctgctacctccactccgcctcggtcctcctcgcctcctcgctcctccctgcgtggcgccgctccgccgtcgtccccttgcttcgctccccctctcctcctcctcgcctcctcactcctcctcgcgtggcgcacgccgccgtcgtccccttccgccgccgcccagacgccgccgtcgtacccttccaccgctgcccggacgccgccgcccatacgttgccatcgtccccttccacagccggagccgcggtcttccccatcggccacacaaatcgcgccatggcaactcacaaaattccccacgcgtggaccaccaaggctccatcgcgctaatcccgcggtggctcccctaatcatgataacgccgtcgccgcgcctttgaacgctgctgcaccatccgtcatcatccgcacttccgccgccgtcgtcaccgcaatcagtatcctggtggtccagggtttccaccagtgccgctaccccgtctcgccctggttgtgcatactcccaccagcgtcgcagctccgtcgtcgccctgcaatcggtgcctcagtggtccagggctccgctggcgatgccaccccgtcgagccacggtggtcaagccttccgccgacactgagcctccatctttgtcgctgctctgtgagtcctctagtgttgccgccattggaaggggatagactcagcagctaggcctcccagccgtgtgcctccctctcttatgttggtgatacctgattcaactcaaatcgactcttttcaatccccatttttcctctttgtgaattttccccattagttctctagctgaattttcttattcaagcttaatggtatgcatctccttttagttatgttattcggttcttctttacctttgtggataattgcaggctatatattacgtgattggtgctgcagtttcatacatactaacattatagttgtcatgttgaatatcttgcagattgtcttacagagagcaaattcaaccatgcctagtctcttatcttttttatttagtcgaaaaataacagttcctttcttactgaaatggaaaatgcacgaaaccctacactgcaattttctgcaatgacagggtaaatagccatatcaagcccgtttgttgctgttgggctgcctgcctcttatttttcttttttatttctgtgatcatcaacaattactggattgtcgtcccttatggtctttcatttgattcactgcacggttgataagttcactcatttgctgccaattgttgttgactaatttctttttcatattttcttttatctaaatatatttattctgtacttctattgggccatatatagtctgatttagtgtttgtcatttcaggtgacattgcttcttagccaattggagcacaaaagaaaatccaataaacaggaaaacatgatttagtattggacatcatttctgaaagcttttgcacttaagaaatgcaaatggacaagaataaggtatgcggtaaacatgatacttctgtgtggcttactacttcactggtcctactactttagagctatatatttttgtgtgactgtagatgggttccattaatggatggctgtgagaactaacatttcaattttgtatatatggtagagcttcctcgggtggttggtagcagaacaagatagtataagttttcaagtggatagaactaaagcaaagctaagaattaaacatgtgtaatggaagtatcaggaattcagaatggtagttggcgcatatggaatggatttgatgactgaaaattgtgtaccctgtgaagaattcattgctggttttaagttttaacttcataccgttatcatttcaaggaaagaaggtcttgcaatcgatcttctgaagagctgagaaaggtacagcttaaaaccattatttgttctatagtgaagttgatgtgtgtatactaaataacatcgtcagaatgagcaaacgctataaacgaaaatcaaccttcaaatataatatgtataagctttaaatgttaatggccacttatgcaaaatgcactaggtaatgttgttcttcattttcaggagcgatttgtaaattaggttaatgaaacaaaatattccacgttttgcccaatttctataaatttgagtacctgaattcactcacaccaaatggattgccacatcttttaaaggtcaaatttaattgtcttgtcatattgctgcgcaatctcgacccgcacaacgggttgtgcaatggaactaggcttatgattagagcatttcagaattattccattagtgctgagattgtcagtggtgcacatgctgggaagagggtcttcataccacggattccattatacccctcggaggatctttcattgccttttaagttcaagcggaagcagttttccatccgtcttagttttgcaatgactatcaacaaagctcaaggacagacaatcccaaatgtggcaatctatctccctgaacctgttttctctcatggtcaactctacgttgcactctctaggggtgtctcgaggggaacaaccagaattttggccaagccaaggatagacattgaccccactggaaaaagcacaaagaacattgtatatcgagatgttttattctgaacaggtatgagattctttatattcatgtcgacatgactttctactttcctgaaattgaaggttcactcatctaatgatttaattgtgcacctgtcacttgctattaatgttttaaaacttgctcctgtcacttaatggtatttcaattaattttgccaaatattacattttgattgagtaattaatattatatctgcagattgtctaaggttgattagagagtaccatgttcagattcttctgaaggcccagttctttatattattcattggactgttgagcttggttgtttctggaggaccaggttgcatggatggtgagtatcatattgtttacaccaagtgttcattgatatggaggaaaacctgatgtactgatgcacaagagtatttcaaataatcttgccaaatattattttctgattgagtacttaatattatttgtgcaggtagaatgtggttgcattgagagtactatgttcagattcttctgctggccctgttctttattttttttttttcactggactattgaacctggttgtttctggaggactacggagcatggctggagtatcatattgtttgcaccaagtgttcgatgatatctagaatatcatattgtttacaccaagtgttcgatgatatctggaggataacctgatgtggattatgagcttggctttgtcttgacaaataatagatgagttgatgcttgtaagagaggtctcgatgatctgctaattgccactgtttagttacatggggtgaaataattttgtgcaaacataactgatgtatatgacaatacgtctctgatttggatcttgtaaacttatttgatttgggaaggactgcaacacttgaaatttttattggaaggacaattcagaaacataattgggaacatttgctatattattttatgatcttatcctgggttgtacctgaacttaatattctgacatgccggttaatttctgagttcatttgctgaacttgctgactaattttaaccggtgatgtgcctgaagtttatattgtgacatattggtttatttctgagttcaatttctgtacttgcggaccaatttatatcactcacattggcatgttgttgttgttttctccaggactccaagtggtctcattagctaatgatggtaaataatgctataatttgagggcaacattatgtattctatagtgatgttgtgttctacgtggacatgaatacaaaagagcatgctactcagaaatcaggctagagttcaaatgatgattttcatgatctataaaacatttactttttattcttaaaaagtgcactacatagataagttatatttattattctatcttttatgtatataatactaaaacgtgccttgcacgtgcacgataactagtactaatataaaaaggaggagttgcctccttgcaatcctacgggtgaaatcaaggaaaaccagggcccacgcacaaacacgtcgaatccccatcccatcaccacggattcctctgccgtccccgccgccgctaaccccgtcgccccactccctctatcaccgcatccgcatgtcgcttcctcctcaatcactctgacgatagcttcctcttcctcttgatctcgccctcgatgacgcgccacctacacacgatttcgccttcaacaaattcactcggcctcttcctctgctcgatctcgctggctgtctccttcaccgccacgaagccttgccgcccgcctccatcgttctcctgtgtcgccatcaccagcaagacctcgcaccgccgccgttgtgaccctcgatccacgccgagcttccgcctccaaggccacagcgatctcttcttcagttctcaacttactactgggtgaaagatttgcctcctctgtgtactagcctcattctcctcaggtaacatcctctctatgtactagctgcttgatggaattcccacatgagaaaatttcgtgtattctgtttcaggttgcgtagagtaagggagaaatttcagaactatgtacaaacatactccaatgattttgctgccatatacctgctcaactatttactagccatcatccttgtcagatgcactagatgagaaataagagtatcgaactcatcttctggtcagtgtgccatcatactgcaaaggaaggcacgttcttttccattttttttttcaaattttaatgttgctcagctctctgtgcctcacacacactttttgattttatttttttacttctatctatcgtttgttaataatatgtgtattaaatatatttttactcaaataaaataattttagaccttcatttcattaacagatctaatatttgtgtatgatgtttgcaaggacgataaacagtattgaaggaactgcaaattactcagatgatctttacaacaatggatgaaaatgatcacttagtgttgggttccaacagtatgatccacttatactctgtaatcatgatgcatgatttctcacatgtatgccaagtttatgcactccaaatcctgtcagtgaacatctagatacactattcagtttcattgaaaataaaaaagaagtggaccagcgtggaccagccatcagacaaattacagagtccattactctcccccaatcttcctctgcaacattttctggtggtgatattctgagttcatgtttaaccaacaaatcaaggcacttgcttggattagagttccacaccaatggttgtagtggttttagcgatgaccatgaatatttaactattgcctaaccggtatgcagtcagggtgccacgtcttagatctatatggttagctcttattctactgctcactttgcttcttgccaaagtagtttgacggtgttttggtttcaaccctctgtccctggaacaaaataaattttgggcaccatgctctacaagctggattttgacatttttctacccaattttttgcgagtttgattggtgctaattaaatggttttcttttggtgaaacacaaacttatctctgttagtaatggcaagtcagcaaggatgaccacctgtacaggattttttagaccggtcatgactgggaataataagtaaggatatgatgatatactaccactcagtctaggaactcatggaggtgcgtaatagttatgattgttacatataggctagcagaatggtattttttgttatttttccattagaaattttccacatacatgattatgctcaatcaagttattacatattgtaggataattaatgacaaaaatatgctgaatcaagttgttatctcaggttgatttctcagcaaaattatactgcctgaagaaagatacttcagagaaagattgagaaatgaagcttgcacacggtgacaatacctaactctgagatattgtttcacattcactctaaattaacatgataattctaaaataaattatagatgcagctgttaatttcattttaaagtgcaggagctgaaatctttcttccccaggtcaagaaagaacatgaaccttaatggtcaggcataatcccaatattctatattatgtttcacccatcagaggtcatgtggcggtctatgtgcctctaactattgcatcgattaatagttcaacatattcttttattgatccagtgtcaatctcatgcagtgatttttcttatgaatatacatatgctactctacatgattcagctcacaacacaaaaacaacgtgattacaaatttatttggtgaatattcagttgcatacattaagtgtcatgatatgtgtaaacatatgtgaataatggtttccattgcttctttataccatgctccacaaaagtgaaaatagtggtgttaaagatattgctgttaaattatagaattctcttatgcaaatgcctattttctaatctgatcttatgccaagaatctttgatgttggtgttgtggtcaagtaaggggaaaaagtgtagcttgaacctcccgatctcagctgtttctgacctctaaattcgggtaaaggccaactgattgaagcaacaagtgaactacaaaattttctaggtttgccatcatttcagaaattatacattattcttagaaccttggttttatgtgagctggaactgttgaatcgtacaaaatatattttgtttcatggtgcctctagctaaatatggagcttaatttcctacacggagggatcactcacctccaccatatcagtacgataacattttgtagtaagatggttcatgtaatcatgtatttagatatgcttgattttatagttgtggaaagaactaatttgtagcttcaaatgcaatagcttcatgtacaacaaagcattgccattttataatctctttcgttgttcacatttcaggagttacatataagtattttcatttgagtataaaaatataataatgtgttgagaagatgattgtgtggtgactagctctgataattgataattttgtttatgctttatacaatgtgcgtctttttttagcactgatcaacatgagattgttctactgaccagttaactttttgcacgcttagtatttatgttgcattgtatatgccttcgatgtaaatgcaacaatttgaaaaaaaaaaaactatattgaaatatgtacgtagaaaattgttaccgcattattaatgtcaaagtagatagttggagataaagaatcaatttttatgacctggtttaagttatatatagctttcctcaaggatataattttaaatcgtacctatatttttctagattcttgaatatccaacacatgaagactcatagctatggaagttaactacatgtttgcataagtgtcattatattggaagttttttaggtgctggatggaactaatcaggaaaaaatttaattatatttatggttaatttgatcattatatttttggtgttcgaagttagtttatgtcgatttgtactgttggcagacaaattaagtcttatcctccaactggtagtgtccaccatttgtggtggtgcttgagaggcaagttgatatctatcatcagatattacggagaagcaattcattgttcgaaatagatgacattgaacatggtcaaaagtgcaagttggtgggatcgaatccattgggttagaatggcatgaaacctggacctcatgagaactatggacacttctgtgacttcgacaacaagtttggttgcccatgtactattgttcatgtattaccctgttcatagcaaatgattgaaaacaaggatcatcatttgagggtttttgtttatttattgttagatcctatggagttacaaaattatttatgcaaagttgattaattggattgttcaagattcaagtcttatgggatttattgtgtaaatttgtatgcaagaggaactggtgtccttgtaacaagcatatatatatatatgaatctgcgaactttcaaacatttcacaagctcactacattgaacatatatgaatgtgatctgggtcaaaatttacatatattgctgagttttctgcagaacactcctaacctcgagaaagttatattgcagaactgcgaggtactacttatagtttctttcagtttgtcttgttaatctgctttcttgatttatcatcctagagtgatcctgtgtgatgccccaatagatttcagatcattcgagaaagaggaaaagaacacccaaggcaaacaggaaccagattcattccaagagcagaagtctgataacttccaagtctgagatctcgaagataatgaagatgacatatgaagatgacggtatcagcgaccttattgaacttttgttgcgcagttggagaaaacttgaggaccatactatcataatcaccaagatttgagtcctttgcatacggtgttatcatacgcctgactcttatgtcattttgtactatgatgtgagtatttttaccaacagcaactaaacccatatatatgactaacgccaggctggtgtgattaagggcattacatccattgtatgctagtattaactgtttccagtgagattcgtaaaatcactcttttctagtttcaagttgagaaatttaagtaaaacagccatttgattatttgatgatgttcctccctattgatcaattgacagttgacattcttaccatactacaggtgcaaaaggattagcttcatttctgttctgtcattccaatctatagagttcttttcaaaatgataagtgccaatttctcatgtttttatactagaaatgcaaataaacatcttcatgatgctcttggaataatctgttgtgaggataatgttttgtgacactgcttttgttgaaagtcatttattataaattggggaagacaaagtaattgattttcttgtccaaatatcattcaacaaattcttcttgtactaaaacactatctgattattacacccagtgcttcaacaaatataatacagaaacagtagggaaaaaacgtttctactgagcacatttcgccatgcccatgtatacaaattaagaatgtcacccaattgattattaaaaggcagatttacgtattacgttaccagctatatcaatacatcattccaatcaagaaaaaacattttttatatgtcaaataaaattatcaagatctacattatagaaggtaaattgagaaacagttggaaagtgcaaacctgttctacattttgcagttccatctattctcatgacccgtggaagtgcatactttgtgtgttccgtgttgatctttatccaacttgattagtcatcatctggccaattaaaagcctgcaattcgtacaaagattgggcagattacttttgagttttgacattctcatagttgaagacatgttacttacgcattttaaaattccaaatcattcagctacgaagttataatattcttttacttagaacataggagaactaaactttctccctccattattgtaatcataaccagagatctaaataaaataccttggtagccagatgaaaactattccatgtcaatatgaagcgtactttgaggcaaactcaacaatattattatacgagctccctcctttcttcatggcttccttagctttcttcatccacctattagcatttttcatgtaatctgccttcctctcactctctagaacctctctgatgcatctctccacctcttcttttctcaccattccttccttgtcccgccgtacgcgtacaccatttccccatgcactctcaatgtacttcgctgtagttggttggtctgtccactgaggcatcgctaacagtggaacaccagtaacaattgcttctgttgttgagttccatccacagtgagttaagaaacaacctgttgattaatgaagaatgatcagtttctacctgcagcttaattatttgaaactgattactgcagagagttccgatagaagaattgacatgatacacacatcttatcacccaagagttggattgacaagataggttacccattggataatttggttgaaggcagtaacttgagctaggttcgtgggatccaaaatatagatcttatgaaaatgactcagtatgccatgtgtacaaaattaggggtagtatgtccttgtaggattctatagatgccattaaatttaagtgaagaaacactccaatcaaactgatcagtatctatgcatcagttacaactattgtattcgtgcttttgtctttactctgacaactacttttaactgtctacgcggcttatgtaattttgagagagatatggttcatatattccaatatctgggactttcagtcttctattcacaccacatatctataatcatggccttatgacattaattctgtctcatgaaatatttgaactagtaatttagtgaatgaactgaaattaacaatattattaccaatttgactcaaaatctgaattgaatatattacatttccgcatttgaatcaaacagatatggggccttgagtaacgtttaaccagattaaagaaagttgcttactagttgcgtatctttgtcaataaaacatgactttttgttccatacctgtggctttgtgagataagacctcgagctgggggcaccaagaaacgattaggcccctctccttgcacttgtcacggagttcttctgatagcttgtgttcattacaggacctcacgacccaaaggaatggtttaccagaattgcaaaatccattacccagctcatctaactgagttgggtcaagatcagcaacagttccataggaagcatagacaacagagcaagggggctgattatctagccacgccaagcatggtgaagtgctgtcagaaatgttgaacccatagttcttgtttggttgcaagcgatcgtcatccaagtagaaggatggcacggtcgggccaaccgtcttaaaacgccatgctgatgccaagtaatctgcctcctgattaagtaacaacattgcatctatcaaatcttctacgtttttcattgaattgaacactgccatgatttttcagctgaatttgaaacgaacctattcgttgactctatttctctaattgtctcttgggcaaaacaacaaacaggcgaggggcatgagcaggttgactcaccttcggctccaattcttggaaagagttgacgagcacatcgtcggcgtcctccagcccatcgaactggcccaacaccgcctccaggaacggcggatacgactccggcgccttcacgaacgacggcacgtcctccggcccaagctccacgctcagtgtcgaaacatgatttcggcaataataaaagggggtagcgcacgagacctaaaagtggatggaggcggagacaaaggatttagacaggttcaggccctctcaatgagaggtaataccctactcctgtttggggatttgaatccgccgggtgtattatagatctgacgatctagttgtctcatcatgcccctagaggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatacagcatatgcggtgtgaatcctccaaataacatgatccgggtgatataccaactgctttgtaaaatatgatgagtgatatagcaaaatagctataaagaagcttgaatgctgtgaataaagaaatttccaaagtattgggcatacgccatgcgcacactgctttaacagatgtgcttaagtccctaaaagacacatggtttcaccacacctggaaatatatggcatatgtggtataacatccgagtaagtaaactcataaaggatttaccaaccgcctgaaaaatgaccataatatataatcagcctaagccataatattggtcaataaaaatgcacacttacgtggcgaaaagcaatgatattgtatctaatcaattgcttaaaaacccaaacagcaccttgacttatatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatactcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggcccagtctttgagcatagaaaatagactcatgactatgaatccatgtggaatgtatccggaacaaatccaaattggagatataatcctcacgcttgagttgatgagcccctgagcatatagcttgtccttctatcatagtcaaaattgtctattggcaataactaacgcagtcggcatggagatgaaatgaccaacatgaagacgaaattgctcatcagaagtaacggaagatgtcagtggtagtaaagatgccaccaattaaatgtaatgaagttgcataaccatggaggtgaagaaaccagtcggcaacagtcaggtcagctagcagtgaagatgtaggcgcccaacaacaacgaaagaacagtcggtggtgacagacgatgcagctggtgaagaagatgaagatgcccattagtggcgacataataagccatccatgaaggcgaggataccggtcggtggtgacaaaagcaagccgacggtgaagatgtagacacgcatcaaaggtgatgacgaaatccaccaattatgaagatgaagaaaatagtcggcaatggcaaacgcatccgacggtaatgatgattagcggcaacagagatagccggctatgatgacgaagttgcccatcaacggcagcagagtaggctatgttgaagagacttgacaggatgtttgatgaagataaccatgtcgttgatccagtcaatagtagtgtagcagtccatgataacgatgagatcctctatcggcagttgcatagtaggccaaccgtgaagacgaataattggaggagagttgatgttgttgcccaactcgtctaaaccgaaatatttgaagttgttgaagtagaatgtctgctctgaatcaaagatgaagataatgactcctggagttgactcgttggttgatgaattgatttcttcagcttgacataaaatttgtcaaattttgagccttgtatttgtgtagcccccgactctttggttagttgggaaacaactgaacatagagtcgagaattatagcttcttatcgtcgagtagtcattgcttaattgaagatatgtgttgaagatgtccaagtagagatcatgaatgttggagagccacttgttgtagtaaaataacacggcatcgcatgccgagatgtcgagattcacaacaacgtcatggttggtgaagtagtaaaacttgcgaagtagcagcaatagagtttgccggtgccgaagataataaagatgaagtcgctccaccatgatgacaaagtggtattgccataatgaagtgaacacaagtcggcggcaacagaagcaaaccggtagtgaagacgcgtagttgtgaagataaaagcaccaatcggcggcagcataatcagtcggcgacggaagatgatgatgtccatcagtagtggtagctgtataaaccagacgtagaggtgagggcactagtcaacagcagacgagatgaccggcggtgaagaagataaggctaatcaacactggtagaatcatgtagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgctagcggtgacatcagtcagtggcggatgcgacggccggccggtgaaaacgtagacgcccaacatcggcagcataataggccagccgtgcaggcggaaacaccagtcgacggcggtcgaggtgaccggtcggtgacgacgtagacgcccaacaacgccggcataataggccagccgtgcaggcggaagcaccagtcggcgacggacgagacggccggtcggtgaagacgtacacgcccaacagcggcggcataaaggccagccgtgcaggcggaaacaccagtcgccgtcggcgaaggcaagccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaagcaccagtcggcggcggacgaggcggccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtgcaggcgaaaacaccagtcggcggcggcgaaggcaagccggtcggtgaagacgtagacgcccaacaatggcggcataaaggccagccgtgcaggcggaaacaccagtcggcagcggcgaaggcaagccagtcggtgaagacgtagacgcccaacaacggcggcataaaggccagccgtgcaggcggaagcaccagtcggcggcggacgaggcggctggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaatggcggtataaaggccagccgtgcaggcggaagcacc

SEQ ID NO: 7073 - DNA, 6570 bp, Oryza sativa
  unsure (1)..(6570): unsure at all n locations
cggtgaagacgtaaccgcccaacaatggcggcataaaggccatccgtgcaggcggaaacaccagtcggcggcgacggaggcaggccggcggtgaaagcgtagacgcccaacagcagcagcataataggctagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcatggacgcccatgaacggtggtgtgaccaaccaaccgtataggcgaggacaccagtcggcggcgacggaggcaggccggcggtgaaagcgtagacgcccaacagcagcagcataataggctagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgttgttgttatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgatttcggcaataataaaagggggtagcgcacgagacctaaaagtggatggaggcggagacaaatgatttagacaggttcaggccctctcaatgagaggtaataccctactcctgtttggggatttgaatccgccgggtgtattatagatctgacgatctagttgtctcatcgtgcccctagaggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctatactagtcgaataaccattccgtatgggtatggggtacccataatatccacactcagcaaccncggagcgcgccncggtcctgacgggcaacccaacgcgcaccgcccagacctccccgtagatgacgtccacggcgcacggctgcgagaagaatgcgacggcaggcacacaggcgccgcgcgccacgcgccccgcccacgggaggtgcgggtcgtacaccagcacgcgggggggcctccccgcgtcggcctcagagcggagaagggcgcgcagcgtctcggagcccacctccgccagccgccgggtgtactccctggcgtccccgcaggccgccatgccgccgaagtcgaagccgtcggagatgccggcgacgcgaaagggggcgggagggggtggaagggtgaagaggacgtggcgggtggtgacgagcgtggggaggaggccgtggtgcgccgcgaggtggcggccgagctgcaggatcgggttgacgtggccatgcgcctcggggaaagcgaggaggaagatatggccgccgccgccgccgtgttgggtggaggaggaggtggtggtggccggtgcgctctccatctcggctgtttcgttttttcttctctctgtgtcgcccgggaggccgggacatgatgcatagtccaagactagtccatcctaccatttttggtttttcttctagaaaattattttacaaaattgtgttttcttttcagtgttagaaaagacaattttgtaaaataattcttaacattttttagaattataccatctccaaaatatatatttaactatatttttcttattataatatataataaataaataattttttatttttattatagtatttcctaaagcaaatctatatatttttatttagcttatattcttttaaatgtttagagaataaaattagctggaagtttagataaaagaaaatctagatttatttttgattcataatgaaaaaaattgttgcaaaatttacatttagatgtcaaactaaacttacataattattatttgtgccatcttctctagtgtggttcattatttttcacggtctccattgctgcttgaccctcttatctttcccttaatttctattggtgtgtctgctttgaaaggacatgttatgagtttttgattttaaattaaactaaaagctctacatattattatcaaaatcgtcttagcttttttttttcatgcacagttttttacatacaagtgtgctaacctatagaattaattgttgtaaccaatgctaatttaagttgcgttcgatctatctgttttgagatttttgacgcaagcaaaacgagaaatctcattagcataagattaattaagtataaataattataaacttgaaaaataggtttatttgaattttttaaataacttctatatataatttttttgcaaaatgtatcatttaacagtttgaaaagcttgctaacggaaaacgaggaagttgaagtttgaagttgagaaatagaactaggccttaatcatagggacttaaaaagtacaatgtatacttttttttttgactaattttcagattatactaaaattaggtggtggttttgccttttgttttctgaattttgtaaatacagtcatgtgcagcgtgggactgtggattgcttggaaagccttttatatttgggttaattggatccatgccattgcaaatatggtaaattagaaaaatactactgctattcgcgatatctgctgggtgccactggaattttggcaaattaaatccatgccatgccgtcgcattttccgtccttcccccgttaatttcctaactccgtgctgtctttctagttcgccgttgaaagcgtcgccgaactcgacgaccggcgcctctcgggggatggtcgctggcctcgacttcggcctcctcaactcgtcccgcgccggcctactctaccgcagtgccgccgtcaagaccggcacacacgtgtttgcggactcgaggacctcgaccccgccgccttcgagtcgccgtctgccgaggaggacgcggccaagtgcccgcagtctgtcgacgagtttcatgggaggggatgcgtggttgacagctgttggaatgtgatttcctagtttccttgtacacggctcaccttccatttctcctcccgatattgtttccataagtcggtggagagagtatggagggtgatgccctatacatgtaacactctgtgatgtgaatcaaccattgcatcaagcgcccntgtgttggccaaagcgtcgnccatgccagcacgnccgacctcttccgggcagacggcccgacagctccagnccgctcnccagccagcggcccagggacagcaggccgccacctcccggtctgccccagcatcgcctcaaggcccacccgcacgactggcctaggcggcccaagcgtcagctccagaccggcccattcacttgggccggtctccccgacgcacgccatcacaagtccggccgcccattcacgtgggtcggccgcccagctctctgacgcctctcctgccagatcgccaggaccctcccacgcctccacgctcaccctgccaccacatgtcgccatcccgacccggccacggtcggctcgtcttcccggcgtgcctactccaccatccctgctcggtgcgtcacccgtcgtcaacgaccatggcatggtgacccgcggcaagcacggcatccgcaaggtgtcagatcggctcaatctccatgcggcggccctctcaccgattcctcggacatatcgggctgctctcgccgacccacactggcgctctgccatggaagaggagtactctgccctcctctccaaccggacttgggatcttgttccctgtccctcgggcatcaacatcgtcaccggcaagtgaatcttcaagcacaagttccaatctgacggctctctcgatcggtacaaggcacggtgggttcttcggggcttcacgcagcgccccggcatcgatttcgacgagaccttcagcccggtggtgaagcctgccactgttcgcaccgtcctcagcttcgccgtctcctgcgactggccgatccatcagttggacgtcaagaacgccttcttacatagtacacttcaggagacggtctactgcatccaaccacccggcttcgtcgacaccgcccaccccgacatggtgtgccgcctcaacaagtcgttatacggcctcaagcaagcaccccgcgcctggtacagtcggttcgccaccttcctgctgaccctcgggtttgccgaggccaagtccgacacctcattcttcgtccttcggagcggcaccgacaccgtctacctcctactttacgtcgacgacatcgtcctgacggcgtcctccaccaggctccttcagtggaccatctccgcgcttcaatccgagttctccatgaaggacctgggcaccctacaccactttcttggcgtcagcgtaactcggcagccctccggactgctgctcagtcaacgtcagtactgcctcgacattctcgaccgtgccggcatgacagactgcaagccttgtaccactcccgtcgacaccgcctccaagcttccgacggtacaccggtcgcagacccgactgacttccacagcctagtgggggccctccagtacctcaccttcaccagaccgaacatctcctatgccgttcagcaagtgtgcctccacatgcatgatcctcgcgagcctcacctcgccgcgctcaagcggatcctccggtacattcgaggctccctggatatgggcctccacatacagcgatgtcccacgggcgacctcgttgtctactccgacgccgactgggcgggctgccccgacacatggcggtccacctcgggctacgccgtcttcctcggtgacaacctggtgtcctagtcttccaaacgccaggtcacggtgtcttgctccagcgccgaagctgagtaccgtgctgttgccaacgccgtcgctgaggtcacctggctccgtcagctacttcacgagcttcacgcacccccgcccaaggccaccctggtgtactgcgacaacgtgagtgccgtctacctctcctccaacccggtacagcatcaatggaccaagcacgtcgagatcgatcttcacttcgttcgggagaaggtcgccatcggcgccattcgagtcctccatgtacccacatcatcatagtacgccgacatcttcaccaaggggttgccgtctctggtcttcaccgaattccggtccagtctcaacgttcgttagacacgacgctgtgactgcagggggtgttggaatgtgatttcctagtttccttgtacacggctcaccttccatttctcctcctgatattgtttccataagtcggtggagagagtatggaaggttgatgcctatacatgtaacactctgtgatgtgaatcaaccattgcattgagccatactctctctcacaacagcagcttgcgacgcagcagcagcagcacaaagccaccgtgctgcagcccgccgccgcgcgccgacaacgaccaccgccggaacgaaactggcttgttgctgcttgtagacgatgggccacgacggacgacgacttggatgaggttaccacgattgacgatgaggacaaggagacggtgaggatgagcgatgcgatggggacaggaagaggcaccgtacgtgacgggcggcttcaacgagaaccgcatccagcgccaaatccggctgggcttctgctcggtgaatgtcaaccactagatgccgaaacggctgttgttgcttgatgatgtagatcgacgacgaggttgctacttgatgcagcttgacgagggatgcttgtggctggcatgccggcagctaggggacgacggactgggatggaaattggatatgactggttgctgttgcttcaagatgaatgggccgacgactgagaacgatgccggtaagcgccatcccgtcgtgcgcgtcgtccaccacgacggcgccgtaacgggtccgcggcga

SEQ ID NO: 7074 - DNA, 15048 bp, Oryza sativa
tagtatttttctaatttaccacatttatagtggcatggatctaattaatcctttatattttgatacttctattgctagttctattccatatgtttttttctctctctaacacatgtaaggcaggcactggaaagttacagaaaaatccagctttcattgatccaatcctacggctgctcttttttttctccatcggtcggtttagctttcattgctgaggtggatcaattgagtgctatttttggattcactgttcacctatggagatttcttctgaaaaatatacttataggctcggacattctctgtatacaattccgtattttcaatagcccaggatttataggcagattagggcttgttcggatcacaggataggaaaaacataagaataggaaaacacaggaataatatagaattgcatatgtaaaacgaaggattgaaaaacatgaagcgtttggaatacatgaatatataaaccataggaattttctaattaatattgatctcatatattatagtataattatagtataattaagcaataaaatattagttcccatctagtcactccaacgtgattagcatcctccctgtggtagctaatgaaaaaaaaatgaggtgtgagtggatgttcataatcctatgaaattcccgcataaaggcctatttgaatcgcaggaatggaaaagcggagtaataggaaaaagtaggattctgacaggaatgcaggtgtaaaacagaggattggaaaatacaggaaaaacacaagaatgaccgtttgattggaccacaggaaaaacgcaggaatcggatgagagagatagactcaaaggaatttttccaagaggttggacctcttgctaactttcctccaaaatctacataggattagccattccataggaattttaaaggatagtataggattcaatcctttgtttcaaaggctttcataggaattttttccataggattgaaatccttcaaatttcctacacttttcctgcaaattaaaggagccctcacagggttgctacagtattcgtaaaaattcctacacgtgcttcctatgaaccgaatgcatgaatatagccaaatccaaaggattcgccaatcctacagaaatcctgtgtaatccctccattccgaacaagcccttaggccctctttgaatcaaaggaaaaaatagaaattctagaggattttatcctatgggaaataatcctatagagttctttgaaataaaggattgtttcctatcaatttgatgaaccctgagttcctctcgacactcaaggctgttgttggcccgatctttcggtgagttgtgataactacgatttgggagaaacgttgacgatccgactacaaccgtacgagacgttgtgttgcgccttagcaatcgatacacctctccgtgggttgctgatcttgccggtgcagatcaaccttattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccaagaaaccctgaaggggtacctaactatttatagaggtgggaggacgaccaagagggtccaagggtcgtgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttagaaagaggactccgagagctttcgatcaagtactcacgggccgaaaacggaggtcgtatgcagattcggtagccgtttgaagtcagcagtgtagtaggtggccgaatcggattctagcacttggagtacttgatctcgatatcttcttgttcatccatgatgtgagcaatggttgcatccgtggtagccatggtcacatcatcctccccttcttcacggaaaaccgtcctcggtttttccatatggtgctctttgcgtagtccatttacaacaacctgtttcttccaatcaaaaccaggcaaactcgagacaatttggttagcaataacatttttctctagcttgcatattttatccacatgtacaggaggttctaaatccgagcagatgtaaactctatgcacaaaatatattccaagatcattatattcaccaaagatgtgaaatataacattggttggatatggcaaatcagacttagcaaataatttctccttgaaattatcgagctcacaaaaatcatcaaactgaacatagcccaaagtatttaaagaagatctcaattcacgctcctctacttcattagcaatgtgaacaacatgcttaaaatcagtgcagtataaattaacagtaggaatagcatgttcattcacaagttgtggcatggatataagtgaagcattatcgcataactcttctttatcacaaggaacagcaaacaaatcaatttgtgacaaaggaatctcagcagttggttccactaatggttgctctgctatagcatgaaaagtggacaaattcaattcattaacaacacactcacctttattaatttcagcaccattaagtttacctttgatgccctcttcagataatggaggtgcctcgactttgagtgtgatcaatgggactggcggctctttcatgtctctctcctccttttcatgattatgcacttcctgcaaatggttagtaatagaagacaaaaacatagcatgttgcttcttcatgtcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctagtatcttgttttaaacattgcagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtctccctcgaaataaggcagtgcagatttgatcttacctagaacatcatcacttacctcataatggtcatgttgatccctcctcatgtctcgacgaagatgtcgatgttgagcgcagctatccccaattatcttgcgtatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacagctgtaatcaaatatgtggagctctgggtaggcttaaatatgtagcaaaggaatagcaaatgctcaaatcagataatgcaaagttgaataattgttcaaagttaagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttcttttttttttccttttcttttctgttttttttggtgcggcttttttttctttttttttttgcacctttctgccttttttttcacttttttcttgattttttttaacaaaaactgactcaaggaccttaatgtaagattacagggactcaaacataaatataaaatttacagggactcaaatgtaaaagtctaaacccaaaattaaaattatacaaaaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaaacttgactacttccaaaatcagatatggtaattcacctttctcctctcgtgcacgacacagacacggccaaaacaaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacacggtggtagcgacgactgtggtacaaaacatgaccagaactcgaaactctaaacgaactagacgctaagaccagcaacacgacgtgacaatgcaacacaaaattcaacaaagcaaaaactgaaaagaacaatgcaatggcacaatatggctaggtaaatgatacgaatttttttttgtatggctattttctggttataggaagataaaaactcaccgagcaatgaaagctctgataccacctgatgaaccctgagttcctctcgacactcaaggctgttgttggcccgatctttcggtgagttgtgataactacgatttgggagaaacgttgacgatccgactacaaccgtacgagacgttgtgttgcgcctaagcgatcgatacacctctccgtgggttgctgatcttgccggtgcagatcaaccctattcctgcaagcaaatcgaagaaacaagtaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccaagaaaccctgaaggggtacctaactatttatagaggtgggaggacgaccaagagggtccaagggtcgtgctccaccagattggggcgcaccccacatgggccccacatgggccagggtcccaaacaaagttacaagcccattggcccaatacaggagacgcagcaccttgctttttgtgattgcggccaaacgagatagatttccgagatgaggctggatccgttagaaagaggactccgagagcttttcatcaagtactcacgggccgaaaacggaggtcgtatgcagattcggtagccgtttgaagtcagcagtgtagtaggtggccgaatcggattccagcacttggagtacttgatctcgatatcttcttgttcatccatgatgtgagcaatggttgcatccgtggtagccatggtcacatcacaattcctttgaaattcctatggaatgaactttactagagcaactttggaggaaaataagcatgaggtctcacctcatgttttcctcttcaggcccctttgaatcaaaggatttatgtaggaatttcataggattcaaatactataggaaatttttctatttggccctttgattcaaaggattgaagctttccaaatcctatgaaattcctatgaaatgacacattgcatgtggattttggaggaaatttagcaagagctccaacctcttggaaaatttcctttaggtctatctctctcatccgattcctgcgtttttcttgtgctccaatcaaacgatcattcctgtgtttttcctgtattttacaatcctctgttttatacttcaattcctgtcagaatactgtgttttttctattcctccgttttttctaccctacgattcaaaggggcatgtgtctaagattcctgcgtttttcctgtgtgctaatcaaacgacacttggagactttcctgtgttttaaaatcccataggaatccaataagtttggtatttaattcctatgtttttcctatttctctgatttctcaatcctgcgattcaaagggctcttaatatctgtagcattactgctattgattagcattactctgtttttgtactcggggatgctccgttcgtgtattggtgttgccaaaggaagcggagaggaaatgggctccatgacgggcagaaggctgcagagaagggaaaagaggaagcagagaaggggctctccctttctcgcctgcgaacaacacattgccgctgcctcgacctcgaggctggttgattttgactaatactccagtcgttaggcccgatgtgatacctctgtgtaattatgtgcattaggatctaatccctatatcatttatttatcatcacggcaccacactttgtcccccttcttaagccgatttactggcgccctcttagtttagaccataagccgagaaatcaaaaccaacagataatttttttttgtttggcttttataaagctataagtcactcttagactgtgcagcaagggatgggaagtaatccctcccgcacagaaaacgaagtggtccatagcgtgtgattaattaattattatcttttttttaaaaaaaagatcaatatgattttttaagcaacttttgtatagatttttttttcaataaacacaccatttaacaatttgaaaagcgtacgcgtgaaaaataaagagagtgggttcccaactctaggtgcagaagacaaccttacactgttaagaaaaagttaggttgaagtagtttttttttcttatgtgaaatggagataagattttaccattaaacttaaggcttaaaattcattagcttattaaaaaaagacaaaaagtcatcttaaaagcctaaccctaaacaaagaggatatgttctttaagctaaccttttagcttttatcgttcttttttgcttttataattaataattaagcttgtgccctttcttctaaggaaattctgtggctttcaagtctcgagtgtaaggtgaagtcctatccctaattcacaaaattaaaagtaatactcgaacctagatttaatttaggcttaacatggctaaaaaaagattagagtaaatttcacaaaactacatatactttgatcaaactatcataaaactacatatttaagaatgtatttcacaaaactacagatttagagtcaaatatatcacggaactacatatttaaggtattatatcacaaaactattgattcaacaactattttatcacaaaactacacatttaaaaactaatttatcacaaaactacagattttataactttaaataaataatagtgctatgatctaaactctagaatatgtagttctttgataacttcatcattaaatctgtagtcttgtggtatggtgcattaaatctgtaggtagttctgtgaaatgtttgacgctaaatctgtagttttgtgatacacatttttaaatctgtagttttgtgataattggacccaagtatatgtagttttgttaaatttactcaaaagattacaacgaacaaactgactatttgttggggcttaaactttttcgtttagctcatgagcccaaaaaaagggcccatcaaatacggctgttgattttaatagtgcaggagtggtttatagctttgaatataacgaaccaaaatgttgatacaacacgtccaacattacccttaaagtccaattcatgtttcatgccaggttcgtcgtgccgattcctgaagttctcgatctggtgcgttgtgctcgagctcggcctagccaccgtggcccctctccctcccggctctccctcgcgtgcgactcatcggttcccttccttcccttacatcgtcacgccaccgtcgacccagccgttttcttctcatctattgccgatgatgatgcgttgggagaaggcgagaggctaactggagtgcgcaacactcaatccaggggatggagccttgctcgaacggggaacgctcaacctcgactgcgactacgcgagcggtcgattcagcgactcggcgcagcggagcagtgaagcaaaggttcgaggtggcggcgtgcagctctgcaaatggtgcacacatttgcctgtgatgccgtgcctccagcgttgacgataatcccatggcacggtgagggcttgaggtcgatagggcacagttttgctactgggaaagatgattgtggtgttatggtgtagcaagggccagatattcatctccttaatgctggatcgactcatgatctggcctcctgttctctgtccgctgctggcatgccagttacttgcagcctcttctctcttatcagttactggctgtggtcacccctggtactaattgctcgcgaccatctcagccgctaatttcagtttgttagctctgctgactatcggtacggttttgcatccatattgcaagtacaaggaatttcatacgcccctcctgctctgctgagggatcctggcattctgcatttcggtgcagtagtgggatttgagcaatgggaagtgaattaattgttgtttactcttttacttattacacagttattttgtgggtttatattttgcttctttcaaatgaagaatctcttaagtttatgacaaagctagaaactcatgtaagtttcaattttgcaaatgattgtgtgatgaagttcacttggttagttaagatgtacctactgaaggttccatatcatatcccacaagtttgaatgctcatttatactatatgtgttacttgctaaaccatttgtacatttggaaccttacatcccaaaattctttgtttctatttagacatgaacactctttagtttgttgtcaaatcaagtttgcctgataaatgtaacattggtatcggcaagtaaaaaaaagtttgaaactattttaggaggaagttatcctataaatgactttttgcttcattaacataagcagatctttcttggtatctatgcttctaggttcatagtctgtgcaacatataagattctacattgaaacctaattagctcatttctatatagacttgtatatattgtcaccttctattttaagttggataagttaccaatttacaattgattctggactttacctttcaggattcaagctctatttctgagttagaattcaagttgtgtaactatttctgttagaatgaagacatcgagaacacgtttactaatataaatacgctgtaatttaaaatgctcataaaatacatcgattaacctccatgactatctttgtacttaactaactctaaatgggatattaaaaggtcatgatgatttgatctacttttcctcaaggtttgaatgacattgaagttatatataattacagatatgataacatggcatatataatctcattagagctttctaaaacatgccaaatgtttgctgaaatcgtctgcgatattcatgttttgcctacttccctgttggcaatgtgattttcgttgtccagactactcctcaagttccacaagaaatgtgcttcgctttagatgctcttagcagctcttgcatgatcctattatttgctctgtttaaagtactatttaatgttcccctattactagggatgcaggtgggtcgggtaagcccactgacccagcgacccaacccgcgatttatggggccaaaatcatgtgggtcgacccacaaaaattcatgggccaacgtgcgtcgggtcactgtgacccagcaacatagatgggtcgacccatggaattgagtaactagagagtcgctggcttgtagatgcgccgccgtcgccccgctgctgcggcgctccgtccacgccaccatcggccatcgcctacacgcgctccgcctctcgccgtccaccgcctctgcgacaagcctgtaggcagcatgcccttccacgatccatcttctagctgctcctcgtatccctcctcttctccaaagtttaagaaacaaaggggatcgattatctcgatgggttaatcgtcatctgccattcatagttgtgatagcacccatggcaagcctccaggccagcgatgatgtgacgctgtgcgatttccttccgtctaatccatgttgaaactgaacaagatcttgccaagttgccatctaggtcgattcaatgccgcagatggttttcagcatatatatagcatgatgtctaagttcaagctgctgctgttgcttcttcttacttgctttacatatgatcgaaattgcatgcttgattaattagttggcaactgcttccttcattcgattaatttctagctagttcctatgttttgtgctctgcttgctattacgcaaccctcctgctacacgaagcagtacaagagggtcccgtaatgtctataagaattggagacacagagatgtaggggtaagactcttttcctttattcattcacttatgtaatacaatagcacctcctcccctctatatataggcatagccatgagtactttccatatttagtgatggacccaattagtgggcaaccgggctggaccttcatgggccggcggtttcctaacactcccccttgggctctcactgcgtgatgcctatgtctcatcaaaactccacaaaaacccagtgggaaaaatttggagaaagagtacatagcatatgcttgcaacgtcacatgaattgcctcattaaaaaccttgataagaaactgttaggaaaacttatccaagggaaaaagagtacagttcacccaattcttcgttcaatctttctagattgattctaggtacttgaatttctatatcaagattctgaatgagttagcgaaattccccccctgaattttctattcctctaagtctcactattccgatttctcggacacacatattcaagagaagatgtcaataatgagttagtggacaaatctataagacttccacataacttagttcactgcttctatgaaattcatgcgcatagaagagcttggggttcatgtgcttagtgagtttgtttctcacgtaactcattcgcatatatgcaacatatgctgcttttagtttcataagtagtgggggttgagatagtttccaagtcgcgattgctgtcgtgggtaaccatctctcaaaaccatgccgaagctctgaaccgttcaacgatgtttaattcggtttagttcaattagccaagtatttgtgtgctgctatgacacacttgtgtttgggaattccgtcccattttggcgataattgactaatccaaagctatgcaccatgaacatttctaagtgcggttggactgatgtactagacttccatctgtcgcatgcttttagctacaagcgtgagcatgatttgggttcggccaaatatttcaaaattaaactcaaattcaaaacgaacgagtttgcttcttcgattattttttggtttattctttctatgttggttcgggacctagtacttcttcatgtactattatgcaagtgtccgatccaagctcctgaattgcattcattgattctatcttcaatgctcatcaatatttaggttgagttcttcctttcaacttccagttcactaattccattcaactctaagttgactgccaatgagttttgttgtctaaaagagataaaagagacattgcccatgataggtctcattgccaatttctattggttgcatgagactttatgcgagtatccatgaatttatgaggagatgcatttttcatatgcttcttcttcttcttgcttgcttaatacttcttgatgtgggcatgtaccagcgttagcgtgcactccaacagctggttttcttccttgatgggaagttacggtacgcctattctgaggttccgtaccgtttgccagatctcaattggctccccttctattcggtggggtactttttgtgactttgagtatgatagtctctcttgccctattttcaccagacgtctccggttactttaggggtgtgaggagccgaagtttcttgtccaattctttttgttcgaggcctctagacaagatgaggggtacctttactttcttcggtatcaccctcctccggtgcatttcattcatgcaacttagtcaaactcttcgaaatcacaaaagtatttacaaagtgatttggcagttttaattctttatgtaaactgcattcactagtgcggtgtaacatgcattaatcccgaactatcacatttcctgacatttcctatctaggggttcattctctccccctaaatgactggaaataatacttatttgtcaaggaatttaggcttcagaactatctccgtaaaatgttttcgactttcggagagagccttttgcaacgcattatgatattgagatatgcacataaaccaaacagatgcaatagcactagttgcaggatgaatgttcatgccgatggtctgaattttctttcagaatccgctgctttcaggactacatgtccttttctactgcgggtattacaacaatgatattgcaatttatagcttatacttagtccgcctatgcggatatttggtacttcgtgctgccaattcaccaatcatcaaatgtaatgctagcattgtccttgcggacttctgaggatgatttggtgagttctattggagttcacgtgatcttgctggatcagtcttggcaaagacacggtgtctatgagacactggatgtttgctgcttcggaagcgcatatatccatacagtaccaaacgggagccgcagatattcctcgcaatccagttcaggaatgctagaactatatgcggtttatgcactaatctcctgtcggtgcatactggcacacaaatcttcatgatttgggaaaattatgcatatatgtgctataaccatatgagttgtaatatttattcttataattctaagaccgaaaatggctgaaaatccattgctaaaagggtgtagcccaaatcgtcacacttttagaaagttcaacggggttgacggacaatagatgcttctataaagtgcatcatttgttccatagggaatatgaccatggcactttctaggccgacaaattcagttgttgctgctagcaacggtcataatatttccagttctatgggtctggaaatactctttctcttaaagtgttatttgtggttatgcagaccacaattcattgtttttctcttttatgtttggacgctacacaaaattcaaagcattataactatgtgctagaaaggagcgacaaaatagtaaatgccttaaatatgctattttatactggaaataattctctattgcagggaaaatgtgtgctctacttgggcaaggatcatttttcgatgcaatgctctattgaaaaattgcaacaagtgatgacgaagtatattgattcaacgaggtatcctggtacttcggattcaattaacttcatagtgagcttcttgctcgacagctatggcaattatttactatcctgacatcaattttagggccgatccgatatagcataggagattctttgtccatagccatgcaaataggctaggagctctccccctcaattcatgatgagtgttctattaggattgttcttttctttaaatgttcatagttctagattgtttcaccttgacctgtgttctacccctcccctctttcctcttctttcgttgaggtaagtgtaccaggctagctgctcgtgttgtattcgttatcaactgtgctagttggttttggaagacaatgctcttctagtgagcactgtcatgaacattacgcaattccatttatcaactagttaggcatacttcttgtgtgtgcaccagtaatgcttgcgtgcgactttcgtcacgttcgggtagaacatcaagagtttccgcagtattcggtgcaccgtattaccgtactctttgggtcatctgctcagtgaatcatagtcgaaaatgcccactcttgctcatagtccttgctctacgagagatagggtttgcaccataatcttctgagctgcttcttttgtgcagtcaaaagagtacccacacgcttatccatctagcatactcattccatagagcagcttggaggcaccgatgagagattgaagtgcttgatcaatctcgtcgaatcagtaaaataaaacgctaggtttaatgatgtcatggagctgcaaggtccattataatttcgacactgagtgtatatgtcagggatccggcgaacttctagttcgcgatgccagtcatctttggtcaaaaatatgcgcaaattaaatgcaggtaaaatgcacaagtgttgcaatagaatggtacacaaaattcccgcaaataattccagtatatactatgcaattctatacattttatcgcaacgatattaattaaaagtaataaaagcatcacaaataatcaataatcgtaaatgcgataaatttcacaatcatatatatcagcaataaagatacctgtaatgcaaagtcggggtcgaaatccaatgtccatgtctcttttatgcgataatatgattttcggtgatatttgcaaatttcgtaggccttgaggtaaggaaatccctatgcagaagggtaaatgtgtgtttcctcaagttcagggggtttaagtgcaaggtttccaatgcagagaaacatgcacttgatttctgggaaacacaagagccattttgcaaaaccaccggagatcctttcttttttttcttttctttccccttttttttttctttccttaatcttgcttatcctttccttctcttctcccgttgaccatgcaggtgccatgtgtggcacggggctagacggcgct

SEQ ID NO: 7075 - DNA, 1185 bp, Oryza sativa
aaaaggattcaagagtttcttgcctttcttctttctcggtctccggaagaacgtcgtgctaataacgtattacgcaaccctcctgctacacgaagcagtctaaggggtcccgtaatgtctacaagaattggggacacagagatgtaagggtaggactcttttccttcattcattcacttatgtaacacaatagcacctcctcccctctatatataggcatagccatgagtactttccatatttagtgatgggtccaattagtgggtaaccgggccagaccttcatgggtcggcggtttcctaacacttgctacttgctggagggtcccgtaatatctacaagaattggagacacagtgatgtaagggtaggactcttttccttcattcattcacttatgtaatacaatagtacctcctcccctctatatataggcatagccatgagtactttccatatttagtgatggacccaattagtgggtaaccgggccggactttcatgggccggcggtttcctaacactcgctacttgctggctgattgggggaacaatgataaattcttttcaatttatttcctgaattttcggtgatgttgatcctttactcacctatgaatttttttggttgacgtctatttgtgttaatctggtgagctttgagctctgttgtggttcgttactcacctctgatctgtatatgacgtgtgcgtactagctattgcatcttcggtgagagggcaaagagaaaactaatgctggtccacggtgatgggtcgcccatggaaggctcatggatcggcgggccaaccgtgttgtgtgggtcggtgtgacccgtgacccacagataaccagcttgggtatattgggtcagacactggtggagaaatcatctttggtcggtccggcaaaatacacaatagtcccggatccaaaaagaaccgggatctttagtcccggttcatcccttgtcagatgtatgtcagggggccgagaatctttagtcccggttgatgttaataaccgggactaaagattaccactttagtcccgattggtaacctgttggtaatacgaaccgggactaaaattaaacacgtagtatataatccctatcactgtcctctcattcacagtgacagatcgaatctcaccccctctcctcagatctatcctctctaactct

SEQ ID NO: 7076 - DNA, 5018 bp, Oryza sativa
cactgagatgtatttgactgagaagttacaaatttgtgattcattgtttggatctgtgatgtatttgagtaatttcttaggatattgtgatgtatttgatttgtgtgtacaagtaactttatgatttgtgttgtggatttggtgatatgaatttgggatgttagtttgatttggggattgatttggggatttgcctacttgattcgggagaaaataaaaaggaaaaaagaaaaagaaaaagggatcagctgtactgcccgctattgtcaccaaccgggactaaagatcccagtcccggttggtaccaccaaccgggactaaagatacatctttagtcctggttatttcaaccgggactaaagatgtcctctttagtcccggatccttactcccggttggaaaaccgggattaaagggtgttcccaactgggagtaaagatggtttctccaccagtgagacctcgggtcaacccggcccgacccacctgcatccctacctattaccatccataacatggcattaattaagacacaaatcaaaacttggaaaatctttttttagttggattatatttagcaaccgcagaagtcaaaatcacaattcagaacatggaaacttctctctgtttttttttttggcttgggattcaagcatagattagtctgaaaacgttctttgtgagctggtatgattgagggagcatctagcagtggattttaactgataattccgtggctcgatgtaatcaaataggtttagtgagtgctgtacatttttaatgtgtatgcgtcctctatgctccattcagctaaatgtgcattgtaccttcatctgatatgatttattctcttggaaggtattgttatgaatgcagataagtggaaccttctttaaagagtaattagtgcaaccctattataaacgtcaaatctgatgactccttttgtcttattcatgcaaaaaggattggttgctaccatatatggtgctcaggtatgtcaaaactataggtgtatatttcttcctaatatgtggagtagatttttggctatctagcaaccttgtggctatgctttctcatgttatgctatactaagcagagtttaagatgtatcactttatacccactttgaaaatttgtaaacttgatgtcagtccttgcctcttaaattaagggataagaggaagaaatcagggccgactgttatttttgtttaccaatttttcctgtatctgcaagtggaaaagcatttcactgtcttttcagagttcatgaaagaactggctatctaaattgttgtggtatctgaacttattaggtgatttttttttaatcttgtagtattcagggtttatttctgatcatcatgtaacatcgaaattcaacttatgtagcagcccgtgctagaatgaagtcctttcaaacttaacatttatcaatataagtacatatacatgttctgacttgtgatacttttgaccaataaagtaattattaaatctatcgattaaccactattactatgtttggatttatatgattctgaatgctgtcatgacatggtttgatttttcttcaggcttggattatagcgttgttacatagatatgacagtgcaatttatatttttgcctatttcgttggtatcatttgctctgctttaggttctcctcaacattcaattatacccgttcctgatttacattgctctcaacaaatggtagggcgcagcgaagcgcgcctaaagttctagtttatttagtgagtagagaaaatattgtggtccacaccaccggagagccttatctctctcgtagggatggcaattgtgcccgtttgcccgtttacccgcgggtaaaaaccctattagggttgggtttgttctccattttatacccatgggtatcttattgggtcaaaagctatgcccgatgggtaaataggcatgggtatgggtaatcactacccatgtccgctttgcccgtttacccgcgaaatctaacttacatgtaggctaggagcaaaatccactagaatacataagccaggttctttgttttctacggtttctcttttatttcccttattatttctctcctcttactctatcgccgccagaggagagacacgacaccgaggcggagaatatttgatattttaagttcgattcgaatttagtagcttgtagactttttgttccactgcttttcttgtggcgggtaaacgggcacgcccccgagcataagacacccgcgggcaatgggcatgggcaaccatccttacccgtcatgtagtaatgggtatacccacgggcacaaataatctcacgggcatgggtatgggtaggcactacccgtgcccgtcgcgcccgattgccatccctactctctcgttgtctcgtttactctctctctctcctgcctttatccatctctctgtgtcgccggcgagatccaccgcacctctctcctgtctttctccgactctctctatgtcccggccagatccaccatggctccacgccgtcgttgctgctgccgttgatccgtcctctctctccttgttgctgctggatggtgcttcctcgatggcgcagttcagtgacaagccgattggagcaacctcgctcctcctcatttggatccagccaccggcacggccacatcaccggttcctctgccgctctatctcctccatctccctgtgctcgcccttcccaacgagggcacggcgactcgaagtgacggcggcggcgactcagtcttctcctcctgccatcggcaactacctcaacgggcaatgacgggcgacctggccgatagaaccatcggcgtcgaggtcgggggacgctagatctagtcacctccgacctccatggtgacgtgctgatctctactctactttcccccggtggcttggccggtggatccatcagtgtgtaggtcagagacgggcggatctgggaggtgagatggtgacgccgccccctctcgttcatccttccacaccaaaagcaggagcagtatctggtaatgataatgaattactcttgtgattttttgatgttaattcatgattttttttctttttatattgaggatttgcatgtgttgttcatatggtaaaataaggatatggagattattgtttgttgttcatatattcatcttcaatttggggatttggggcattgtattggggaatctggggctttcaaagactcaatgaacaaaatcgatttatctttctcgctgggttttctacccgattggattttatatccatctttgaatttgtgctttatctgtcttacaggatgtgttacgggagcgtgtgggaaaagaggccatagctcaatcggacttgcagacgagaattggtgtgacgaacggaaagttatcaattttttaagtagttaagataatatttataatcgtacttactattgtatgtacggagtacttatgtacatacggagttctttttccagcccataggaaggtactaatttttagaaatagtatatctaatctaatggtctaaaatattgggtccactgatttaagtgaaaatcgacggtgagagtggacagtgtcatgtggtgttatagaagtatttataggaacgccacgtgacggtttaagagcgtttgtagaaagtttaatagatttttagatagatagatagatagatagatagatagatagatagaaatgatggactcatacgtgccacttgtttagaataactgatacaaatatatatcatatatgctgctttgtaattagtaaccatggactatatagttatatggatgaggagtttggaactggaaccagcttatacattcaacttgagagcatgtatacctaatataagtagtacttacgtacgtacaacaattatgtatttcaaatatcgattaggtactacgagttcggaagagagtatgccgaccaaaagaactatttagtcgggctctgaggctgcgatggctctggcatgacttgacgtactctgacaaaccgtggcagggatcaaacctcccatgtgatgaaacagacaagcaactcttcagggcctccactatcatcatcttaggaaatggaggcaaggtcaaattcttgcatgacaggtggctcgagggcaaagcaccaaaagatacagccccatctttattccagattgcatccaggaaaaatagaatggtcgctaaagaactcgccgacaaccgctggcttcgtcagatgcggagaatgaacactacggtccaagtcagagagttcatcgctctctggcaactcatccattagattcacttacagaatggcgtagaggactcactttcatagagatggaccacgaatggctgctactcagctagctctgcttacaggatccaattcctagggggcatccaggacagcagatcaaacttcttctggaaagccaagacagaaaacaaatgcaaattcttcggatggctcatgattcacatgaaaatcctcacggctgataaactacagctacgggggtgggataacagtgagatttgccccctttgcggcattgaaccagagacggcatttatgcttgctcctgcttgttgctgttctcacttcgtaaagattgggtgctcttccttcgggctgtgagtccctagcgactcctctttgtggcccgtatgtaaattgacccttttctgctccttcttatatgcaattggtagagccccagacgttttcccctcgaaaaaaagaatagtacggagtactagataagaaaaagataagggagacgaatgacaccttttttttttaaaaaaaaacgatggattaaaacctgacgtctacctccaaacatagtaaaaaaagccggaccggtaagtgacccggccgacctctcggttcagcggtccgccggtccgaccggtgacccgggcggtcgaaccgcggttcacaaagtacatgtatattacatattcactcatatacacatgtcgttggatgccctgat

SEQ ID NO: 7077 - DNA, 17085 bp, Oryza sativa
atgggagggggcacggggaggggagccatgggaggggtccccgcaggggcctgtggcatgtagttctccatggaggagagctcgcgcgaaggcagatggtggccaccggcgagagctgatggtgatggagggaggaagaagatgagaggagggtaatttggtccgagatagtattttagcgtgtaaccatgtgttgaaagtggcattttaacgaagcccactcccagcatggcatttgggcgaaacccactttttgaggatggcacaatgtcaattttctccctccaaacgggatatatatgtgtggcggccaacaaacggatggcacacgcaaaatctcctggatatatatggccaggaaacacaatcacgaattcacgatctggaaactgggagtgttggtggctcgatcttgctccagcagtgtatagcttcaaactaaagcagggtttctcagatgctccgccagttgctgccgccaagactccatgagtgcgtcgtcaaaggtacccagaacccgcacttggttgagggaaactggatgctttagcccagaaagctgcagtaacgacccatcatggcagtggatcttcagcagctctagcttctgcattgcttcttcgtcaaatattacatgtaagttggacctgcaaacaatctcaaggtgctgaagtttgctgaaaagatgagcccgaaattggaggacaccatcttgattctgcttgacatgaaggcgtagagttcgcagacttgatacgctcccgaggagcagtacgttctgtgtgaatagtgtagtattcatctctaggcacaacttccttaggttcctaagatttttgaacctccgagccgataacatctccacatgcccatacagcttaaggctccgcacgctggaaggaggggagatgtcatcccaacaaacaacatgtttctccttgtccagctgcagtgacaaggattccaagttcttgtgattgatgatggcatggcacagatgtttgctgtttttccggttgatgcctgacacttcgagcttcctcatctgtttaagacggtagatgtcagccagaatggcctgtccgcttgaagaattgatgtggacggcaccaagcgtgtgcagggccttcaggtgatggatcccgtctctaggcatcttgacgccttgacaaggtccaacaggtccaccacgtctcaggaacttgggcaagtaggacgacgccacactagcgcatgagctgatactcgatgcctcgtaagccaagcctttaccaccatccatccatggcgccgtggtgcctgcacgaatgtactgcagctcatgtagcgtctgcagcgcaatgtagacaactgaggtgtgcctgatatccagagtctggagatacttgaggccagacaaggaatccgggagatgagtgatttctcggtgccctctcagtgagagaaacctgaggcgaggaagcagctccaagatccgcttgagttcatcgtcaccaaaaccaacatgagtagtgccctctagatccagcacccggaccgatttcatcttgtaagggacgaagagggacttccaagctccgtatactgtcaaagactggagatgcgacacgtccaggtcctcgtagtacacatactcctcgtctcttttccagctgctcccaatgactaggtgttgtcccatgacttccgtggttaggctgcgactcccatccaacacagagactaccaatggaaagaaaaccactctctcttccatgagtcgtgagttgatgtactcatggaagaagctattgaaccgccactcgggcattgtatctgtctccttggcaagcctgtcgaagagctcgcccgtgtaatcctccatggttttgctgtcagtgcacttggagtagccctccgcgatccaccgccgcacaaaatggctccgccggattctcttcacttggaacactgccagatacaggatgcatggcttgatggagtgcggtaaagcctcaaaactaaaatgcatccagctgaacagatcccgcaagctaacaaactcggggttggtctccagctcgtgcataaagttgtctttaagatggctcaacttcctttgccgtatgtcctcttgctcggaggccacatatctagctaaagccattattacttctggaattccaccgcacttggctaagatatattttgcttcctccagcgtgtgtgcatcccttaatgttccaacccctcgaaattcctgttttacaataatttaaaagctatcagaagatatttttgtgatgttaaagtaagaaacgtataaaaattttgctatatatttgtcgataaatttttttctaaaaatttaacaggtataaatatagtacaatctgttaacatcgaaatttggcaaaatagactcggatttggagttagatatcgaagcggaatcaaaggagattaaatcttgccaaaacagattgcgcatcggctagcagtatatcggctgaaaacagagtcggaatctaattgagccgatatggcaagtagccgatacggcttgacttaggctcggtttgggctacgattgagattaaccgttattgccatttagagaaaaagctcgtttaaggcaattgtatctattaattaggatatttatgtcggtttgagttagagatgtggtaagagtccgccatgtggacttgtttgtattttatctttaggaaagttttgagtcgtgtctataatcggcaagttttgtactcgggatataaatataaacccctgaccattgtcatgcaggagacaatcaaatcaatacaactttcggcacgttgccacccttttcttttactttttgttgagttcttgcttaatgccggggcatcggctgcgatctctcgacaagaggtaatttgtctcgatgtcttgcgctatcggggctattatgtcgatttagatttattagtccttttaccgtggccattgctattacgtatcttagttaatccagtctcagcatctcaatttagtcttatccatcgatttccgctttagggtttatgccggtatcagctaaattgttttactatattagagctaaggtatctaccattcttaaaagtggttaattccttaattatttagactttatgtttctttgcatactttgtgatgcatcctctctagccatttttagaatcataaaaactaacctgaaattaatcataattaagtacagtattagggtttcagccgatcttatctaatatacatgatagcgcatgtttcatgatatgtttatgtatatttgccacttatatagataggttgctttatataaatacatcaagctagattgatctctcttaagtttcatatctagtgatcgattgctttttgatatgtttatatagattagtttattaggataagtttgtattggagtattagctaatacattatctatatttgctctaaatactgatctatcggctatttctttaatactgtcctaaaatgattgatgcaaacctaagagatagtattatagctgatagggcatgtttagggttttgctttggattgactatcataaagccgcagccgattaggtttacccatattggccctatcggctatcgttaatctaattatgttttctctttcttgttgattgcaagatcaaaccagctggcacacttttgacacttgaggcaagccttggacttgcactggagttagcaaatctcttaggctgtcgtgttttccgtcaacacaatcgtagtgtaactacaatgtatcttgaatataacttttacatagttttgaacaattagatttgtttaaagaatcgtgtaagtgagatagcgaggaaggaaaaaaatctcacaacacacatacatgtgggggattcggttccatgatatacgttttatgaaaaagacatgttatgaagggatgtataaaagttatatacaagttacgatgtaattacatcacgtttgtattataattatatttgttagaatttttaaaagtacatttgacgacaaatgtgtagacagtcccaacagataacacaaacactcaagattggggatgtcaatggttctttagaatatttccatatggtcattcagtaatgacatgccaagtcataccatatattgacggtagatgggtatatagttggccatatgggctgccctgcacggcacggcccaggcccggtcatgcctgggccaagacatgtcgggccgtgccgggccatgtcgtgccggcccacgtgctccacctgtggcccaggcacagcctaataagggtcaggccatgctaggccagcacgaaggcacaggcagcccatcgtgctttcatagaaataagtctattccccctccctcctttttgtgttgtgacatatataaagctaaaataagtctatttacgtccctattctttggaccatgccatataatacgtctatttgtcctccctatttttttgccctgacttacatatggttgaaaataagtctatttcacgtccctgaagttcgtgctgtgccgggccaccccaacagtctgatgggggtatagctagttgataaactcttcctcttcctattatttattttaatctgaatttaaaatatttctaaattgtactcttacatgaaatcttttctccattatatttactcttctatatgaattttaagtatttctaaatagtatttctacaaggaccctttctcttaatattaatactatttattgttaatttgaattatatattttctattgcatttctacatgaacttttatctcaatgttgatttttttaaagcgaagttaaattattgttttctaagttgtatttctatatggacttcattttatttttttatttttctctgaatttcaggtatttaaattatatgtctacttcaaatgttttttattaatgcgagaaatttttaggtcgtgagagcgaacatggtggttcattttctgttactttattaagttattaatagacattacttttagtagtatagtactctatgtgtttcaaacgataagtcgtttctcttttttcttagtcaaactttttctggtttgatcaagtttatagaaaaattagtaatatctataaacgaaattagtttcattaaatttaacattaaatatgttttgataatatgtttgttttgtgatattactatatttttctgcaaacttgatcaaacttaaaataaaattaactaaaaaaatcaaaacaattataatattaaattatgcaatatggagggagaactttctttgtcagcacgtattgtgtgctatggacaaatatttggcgtgcctcaccgggagaattatatagggtgtcacttagggtgtataaaaaaactaattacagaatctgtcagtaaaccgcgagacgaatttattaagcctaattaatttatcattagtgaatgtttactatagcaccacattatcaaatcgtagagcaattagtcttaaaagattcgtctcgcaaattagtcgcaatctgtgtaattagttattttttagtctatatttaataatttatgtaggtgtttaaatgttcgatgtgacatcgcgaaaaattttaagatgggatctaaacatgccacagtgtaaaaggagtaattaatgagtagggggtcacacacctgtttgaaaatctcgagggctgcctcagatcctagagcgttgactctgtgtactgcggcatcgtcttgcacggcacaatatttggcgacgttttcttctgcagtaacgacaaggatgcaacacttagaggatccatcaatcaacgactttatcgagtcccactgttccctggaccgcaggccatcgatcactataaggcatcgagaattctgcagaaactctctacactcttggatgatattttcctctggttttggattcatgggcatgtacgcatactctccttgtgattgttcgaacatatacgagtgcattcttcgacagaagtcgctaaaattgaatggataggacacatcgacccagccataccaatcaaatggggatgtcggattactcgcttggcgtcgcctgacggttcttactagaaccgatttcccaagaccaggaaaaccccatacagagatcacatgagatctgtcgctatggcgtgctgaagaaatcaggttagagagtttctcctcatccgagctgcacccaacaaggtgaacttcgttggacatttccaataaggaaggtccaccagccaccatgccaacttcgacacgttcaaaagcctacaaattaataaggatagagagtgatcaattgcatgcttgatccatgagagaataaccaatcatgctcgaatttacggctcacacttgcttggttatttcaacacggaattccttacggtacaatgattctacactaaaattcagcacaacaaacattgaattattagtacgatatatccaaatatatggaacatgcataacgaattggccttctgacatttaggaattaaaatttgtataatgttttgagccccactatggtgcggaaactcttttaatcacccggatgaacatccacctgtttattccatattaactaaatggttatgaaaagaattggcaagatagatcaatatgtaatatatcactccacgaacgtgtaggttaaattcaacttctacaaattgtagcaaagatccatcttccactacggtgttctctactagtagtagaaagtaatttgaactgttgatttaatttgatcaaagggtttaaatttatttatattaacacccaagttaacggtagtagaaatgttgaaggggtattattgaaaaaaaaaaggtacggagcggtataatcatcatttagcattgactaaaccttttttcttctattttggatttttcccatggaatatgagcaatgccagcgcaatggataatcatagatagatttagccaaaaaaaacataaataacagttactcctaatcgtattatttgtaaattactaatttaccctaataatactgctagtatatataatactactagtagagagcactggagtaacgctccatctacaactgggaatcttactctagagtttagatgtgtgtagaaaaaggccgttgcattgtacctcgtggaaaaagacacagatggagtcattgtctgataatttcttgagctccaatacttggtagtgttgccccgcgcacaatctggcaatctcgagttgctgtgtagacacgactatacggctcccatgcttaccgtctggtagatatgtccggacggcgtgccactctgccatgttggacaggtcttctaggacgatcaggtatttatgcttgttgagttccttcacaaactccttcacgagattggtgccttgggccgcgtccatccccgtcagaacatcgataccggtgatttctccttgttgttctttccatgtgtttcgatagaactgatgccccaagcttcggatgaactcctgggggttgaagggatgtgctagcttcaaccaggcacgagctctgaacttttggcatatttctggcttttcgtaggcctccttgatgacggatgtcatcccaccaagaccgcctccggttccccacagtgatatcactcgaagggcatcactgttctcggtgaccagcatggtgagatcaacgaagcctggctgcttcttcgcgttgcaccatgcctcggtgaggacgcccactgccgatgtgccgacggcagaggcggcggacgccaagtgtcgcggcatggcggcgggcttggagccggagtcgttgatgaggctgtagcgtatgttccgattgctgacctcctcgacccgggccttgagcagctcaatctcggcaacggcttggtccagtggcgatgctgcttccgacttgcagctgcacgatgccagcaagcggagacacatggtccagaacgacctatttgtgtccaggaggaggatggatttgatgcagtcctcggcgtcataagacagatcacggacctggctgacccacgtcctcaccacattgttcttgatccgttcccaatcggcggtcttgaggaaggactgcatcatctcgaactcatccttcatgaacacagtatcacgttgcacgatctgccacagctcctcttcctccttgatggtgctcttgaccttgtttacaagtgcctcaaccatcgtcttggagatcccaatggcaaggtctgccattgctctctgcctctctctgtctctcaagttttgttcgttggtgtggtggaagctgaggattgtgatccaacccagcaattggagtaggattataaagagaagattggctaagcaacagctagcttagatttgttttttttttttaaaaaaagacttgactgacttgtggttaggcttggggtcctaatgtataacaaacaaatttatgttttagacttacactctttaaattttgccaattgcccttaagctaatgaatcgtatagaaggacgagatggcacctcattaattcatagcaatacagcaagcacatgcaataacttaatgaggcagcagggacaaactgattgcacatgctgtcacatgggggtaggtaatatggcaatttcacagaaatacacaattacactctacgaccgcttaaacaaactggaagagtacatttgattgcagtgatattggggccaggaatggacttgcaattcggatcctctgctgtggaggagaaaattcagaggtagctacagtgcccggcattagaagaactgtgaagcgtccgatagaagatggatggatcagatgagacgttacagtaaatctgctacagtactaaacagcggtgctacagtacattcatccccgtagctacagtaaagcgcgactgtgctgtgcattagaacactgttccctcacatattactgtagctaaaagtgaccctctgcattactgcagaggatccgaatccatggacttggagaggtgtgtggcactggaaaattcaaataaatacccagcgtagacttgggaacgaaagcttaggtaccggctagccgcctccattggcaatttggcagcagcgataaatccagcgttgtccgcatacagaattattgcactaaacatcatccaaggatacaactgatatttctcatccgacttgtggttcgttgacgtgttgtgcggagcatgataatagaatcaaaagagagaaattaaaccaacgagatcgagatgggtaaatgattgcaaaagacaaaatatatatcaaaacttttaagtataaaaaatgaacaaaatcgcaccaaattgaaaaagaccggcctacaacaaacccgaaataagaaaatagattgcttaaaaactacggagacttcccacaactatttacttgatctcgtaagctttttattaaaaaaataaaagaaattcgctcttgagtgcaaactagaaagagaggaaaagtataaaccctactttatatgaacatattcacggttcataacaaatttgtttacaaagtgcatccacactatttatcactaatctcatgaggtacactctctagcctctagatgagggagaaaaagtataaaccctaattttcctctctattaagcctcaataatagatcatggtaagtgtcattaatagatcatgagtgtgaaataagaattgaaaaagcatatcgtattgatcagcatcatctattatatactaaaggaaaaagtacgaattacccccctaaactataacggtcgactggattaccctcctcaacaacaaaaccagacatttaacacccttaattttctaaaccggacaaataacccccctcggtgctgtacaaggtgggtttagtcctatatggcgtccacgtggcaatgtattaatccagtcagcaacatctcaataaaatgaatattctaaaattaggtggtcccacatgtcatgctcttcccgtcttccactttcccctctcttcgtctcgtgcagcgcagacagaaagcgacggcggcggtggcgctctccagggcgggcgggggaagcggcggcgtccagggcggcgaccgcgccctccagggcggatgggggaagctacggcttccagggcgggcgggggaagcggtggcggtgacggcaccctccaggtcgggcgggggcagcggcggcgccctgcaaggcgggcgggggaagcggcagcggcgacggagccctctaggacaggtgggcaaagcggcaggggcaacggcggcggtcgctgacgccgtcgcggtcttcttccccttcgtcgggaagctcacgtacgtcctctctaccggcgacgtcgtcgttgactgctcgccatctgccgttggggacggggcgacagcgacgcgcgggcgctgtcagccgccgagaggcacgatgtcccggcgttcttgcggctcgtgcccagcctggaggcccccgagctccccacgccgttgctcgccgtgcaggtgacgcggttcgtcggcggcggggacgggggtggcgttgccgtgcaacacgccgtgccggacggccaaagcttctggcggttcatggacgagtggtctgcgccggccctcggccagccatctgccccggcgccggtgtttgaccggtcggcgatcgtgcaccccatggccgctgtcatggctcagcgcatcctccggaaggtgacaccagagctaccactggtaatctcatttttgtatgtgcgcatgtgcatttttgatgaaaattcattaagtcatctgatttttagcgtgttctacaaattttcatcgaaatttgtagctcctcaccgcgaatttgttgaggcgaacatggcaacaccacgacacgaccacgctagagctcgagcgccaccgcatcgccgatatcaagaacctcatcgtggagctcgacgaggccaccacatcccccgggcaggtgcggcgaacggcggcggcggccgcagcaacagatcggcggcgtccccccgattccccctcccatccgcgcccatcgtcggccagagccaccaaaccgtgcccgcagttgctcgcccagtgacgcccaacaccaacgtcagagaagggacagagaacaaggggttaatatgacatgtgggccctatattattttattttattttattgctgattggatttccacgtcgacgtcacgtgtatgccacgcaggaccaaaaccgttccggattgagtcaggggggtaattcgtccggtttcaatagtttgaggtttaatatgtctggttttgtggttcgggagggcaattcatactgtcgcaaaagttcaggggtgtaattcgtactttttcctatactaaaagtccattaaacttcctacaaacgctctcaaaccgccacgtggcacacctacaaacgctcctgggttgccacatggcactatctgatcttaccgtcgattttcactattagattagatttgttattaaaagaactaaagtatacgtacacatgatatatatccacacctatgtacgttaaacacaaacaaagcttacctactgttccaaaaagaagaaaaatagtacacgcgtacttacggaaagaaaaatataaagtaggaaatacatatgtgatatgtacctctaacagcaatgaaaaagatcaacgacaaaataagattttctacaattaataaaatatattgattttataaaaatcaatgatcttaaaaataatattttctaccgttaataaaatatattactttacaaatttacgtaaatatacaccgttaaactagatatataatataaatataaagtattcaatcaacactgtttaaacgttcagattattttaaaattatatatccacatagcactatctattctcaccattaattttcatctaaattggtggctccaatattatagaccattagatttattagttaaaaagtaatacattcatcatgtatccgtataaaaaatatatccgcatgtacgcattattaaagaaaccaataaaacatacctactctttgcacaagaagaaaaaaataacagacgcgtacttactaaaaaacgatagagcaaaagaatttaggcacgtctaatacgcgtgggaaaaaatcgatgggctttaaactagaatttattttctacgattaataaaatgtatttctctacaaatttagcaaatatacacagttaaactagatctataaatataaatataaaatatcgaatcaactctctttgcacgttgtcttagaaattattttaaaattatatatccacgtatctctatatagtctcaccttgattttcacttaaatattattaaaaagtaatattttcctcctatatacatatacatgagaaatatatccgcatgcaaatttaattagcttaactgctgttcacgggaagaaaaaacatatgcgtacatctaacatatacctgtggaaaataatcaacggtctttaaaattggattttctacaattgataaaatatatcaatttacacatataagcaaatatacgtagttaaactagatctataatataaatatacaatattcactcaacactctttaaacatcctatattttaaattattttaaaattatctatccaaattatgatcctgttttattttttttgttaactgtacatttgatgtttatggtcctaaagacgtcacaacacatgagaccgacatgtaataataatattatgatatgtatttaaataatttccatcatattttagggtgttaaatatcatttcacgaatataaaacactaatttaaatctacatatgtaaaaccaatcaaaacaacacaatttttttcatgcagattttcaaagtttttttttttggattttttacaactatttgattgcatttgagaagtgagcaatatagatgtgtaaatattatcaaaatattttcaaccaatgaacttgctgtgtaatagagccccttaatccatcgtgagatttatgcccatacatgtatgtattttctctgtgccaaatagttttgataacaaataaacaatcacgtaccatgtgcaattaagtacttatcatatattttgttatagttgaggaagtcctccatgtcagttattacccaaaacatgtctaaaatgaagtcaaagaatttttcaaaaatatcatcacacataaacatttataagaaaaattcaagcaaacattaaacaaggtacattaaacaaggtccattaaacttcctacgaacactctcaggccttcacgtggctcctacaaactctcctaagccatcacgtggcactgataaattagaaaaatctaagaaattccaaggaaaaaaaaggaaaacatcctaccattgattttcacttgatatggtggacccataattttacaccattagatctatgtatgttaaacaaaaatgtcacctacatccacacctctcccacctctcctcatacttacgtacacccaaattaagtacgtctccccagccctgtcttcttccttccatttatactagcaaaatttttatatataaaaacgcagtaactaaataattagaatatcttgtaatatattctattttaatttgaactatatttaccatatattggcgtgtacatatataagaaatatatcatttgacataatcccttttatatcacaactaaatagtaataaaatatttaaaaaataacatatatcatgccaacgtgaatgatctattatgtctcctgctcactttcttatccatattttctatagccagcagctcaatacgtaaacaataaaaaatgctatatattaaaagttcattaaacttcctacaaacgctctcaaactatcacatggtgttctacaaacactcctaagatgccacatgacactcaaataaactaaaaaaaatataaattacgataaaaaaatcaaaccattgatttttctttaaataggtgaacccaataattataactactacatcgcacataaataaatctggtactcccacctccacccctaccgtatgtgacacgcacgtgtgtatgtactccctccaccgtcctactctcctataggatgcaactctcatctcctattttagctaacacataatatataaaaaataatagctaaatgataatgactctcaagttacatgtacttttctcagtttatttgatttactgtgctatttataattaaatacataattcaagaaccacaatgcatatatttactatataaaagttaaataatatggttgttctgactacaaatatttgagcaaaatagcacttcgaaaacaactaatgaattcaaatatgtgagtctaatgtccaagttcaatcactaccaataaacttgaaactatcatgcatactctgggcctgaacccgacgaaggcggagctacaagacattattagcgaggtggacatcgacggcagaggcaacatcgacttccacaagttcataggcctaatagcacgttagatgattaggtgaagggcaaggactgagaggaggaccagagggagacgtgacgttccatgtcttcgatcatctctaccaccgagcctcaccacataatgtccaatacattaagagaggctcactcatgaggaggtggacaatgatccgcgaggctaatggtgaaaagcgaatcactacaaagagttcgtaattaaatttagaaaaaaaacaagcaattagattaaaatatatattaaaaaaacattaaaactaaagaaaatataacaagattccatatagaatataaaatatgaagagtccatttatacttgcataagttataaatatttgaaatttagaataataaaataagttttaaaaaaagagtccaaatacaacacgtacgagaacaagtacaatttaaaatccctagaaaagacaatttagaataagaatcacacaataactaaattaaaaatacaacaaataatttaaaaataatttttatatctttattgattcacatgcataaccaattgcatatatatgaagcaattaaagagagacctagcaggatggtaaaaaaaaaccagtttgttgagatttcttcacgaaaaataccttactttaatttcaatttgttttgttagaactattttcgaaataaactaatgtgcatgcccgcgcgaatgcgcgggctgtcttcctagttttactaatagcacttaaaaatggtttttccttcattttttcactgccaacggaaaaagaaaacgccacaaaaaatgcaccataggcacctagttgtggattgtctcgatttttactggtggaagccttaataggaccacttgtaaaaaagatcatatttttataggttgccctcttaatagaccgccagcaaaaatcactaaggccttataaaatactccagtgacacccctctccctcacccgttctcctcatactcactctcatcctctccactccttctccctcttcactctctcccctagcaatccatgggacaatggcgggatggtaacggtggccgatctccactcgtcccccctccactctctccgccaacagctccattaggcggcagccgaatagtgacgacagggcatctccaggctgcactagcaatggtgggccagccacttgatgggaacgacaacggctgccatcgatgtcgccagatctggcagcggcagacttcggggccactagcagatggcaggcctcggcggatggcgatggcaggccagcctcttgctggcaatgtcagcggttggctggcctttcaacagtggatctcgcggtcgccagatctagcggcgatagactttggggccaccggatctagcaccagcgggcctcaacagacggcgatggtgcccaatctccactcattctccccctccattctctccaccaacagctccgtgaggtagtgggctagctttgagctattgaagtgttactcttcggatgtgacggagcttggggctcctcaccgggagaccgcgcaggcccctctttgccggttcggccgggggcgctaagtgaggttcttcgccctcgatctgaggaatgtcagcgagaagaatcgcacaagacacgggcgacgtagacaggttcgggccgctgagaagcgtaataccctactcctgtgttctggtggatctgtgtgtgaaggaatacagctcgagagaaccagagagagctcaggctctagaaccaagtggccagagtccagccccctctcctaggcctgggcctcctttttatgtggtcaggggtcaccacatgggcctctagctgcctaagaaaggaaacatgctttttacaatgagggctagtctacagccggaagtgacctctgacaagcactgcacacgccttctgctccgctcgtaagctctcccggtggacgcccgtttcaaccttcattcaatggccagcgactttcttgccatgcttgcgctgaagcctagaatggatctgaccgggactgacataccaactccaggagtcagcacgccagctccggctagagacgagagctaggaaactctcatcattccgacgggacggggcgaggcgtgcgacaggccgcctgttgccacctaacccgcgatctgaccggtctgtgaccggtcacataccgcgactggtcacggaccggataagcgtgcgctgcgccgcattaaatgcggcgtggcgcgctcgtccaacccgctataaatgcggttaggtgagccccgctaggctcacctattgtaacatcctaaaaattcccaacaataaaaatcactaaaatttcgaactttttaaaactttttgcatcatgctggatgttatggttgcttttacttgccaaactataaattgtcacaatggaaaattaaactaaagttatacagctaagtaataattataataataagatatttattatgaaccccataaatatttacgcacgagaaaacaaagccagacaaagggaaggttaattagcaatttaatttatggatcaaatattaaatacttgaac

SEQ ID NO: 7078 - DNA, 4994 bp, Oryza sativa
ccccacccctctccattatttcccactccattcatttctcctctccctctttccccttctacacacgccgccgtcgtcgtgccgccgcgccgccgcgacaaagtcaccgcgccgcgccgcgacttgcgccgccgtcgccatcgttgccgccgcgccgccgaccacggtgacgccgcaccgcaccgggtgccgcgccgcgtcctgcgccgccgtcgccgtcgtcgccgccaccgccgccgccggtgagccgtctttccccccccctccacctcgcgcccaccgccgtcgccgcccgagggagaagccgaggaagaagagaaaggagccgggagggagagaagaaagggaaaaagagagagaggagagaaagaaaagaaaagggaaaagagaggagagagagaaaaagaaaagaaaaagagaggaaagaaaaaaaaaaggaaaaaggagaaaaaggaaaaggaaataaataagaaattaggaggatttaggaaataaaaatggtcggggttaatcatagattatttttgaaaattcctcgagcgtaatagtatttcggtcgaaattccgagttaataataagaatatgtgtcttgatcagattagattaaaattggtagtaatttagatataattaataactaaacaattagatgaattcttatagattattatagattatttttggtaatctctataagtcattggttcacggtagaaattcagatttaattactaggaatcttagccgtgtattatatcgtttagtcatagactaaattaaattgtataatatttctaggatttcgtccgatatttagctcgtaatagaaatttctaacctattatatggatataatgctcgggaagagtaaattaaaaacttatgacaacaaaataattatacccgcaaaatagtttaaatcgaaattgggtttgccgtagttcgcagatagtaaagttaatgaaaagaaaatcaaaaccttgactccacctgtcggtcactgtagcttgtggataaggttgtattataaataaatgaattagggacagtaccatttcgcaattattagaattaattcaaatttgaatctttacgctagcataacttattcatttcagctccgatttgagtgaaacttgaacctaaattcatctaatttcataagctttccaatgatatataattcactattggataaaatatatttataaaaattaaataattaatatcaagatgatgcataatagtcaacttaaaaatatgctaataaataaaattagtattgtacagcagaataattatctttaatatgttctgtcactgtagcaaccacataaattaagtataattgatgtttgaagttaatggatatataggaaaatattagtgccatttattaatctatgtccaaatataattaaaacccacgacttattagttatttaaatagagttagccttataattattaggtaagtaaaatatagatacacatagatcggtcctaagcttgtttatggcaaataataacagagctagtgtgattaaatcacctatatgaaattaatcaacgacatatcccatataatagcatatagtgggagaggtgagcaacccttagttaaccaagcagtaaatagaaactattcaaataaatgattcaatatattaagatattgtgcacacatatattgtacatcccattatagatatatggtatcgtattaatttgcttgttgcatatattaatttagagggagtatgtgacgaacatgaatattagataaatactagttatacatcttgtcctcgtataattacagatcaactgtaaatttggattattcattgtaaaattatgtgatgggataatccgtaaccataatatgattaacctaaacaattctaacatacacagcatgggtaattgttaaccttttataatttattttgacaagtgaaatatgtacataattaaattaaagcctccattaataaaataataatacaaatgattcacagtaattatttgaccgatccaaaatccatccggcaacagaacctctagtgtataaccgttctatttagatagatgcatgtgtaaccataatccttccttagccattagctagactgaaccaccatgacaacagaaagactaagaaaccttagctcttagcttgattagagtccattagcaagcgcgaataatatgagcaaccctaggttcgacctcagcaaatatattttgtttgtgcatatttgattgttgcttgaatattggtttttctcgcgtattatagactttgtgtatcggttagtcgtgaggcaacgtctgcaacttccaggaggtgaaggttgatcaagattatatcgagaatagggattatcctgagcaggcaagtcatcactattccttgagcatgttgatcccaattgcgaaattgttttgtttataaataaaattgcatgcaatgatgaacatcctacttgtgattatgccatgccttgattattgtttacccttaaatctttgtaaccatgtttacgtatgagtccctagtcaactatgacaattgcttagaaaggctattctagaatcatgcatactcatatttatcaaatgctatatgcttgggcaattacctttgggaaggtaattgagatgcggcatgtggagacatgagcgccacattgccatgatgttgatgacatgatttgtgaaagtggaaataaaattaaacaactgttttcgactggggcggacggaggatttgggtggtatctggaaaaggctagtaccgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacggtgggacagccattggtaggaccgcgaggcgggtgtctacagtggtgtcgccatcggtaggactgccatgtgagaatctaaaacataattataacttaatgcatgtgtgagtcttcccttcccgggtgcgccagaactcctctcactgctagaaaccgtgtacgcctagagtgcatgaggatgaaaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagaaaaccaaatctattcgaatagccgtgctcgcggttaatgagcaccgggacatgtattacacttggctagactctaaattcttaacttgtgtgggatgggatattgcatggtgatttttatgctgatggagccacttcctgagaggagggaaggtggacgtcctcagaaaaccatgacgactcaatggcgggaagctatccttgggatcacaatggatggtggacagaaccatcgttgtttaatgtgaacactggaactaaaatttgatcagtctatgataggtcttaggcttgtgaaaatatttgcaaaacgcagctttatgcaaaagaacctaaaaccattccttgaataccctctatcatatgcattgttgttgtggtggcttgctgagtacggttggtactcacccttgctatttatatatcttttaggagtgtgttgaagagaagcccttgtcggtacgcttgcgtatcccacaagatgatcggagtgcggtcttgttctaggtctcgttccccagtcgactgcctgtggcatgttaaccgggcccttatattattttgtcttccgctgttgttctctgatagttgttggcctacctggccctaatgtaagtgtttaactcttttagcctaaattcattcgtgatatgttgtgatccaactatgtatgtgtgtaccaactactgatccagggattggtacggataaacacagaagatttctgattttcaaaatcgggggtctacagagctggtatcagagcatatcgactgtaggtcgagaccctagatagaatggccgttagttgcaggaccttatattttacaaatatatttttaaaatgctaaaaaaaaagaggttatgaaaacattcaaatattgtttctcatcttacctctcttcaaaaatatctgattccgatacgccaaaaagaaaaaaatatttttgataccttacatctcaacccttcctttgacaaggcgattttatcacttgatttgtgattgaaaaatactggttctatattctcatccacatttcaaaattttagaataagaaccgaaagcaattaagacgctatagggatattattgattgtgccgaaacctcatcctcgaaagtagatgattgcaacatgattatatgaaaaacaaagtaaagaaaaacaaaagaaaagaacagaaattaactcatcaatcatgataactcatgattgttagtactagtttcctctagtcacacactcgtatagtagaagtgaagtctcgactaagccgttagtgaccatagaagctcgacctgcgacatggaagttcataaagaacaataaagagaaaagaaacagactgcgtatttatgagaaagcccagcaagaatactaaacatacaaggatctaaagattatggatcaagaaggaacataagatgctacgtagatatggaaattcaataaaaggaaccctgatttggataagagtacatggacgaatgatgaaagagatttgaatttattggatattagcttgagggttgcttcaaaattccaaggacaagtcgaactcatatggcttaaatcctctgaactttattttataaaatgtctttagaaaatattgcgaagcaaattaatttttgcattttgaaatatagccttacaaaaaaaaattacttcaaaaaggaagaaaatgtttgtttcaaactatgtaattg

SEQ ID NO: 7079 - DNA, 3784 bp, Oryza sativa
aatgtaagtgtttaactcttttagcctaaattcattcgtgatatgttgtgatccaactatgtatgtgtgtaccaactactgatccagggattggtacggataaacacagaagatttccgattttcaaaatcgggggtctacacctatcccacacacgtggcgccaaaaccacagggggtcggggcgtcccagccctcggggccgaaacgggagcggcccgacccctcggggagacagagggaggggtggccacgtcaccctcgggcccgacccccccgagggagtcgggccacgtgggtgatcgcggctacccaagcctctagtcacgatacccccggccccatgtcaccgacagtagcccccggcgttacgccagggcgaccgcccccctcgagggaggcactggggcgtgacgccactccttaggcccggtgacaagtggggccggtccctacaggcgggcgggaacccagcggtcgcaaatcgcgcgcatcggcaaggggaaaccgaccgacaataatgagtggcctcttcaagaccgctacattactcgagcggcgcgcgaatcgggacgagccggttcgtttcgcctggagacatgatgatggcgcttttcacggttggcgagcgtagttgatgcgcgcacgatctgtcccatctcaactgccacggtcgcacatacgccgcgtgcgccgcaaacgggcgagtggggttagtggaggcgcgagcatgagaaacgagggggcgagatagtgggcgcgggaaacgaggagccgggcatagcgttggcaagggtataaagaggccgaggaagagattcgtttccttcctctcgccactattccccttgccttcgccacttgcgctctaactcctcgtttcctgtgccctacccttgccgcactcgctcgctctcaagctcctcctccgccggcgtcatggcacggggctccgcaccgctcgacggtagcgtgctgccgccttcccgcatcgtgagcgagaggcaggccgggctgccgcgccgattcatgccggaatctgccaccggccgggaggtggtcgcgctgggcgagggatgcccggcgccacactacccggggtggtccgtcttcttcctctctttcgcaatggcggggctggtcccgccattctctgcttttttcatggatattctggagttttacgatctccagatggcgcacctcacccccaacgcgataatgacgttggccatcttcgcacacctgtgcgagatgtttatcggggtgcgcccatctctccggctgttccggtggttcttcaccgtacagccggtgtcaccgccgtcggtagtcggtggctgctacttccagccgcgggggcaggtgctgaaccgctacattccctgcgtcctccgcaagaagtgggacgactggaagagcgatgggttctacacccccctcgccgacgaagcgcgcctccgacttccgagccagcccccggcgcaggcctccagctggcgggcgacggtagatctgggagacggctacgacgccgttcttgaccgcctggcgggtctgcgatcccaggggctcacgggggccatggtgttcggtgactaccttcgtcgccggatcgcgccgctccagcagcgcgcccggggcgcctgggagtacaccgggctcgaggactacatgaggacccaccaggggcgccaatgggactgggaccctgaggacttcaggatggtggtccaactggtgctgaatctcagctccgtggaggcatccctcatcccccaaggggtcctccccctctgctgcgatccagagcgcgccaacatcctgaccatcatgcaggaggtcggggcgtcgggggaacggaccccccgaggccacgatggcgcgggcgggagccgcaagggggaacaatctaccccgggagggggtcgtgcttctgggccacgtgacgggggcccggggggcagccgccctgccgacgcccgggggaagagaaagcaggagggtacccctcccccatctcctccccgagggggtggggcggtgcgtgccagcagcaggcgcccgaagggtgccgtgccggcgccgcagcccgagggggagcgaaagaagaaacggctccgcaagatgggggggaccgagccattgtcacgcccagaaattcccgaatagaatttcaagcagaatgtgcattaaattccccgtccaggaccagccggggtacacaaacgacaatgttgacattcagatccacgtcttacaaacatcgtaaaagtcttacataaatgcagcggaaggaaagaaagacaacaggagctaagccttgactagaactgcagcgggaacaccactccacaggcatcctcgacggcacggacgaagcctactcctcggagaaaccttcatctgacacaaactcgagctctggggttgggaaaagtagagcaagactgaatactacccactgtactcagcaagtcataccggaataggggtatgatgcacggaattatcaagaagagctagagtggttcatttgcataaagcgagcatttataaacataagtcgaaagattaaaacagttgtaataattaattaatatcaactatccactgtccaacgctaacccacgttgcgacaggcccaaccatccacctaaactatccaaattcaaaagattacactagggtgagactaatcacggtgaatctggttgaccgcccgtaaccgcgggcacggctattcgaatagttttactctgatcagaggtgtacaactgtacccacaagacacagccccacgacacgtttccgtgcgccgacatgccaccacgacataccggaaagaggccgtgacaggaccattcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgttaagttcttccagggcatcccgcgaaccggtccttaactgccatgggtgcgaccagcaaaaccatgcacccacagcccaccatgtgatttattttaattaaccaacaccaaagcgatgtcactaatccaacaaaacaattagaaccagcagtctaaacattaataggattttccccaacgtgaactagttgaactaagcatggctaagcaatccctagtcctaactctaatcatgttggaaccccaagttgacaaagaaacaatgtacaacaatagcgtggctatgacaataggtaaacaacccatagtagtgttataaaacaatgcaatatttgaaacaaaacaatagagcatttgcaatataggatcaacatgttcaagtgacaagcatgacttgccttgctctgctgctggaggaacctcggcaactatttcgaagtacaccggagcgtcggaggaatcggaatctagcgacatacaaagcaaacattgcaaacaggctataagactactgaaacagggaacaaaaccatttttaatggattctacacatttttcttgatttactgagacttgaatgggcttaaacggagctcggatgaattagttatgaattttagaagattcactgtgtttattactatacaagaaaaaccttaaatcatttattgcgcaataaatcccagggctgacg

SEQ ID NO: 7080 - DNA, 5355 bp, Oryza sativa
  unsure (1)..(5355): unsure at all n locations
aggcggaaatcgccggccgacgtggggaagtgggaaaggagagaaaggcgggattcgaaaatcgaatcccggccatctcgggcgcgggcgcgagcggtagagagaggggagtgggcgcggaagaagcggcgcacgcgcggggtggtcgacgtggcccgtagaaggcggaggcgtggactcggcggcggttgcgggcgcggcggttgcggcgcggcatcggctagaggtgggggaaggacccgacaggtgggccccacctgtcggcgaccccggtaaaggagggcggcggggcggcctggctgggcctcggcctgcggccggcccagcagggaggagggggaggaaggagagaatgggccggcggcccattcgaaaaaaaagaggaaaaagggaggaaaaagaaaaagaaaaaggaaaaaggatttttcctggaattaaaatattgcttgctcaattttaattggttaaaattatttctagagctctgaaaattccactaaaaatcctgttaatgaatttcggcatgtagaactcaagaaaaattccacatgtcaaatccgattattatttgcattactatcctagggttttctcttgatttgcacctgcattttcttgggggtcgtttaaaaattaaattttaggcttgggaggagaacttcggggtgtgacagccatgccgggggaacctcatctcgcccccgaggtggtcgtttagccgacctccccgcaggttcgtccccgcgcccaccgcggccgcattcattctcccatctcccaaggcgagttttcactcacccgtttcttcttgtccactggtttttcttctgcctcagcaagatcccgtcgcgcccccctcgccattccaagtccggccggtccgaggccgaggagacggctaccgcggaggcccggaggcgggaagctgaccggcgagaagccgcggaccgcctccggaaagccgaggaggctgcccaggaggccgtccgggtttgccaagctgaggaggccgctcgggaggaggccagacttcgccgggccagggagtccgtccgggaggcagaggcggcgcgcgcacgccaggcggtttgccaagcccccgacccgacttccgccgaggcgacgacgacttccgaggccacccacgacgaggccgcgggcgcgccgctcgggcccgacccctcgggcgacgcttgggacgagccagcttcggngggcgcccccgagtccggcatgtcgatcggcgggccgagccgcgcggcacccacaccgaggcagctctcccttttgccttccgctgccccactgagcgcggagcccctcctgcaggccttggccgccgcgaacaccacggtgctggacgggttaagtgcccaaatggaggtcctgcaggcagagcgggcggagctcgacgcggcgtgggcgcgcgtcgaggaggggcggcgctcggtggaggccatggtggaggcgggccgcaaggcacaccgccggcacgcctcagagctcgaggcccgtcgtagggacctggcggagatcgccagggaggtggaggaggagcgggagactgccctcatcgccaccgccgtgctcgacgaggcgcgggacgacctccgcctccaatacgggagccgggcggcggagctagagaagaagctcgacgccgcccggggagtccttgacgccgccgctgcccgggaacggcgggcggcggagaatgaggcggcgtcccggcagcgcgaagaggcccttgaggctcgcgccacggcgctggaggagcgcgcccgcgccctggacgcgaaggagagagacctgacgaaccgcgaggccgccgtcgccaccagggaggcaacactggcggcgcacgaggctgcctgcgccgaagaggagtccgcactccgcctccgcgaggacgagctcaccgagcgggggcgagctctcaaggaggccgaggccgcggcgcagcggctggcggacagcctgttcctcagcaaggcagcgcgggaggagcaggcgctccgcaatctggaaggcgcccgtgccgagagggccgcactggatcagcgggccgctgagctcgaggcgcgggtgaaggagctggaggcgagagcgcatagcggcggggcggccgcgggcgacggcgacctagccgcccgcctcgcagccgccgaacacaccatcgccgagctgcagggcgcgctggactcgtccgccggggaggtcgaggccctccgcttggcgggcgaggtagggcccagcatgcttcgggacgccgtctcccgtctagactgcgccgggcggcaggcgtgcctctggggcggccggtgcgcgaagtacgccgccaatcaggggggcctcgcccagcgcctctcagagatggccggggtcctcaagcggctccccgaggagctcgaggagacgatcaagtcgtcctcgagggacctcgcccggggggcggtggagctcgtgctggtaagctaccaggccagggaccctgacttctccccttgggcagcgctggaagagttccctcccagaaccgaggacggcgcgcgcgcgcaggtccgggacgccgccgaccacatcgtccacagcttcgagggtacggcccctcggctcgcgttcgccctcgactccgacgaggagggcggtgacgacggtgcggacgacagcgacgacgaggccggcgacccgggcgcgtcggaatgagcccccaggcccccgccaatcttaataactttttcttctttttccgaggccttcgggcccccttcttgtatagactgatttaatctgcaatcaagtaaagaggaaatttctgtgtcagttctgtttgttgtgtgtatgatacgaggatggtctgtgccacggtccttctgtgtcttggcttgaacaagggctcgtgcccaggtcccagcctcaaacggcgcgggtcggggctagtgcctggggagatccacgtgtcgagactggccaggccgggagcgcggtgaccgagggttatggatgacccgattgtgggcctttgctgattcccccccggagttcaccacgccccggggcacggctcggttctgggccccgtttggcgattttagccggcccgggccaccgagggcagggtcgggcacgagcgtgctaattcaagccaagatccttcaaaaggaaacgatggcacaaacacagtcctcaggaaatcgaaagtgcttttattgaaatacggaagagaaaaaagagggaagtatatgcatgtggtagcccccggccaacccgcacgccccgggggggtgcggggttggcccgagcccgagaaatgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgagatcgtcgacgcagagtgatcgggcccggacgtggcgctgatggtagcgccgcaggctctgctggtagcgcgtggctcggagggccgcgcgccgccttcgctcttccaaatagtcgaggtcgtctcggcgaagctgatcttgatcagcctcgaaatacatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgctattatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcagggcctgggccggctgatgggtttgcctggcgtggaactggcacgccctgcaccgccggaccaggtcgaccgcatcgttgagagccgtcggccaatagaaaccttggcgaaaggccttgccaaccaaggtgcgtgaggcggagtgggctccgcactcgccttcatggatatcggcgagaagctcgacgccttgttcccgaggaatgcacttcaggaggactccgttagccgcgcgccgatagaggatcccttccacctgcacgtagcgcttggagatgcgccggacgcgttcactcccttcgcggtcctcgggtagagtcttatctgcgaggtacgcctggatctcagtgatccaagcaatcaatctaggggagctgggagcgctcccctcgggtcccgaggcctggactccgacgggcctcgggggccgttcaggcgcgtccgtctcccctagggggacgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgcacgtaagcgtccatctgcgggtcagagcaccggtactccttacagacctggttaaccactaacagggagtcgcctaacaccaggaggcggcggatcccaagtccagctgccactctgagtcccgcaaggagtccctcgtactccgccatattgttggtcgcccgaaagtcgaggtggaccagatatctgaggacgtctccgctcggcgagatcaacgtgacccgtgcaccggcgccctgaagagacagggagccgtcgaactgcatcacccagtaggcggtgtgaggcagctgcgaggggcccgagctggcctcgggggcggagacgggctcaggagctggggtccactccgccacgaagtcggcgagggcctggctcttgatcgcgtggcgtggttcaaagcgcaaatcaaattcagagagttcgattgcccatctcaccacccgtccagtaccctctcggttatgcaagatttggccgagggggtaagacgtaaccaccgtgacccgatgcgcctggaa

SEQ ID NO: 7081 - DNA, 18579 bp, Oryza sativa
  unsure (1)..(18579): unsure at all n locations
agggtatcgggtcttggcgtcccggagggcctcgctaacgaagtagacgggccgctgcacctttcggcggggccgatcctcttctccaggggccgcatctccagggcgctcttcgtccgagaggccacgcggggcgcactcggcttctgtgccgacgacctcggggtcagagggcaataggtgcggccttcccgcagtggccccggggccatccttggggtcgggggcgcctggcaccgtcggacaagcaggcggagggccagctccggccgtcgggggtcttgggccgccgttcggctcgggggcctctcctccctgctctctcccgggtcgagtcgacacaggatggggatgcgcggagtgagggttgtcctcgtcgcgctccacgaccaacgccgcgctgaccacctgcggggttgccgccaggtagagtagcaacggctcatctggctctggggcgaccaggactgggggagaactgaggtacgccttcaactgagtgaaggcccgctcagcctcctccgtccaggtaaacggcccggagcgtttgaggagcttaaataggggtagtgccttctctcccagcctcgatatgaaccgacttagggcggccatgcagccggtgacgcactgcacatccctaagcttgctaggggggcgcatccgctctatagctcgtatcttctcggggttggcctcgatgcctcgggcagagaccaagaacccgagaagcttgcccgcaggcacgccgaacacgcacttattggggttcagctttatgcgggcggagcgaagagtttcgaaagtttccgctagatccgagagtaaggtctcttggttgcgcgtcttcacaaccaagtcatcaacataggcctcaacattgcgtcctaactggctacccaaagaaattcgagtagtacgttgaaaagtaggacctgcattctttaacccgaaaggcattgtcgtataacaataagttcctattggggtaatgaacgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccaggagtcgcgccacttcctcgcagatgaaggcttgacgttccggggcctgccgccgcactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttagacgggccgtcgcccagggcaacctccttgaccgggacctcgtcgcacgtgaccatccgctgcctcggggtggcggggacggaggtgctgagcctctcgtcgccacccgcgggcttggacgccacggcgaggtggtccgcacgctgctccatacaagcaagcgcgactttgaggtcgccatggacggtgatggggccaccggggcccggcatcttcatctgtagataggcgtagtggaccgccgccatgaacttcaccaacgcgggcctccccaggaccgcgttgtagggcagactgaggtccgccacatcgaagtccacccgctccgtgcggaagttggcggaaccaccgaaggtgaccgggaggtcgatatgacccagcggccaggtgtgccctggcgtcacaccgatgatcggctgggacggccggagcaccatccccggggccttgatggcgtcaaaggctacgggggaaaggatgttgagggctgcacccccgtctatgaggacacgccccaacttcacattgcaaacggtgggggaaaccaccatcgcgatctgtcctccccgggcaacgcacggcgggtggtcgatctggtcgaaggtgagggcaacctccgaccaccgcgcccgccgcgtcgcctcatgggtaagggccgcggccagaagctctcgcttcatggccttgaggctccggcgagaagcgtgagcgcacgctcccccatcgacggtggcgacggtggcctcaggctcctggaaccccaggtcatcattgccatcgtcgatgtcctcggcggtggccttctgcttggcctcacctcgccggttgccggcgggagccgccggggccttgccctcacggcgctcctgcctcttctcctcctcccacttcctcgtccgctcagccaaacttttgaccgcgcggtagtccgcgaggtcgtggagggaggtgttgtgcacggtacaccacttgccggtcgggcgctccctactgggagcgccggcctccttctttttgtcgctcgcaggcctcccctttcggggggcccgcgaagcgccctcgacggcgaggacatgaccctcgtcgtcggaacgggccgacttcttcttcctcctcctgtcccgccgccctggctgtgcggcggacccgggggcggccggagctgccacaccagaaccggaggagttccaggtccaggcctcctccttgcgagccacacggtccgcgagctcaaaaagctgcgcggtggtctggggctccttggaggcgatcttctcgagcatgcggttgtgccgcacgcccccccctgaacgcgtagatcaccgcgtgtgcggggatgcacggtatggtgttgcggacttgacagaaccgctgaatgtacgagcgaagagactcatcgtcccttcgctgtaccgcatgcaagtccgcttcttcgcctgggcgcggatatatgccctggaagttcgtggtgaactgctggcacaaatcctcccaagagtggaccgacgcgggtggcaagttcattaaccaaccccgcgcctggcccttcagggccatggggaagaaattcgccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaaggctcgacagccggcaccgtcaaccggggacacggggggccggcccccgtgcccggaacgaagtggcgctccggacgaggaagcgccctccgttgcgtgggcggcgcgactatcgtcgcgccggcgctcgatatcgagccgggcatccggccccccatgcacatcttcttgggtcggaggcgttgacgagggaatggcggacgaacggcgggtaacggccgccgttcgccgcgccctccgcctcgacgacgtggagccggcggcggcagcgccagaggccttgttggcggaggactgcccgccggcgcctaggcgctgctgcgccgtcatgaccaagtcggccacgtcatccagccaacgtcgggctggagtctctggatcggggacgacgggcgggtgacgcaggagcgcgcccgcagcctggagcgcgccctggggcgtgccgccatcgccgtagacgaggcggcgacgcgccccgtctcgccgtcctcccccgtcgcccgcgggcggcgaagtcgcggatctttcgaccccctcgagcgcctccccccgcccaagatttcggcgagagggggacggtggggtgcgagcccgacggcgcgggttctgctccccgtcgtcaccgctagcgctcggagagaggttgtgcgccactgcccgttcggccattgggctgagcgggagaagcttggcgcacacgaaagaggacgagggcttagaaagacacgcgcgccccctacctggcgcgccagatgacggagcttggggctcctcaccgggagaccgcgcaggcccccctttgccggttcggccgggggcgctaagtgaggttcttcgccctcgatctgaggaatgtcagcgagaagaatcgcacaagacacgggcgacgtagacaggttcgggccgctgagaagcgtaataccctactcctgtgttctggtggatctgtgtgtgaaggaatacagctcgagagaaccagagagagctcaggctctagaaccaagtggccagagtccagccccctctcctaggcctgggcctcctttttatgtggtcaggggtcaccacatgggcctctagctgcctaagaaagaaaacatgctttttacaatgagggctagtctacagccggaagtgacctctgacaagcactgcacacgccttctgctccgctcgtcagctctcccggtggacgcccgtttcaaccttcattcaatggccagcgactttcttgccatgcttgcgctgaagcctagaatggatctgaccgggactgacataccaactccaggagtcagcacgccagctccggctagagacgagagccaggaaactctcatcattccgacgggacgaggcgaggcgtgcgacaggacgcctgttgccacctaacccgcgatctgaccggtctgtgaccggtcacataccgcgactggtcacggaccggataagcgtgcgctgcgccgcattaaatgcggcgtggcgcgctcgtccaacccgctataaatgcggttaggtgagccccgctgggctcacctatcccacacacgtggcgccaaaaccacagggggtcggggcgtcccagccctcggggccgaaacgggagcggcccgacccctcggggagacagagggaggggtggccacgtcaccctcgggcccgacccccccgagggggtcgggccacgtgggtgatcacggctacccaagcctctagtcacgatacccccggccccatgtcaccgacaggatgtatctcaattgtcgcttgaatctggttgacgacaacatgtgtcatatgatcttgatgacatgtccatggacgtctgtagcagcctgtaatgagaaccctggttcccatttatctgacaggtagggtagggtgttgatgtgatccttcctggagacaaagtgtgagtgtgtgtatatacatgagcgtcaatcactattcgtcattattatgcaacccctcctgctacatagtagtctaagagggattgcataattctagaaaaagtgttgacacaagatgtaggggtgagacttttccattgcatatcactagtgtacaatacatcacctcctcccatctattgataggcatagcctcatgaactttccatatttagtgatggcccattagtagataacctaggccatgccttcatgggcctgtcggtttcctaacaatccctcttgagctttcattgcatgatgcctatgcctcatcaaaactccacaaaaacccaatgggaaaaactccacaaatatgcctatgcctcatcttgatggcaatgattttctatatcaagattttggaatgagtcagtgaaattctccccctgaattttgcatttctatatgtctcattgttccgattcctcggacacatctattcaagagaagatgtacaatgatctagtggtcaaatctgcaagaatttcacataacttagcattcaatattttgttgcttgtacgaaattcatgtccatagaagaacatggagatgcatattctttagtgagtttgttcatgtgactcatttgcattgtgcgtcatatgctgcattattctaaaatgatgggtgataagataattttcaaaacatgattgctggggcagtgtaaccatctctcacagccatgtcgaggctcttcatagttcaacgatggttagttcagtttaatgcaattatccaagtatttgagtgctactatcacacacttctatttgggaattcctcccaattttatctataattgactacttcgaagctatgcaccttggacactttctaagtgtggttggactgatgtacttggcttccatctatcaaagcttttagttgcaaccgtaagtgtgatttggattctgacaaacatttcatttcaagtcaaactcaaaattcaaaatgaacgagtttgtttcttcaattgtttccatattattctactcaggacttagtaattcttcatggactcttatgcgagtatctgatccaagtgttggtatttgttacgcacacagataaatccgcaagcccatagataccactatagcacttccctttagagtattataatggtatcgaacacaatgaacgtgtgtgtatatctaaaaacaagattcaaccaaggacaaacaactaaatggtaatattaggatagagaggattcctatgaattcaactagctaacttaagttaaaggtaaaactttatcgaatgcttcgggccactagtccagaaaactctattagtgccggttgaaaactggcaataggtgtcggttttccgtccgacaccaattggtcggcacctatgtcggttttccgtccgacaccaattggtcggcacctattactggggctggcacctataggtaaaatagacccggcacctttatgtctgcacgagccaaaaaaaaatcccccggctcgaatcgagccgaatccagaaccctacacatccttacatccaaaagcaaaatcctcacgtccaaaatcaaaatcctaatcacacatcaataacaaacaacaatgcatggagaagctcccgatttcacccaagaatatcaagaactctatgagcatcaagaactcaagaacatgagcatcatcaaggcatcaacacaaccacaaacaggaacacgttgacacgccgtcgccgccgccgcacgccgctgccccccgtcccgctgccgcatgccgggcagccggatctggcagaggggaggtcgcggccaccgctgccgcggcctctccacccgctgctgccgcatgccggctgcgatccgccgcctctccatgcgccgcccgtggggacgccacccatgggggggcagaggggaagggggacaccgcccgtcgcgtaggtggaaggggggaggggagggcggcggacgatgaggtgaaggaggaggggtccggaggggaggaccccgccgccgccctgcctccctcactggctgtacctgcgccactggctttgggagctcgcccaccgccaccctacgtccctgcctccgcggggcagccgctgcgagagagaggggggaggcagatcgagagacgcgagagagaaagggagagatatgcgagagatcgagaaagggagggagtagatgtaacgtcctgcctctcctaggccgggcccgcttacatctggcagctttcataggttatagactgccggggagggagatcgagatgcgcgagagagaaagggagagatatgcgagagatcgagaaggggagggagtagatgtaacgtcccgcctctcccaggccaggcacgcttacatctggcagctttcataggtcatagactgccctcacagaccaacataagtcttttctgcacactttgtcctcactcgtgcgctcccaaattgttccaggccaagcacgcttaaccctggagttctttggagatcggtttccgaaaaagaagttgaaacttgttgatatgagtattctattattcctattaagccttaggctgggatgtcacagtagataaggatgcggtgggtgcggtgcaccgtgcgtgcgcggatggtatcggctcatcggctcggctcaaaggtataggtgccggttctagcatggttaaaggtgccggttctacatttttctattactgggaggtgggaaaagctctataagtaccggttttaaatgaaccggcacctatgagccggtccctatgagggtttttgtagtagtgggcaccggtcctctcctgctctgccaggctgagtccggccttaagctctatcacatacccgaacatggagggatgtaaaggacggatagggctgtcaccacctatcacgtacctcactttctgtggagcacacaacaaacggaggtaacagctaatctacacaccatgtctacgttatcgattaatactctagcctcggccaagaactttcttctttatcccgagtcttagtactagagcactctgtataagtgctaagcgacaaatccgcaccaatgagaatatatcccacttaagtaagctaattaaataccataaggaaatcccaaatacttactttattgaataaagtatccggcattcctccaggactccagtggagggagtgccgacaactccggcactcctacggaattcccctacattgagagaactctttactttgaggcactcctttgtgagcttctgtgatgacctgcacttttaacactgaagataaatgtgtcagactgtagattactagtcgtcaacctgtgcgttgcacgggatgaatttatatattgctattcgtattataaatgttaaaatatatacgtcaaatttataagtaaaatttgttttagtggaagttatgtgtactaatatttttaatttatatgttccaagaaaacaaaattagtaattatatataaaccattataatatttattttgttgatttatagtttctaagtctaatggtccatgtgatttttacgggcaagttctatgaattacggaaatttgacctactatagaatccatatagcgaatagtaggcacaacacaaattaaatgagttctaaaagtgcctgaagatatcaaatgctgattagtctgctaaattatttttatcaaataaattacatatattgattggctgaaatagaacaaatgtttccagacgaagcaaccgatttattagtggtattgggactactatcatgtaaaattgacatagaaggataaaaatccaatgacatgtccatgaataatacgttatacagactcgacgtaatgcatacaatatatatactatctatatatgttcactgcttaaaattattctacgatacaatttttcagtgaactttatcattcaatagacaaaacatcatcagcatatttattacttcaattgaaaccaaaatccaagaaattcttaaataagtcatgtggcctatgagtttgatggaactacaaggtaccccgcgcgttgcatcgggacattgtgcatgcaaagaaaagagaacgtttgatccatcacaaatagaaatagtgtatatgaaaaacattacttttatgaaaacattttatcatcacattttacacattttattagtcgaatagatccaagtattttccaactgaccttaatcttattattagaccgatcataggaaaatgagttggttgaataggtccaagtatttttctaacaaagcacaatcttatttgatcaactataggaaaatgaattttattgactacaaatgttgaaaataggtaaaatactaaccttctgatgtgatcatgaaagttgagtagtatgtgccgtgtaacggccactgtttactgtgctctgcttcaaactaagtacggatcagttgcacaattatttcaagagtggtaatatattatttgatagaaataaataatattgtagtataagaaataagctaatttgaggggtacagcctggaatttctagaaatcaatgcctctgaagaagaaactgaatctcttccgaatcataccatagctgaaatatgatttaagatagaaattagtgaccaaaatttacattctaattaggtgagaacatgcagcataaaatccatcagcaaaaaagtatatgatcttcatctaaaggaagggggaatctgatattaaatcttggctggcatactgaagacagacacctgggacatttcttttttacagtactaaatgggaaaaaaatgagtacagccgatgaactcatccaaaagacacatgttttaatttggtgaaccaataaactcaataggggagaataagggaaaagaagaatgcacctgatccaattgggaacagaaaaaaatagtgcaggccaggatgataggaaacaccgtcgctggtgtgtgcaatgcaacaccgtcgctgcctcgctggaggatgaattagctgaggccgtttgcgtccaataatccctaatcaagatggagattggctaatccatctttttttttatcaaaagaacaaattggctagtgtgttgcaacaattagttacatagcaaaggcggagtctagtattcatgggctactaaaccaccagagctacagatagaaaccaccaaacctgataatcacccgatggataccagttatatagactcacaatacctgtgatgggcatagcactcagatttaaatgcgtcaatcacggtagccatcaaggagcagttgaggtgtctatgccgttttcctgattttgcgcgcacgaaggctagggtcacgaagagggagcagagcgatcaggcgagaaaccgtcgtggaggtaggggaatcgggcgggggaggggaggggaggggaggcgtggagagggagcgcgatgcagctgggacggctggacgggcgcgatccaggagaaggagaggatgcggcacggcgagagcgatgcggtgagggcggcggagcgtcgtgatgcgggacagggagagaaagcggtgcagcaagcacgctgtggtgaggcggcatggcgtgatgcaggagagggagccgacgcggtgcgagtgcgaccatgcgggtggataagagcaaggataatactatagcttgctgccggcggtagattatgtccaagtcatctgaagacagcacagtagctggatggtataatggtttggctatacattgtctggatagaagtttggatacatttattgactgcatgtgagtatgatcaaatctagctttcatttgtgtgaccatctgtgtgtcgcatgccggatgagagcagaatcttttgcatgttgcacttgtgagagcaggcagaattatttatgcacacgggatcaacaataactgcgtaactaccatccgcacctgctgcgggagggcggcaatgcctgcgccggcatgctaacgctcggcgcttctgcaatcgcccgcttcactctctttcctctttttttctcctccacgtaggaatatgctgacgtggagtttcttatcgccaacctagtcagcactattatacttgctctaagtcgatccgagcaacggttgatcgctcgattagatcgaacggatagggggaaagagatgatgtggaagcaccaggaagcagagaattgtagtagtggggatgatttgtataggtatataggatacctttatagattgtacattggactatcaccaatagatcttcttgaatgcaaggggatttttcgatttgtgaatttaatctaaaacttgaaactcatggatctatatgatacatggcttgggcgagtaatgattcatgtcgtttcagaattcggatgagagaagaacagaattataatctaatcttgattggaaaataatacagtagaagctaaaatcgagagtcctgattgattaaaaaaatagaattgtacctgagcagttcagcacctgagctgtagaagtcttcaggttgcgtgtgctcccgatgagcctatcatgaagtcttcgtgtcgcaaggtagttctgactctaaagcctgtaggatcacgcactactaaaaaaatgattttccttgtacagggacccatttagattgcagacggatcataactgatcgcgtctgaaaaaataagctcatttaagctaaaatgagccaattttcgcatgcggacctattaagagggccacacgcaaaaatatccactccctcttttccctctgacccactttaatttttcccttctttctctcctctcctgtctatctctttttcttctctcctctccttttttcctcttcccaatcatcagtcaacaatagcggcctcactcatctacgccctctcctctcctcctgacaacggtggtgggtgtagacgatggcgacagcggcggcggcggcggtggtggaggtgcgggatccggcgggcggcggtcaacccccgcacggatccggctgtcgggccgccccttacccccctccccccccagggattaggctcccctccactccccttccttccctccccagatccggtggaggggaggggcgtcgtggcagtgcgccagagaggagcacggatccagcggcgggcggcgcggagtcccccgctgacgacgacgagggcgggagcggcgttctcggacgacgacgaggagcggcgcaggcggcaccgctggattcaagggttttcattttttgaaattttatttttttttggatttttgtttttccgtgcaggcgacatatctcgtgtgggtgcgccctagaattttctgttttttctctccaatcgcgatttttgcagatctctgggtgcgtgcgggccgcccaccagcatgcgaaaaccggttttgaccgcacgcgagaatctttctagtagtagtgacggtacacaaatcgttgcggatatatatctgaatggatgaagggcgattggagagcgttcgtctgctcgcgtgaagtcccatctgctctcatggagagatatagatcgatgctgtagaatcgaatcacaataactaagccaaccagagggagggtgaatagttgttatacccaaaaaccgaaaacttttagcggaaataaaagttaccctcgaattcgacggaagtcggtctgaccgagattaatctgccggtctgaccgtgtggatgccgtcagtctaaccggtatagatcaaccggtctgaccgccaaagtcgctcgccgcacctgtcgccgccgccggtctgaccgtcgcaaaaccctacttttcgtcgttcgtttgttgaggctgtgcgagagggggtgatggctggcggcggtgggagattcgtccggcgtgacggaggcgatggaaccaaccaagctgccgctggtgttcagcacttcaacctaggcagaggagatggaggtggacgccgcatgcgtggaagaggccctaggcgcggtcttcgcggtaggggccgaaatccgtatcacgcagccacaggttctggtacacgccacaggggctgatgctgacggccacgttggaagaggtgatccagcggggaggggtcgtgctgccgttggaggagatagcagcgctgttccttcaagtggcgctggcactggtggagctgcccacggcgtggcggcggtcgcagctgctcctgccccagacgcaacggagaatgaagttgtggctactaaggcagcaaatgagaccgcggctaagtaaaaaattcgctgcttcaggtgcaaagaaaagggacatggtgttactgggaaagaaattctctgcggcagtgccgcaagccacaccctatgcaacaccgcgtagaataacgacgcgtgtccattgtccatcagcgcgctgcagccccagccggcctgagcccaactttggagccgagccgatgcctggtatactacacccacacacctgtcagctcgttgaaaatgctaccgagccgcatctactggctacacatgaagcctgaataatttcatttttcaatagagcttttttatgcaactgttgctgataatatgctggagatttttctagtgtaatatataaatcctttacataaactttatcaagatgtctcgggtgctcagaaattacattttgatgacataacaaatcacggaacatttaaggagtactccctccgttcaaaaaaaaaaaaagtccaatcctagcttgtgtctaggttcgtagctagagtttgtcttttattggcatagagtagtagctccgaaaatttttaattgtacaggtgcggagctatatagccatataggaataccaacaacatgaaagcctgaaagtttgcaacatacaaaccaattctagcgctatacccaacctgacaagtaaaaattacatgtgttgattgacaacttaaaagcacacctggtgttgaaattaggttggcacgtttacatcatatttatacagcatgtaaaatcatttggtctatattgcagaaataaaaagagaggcaagacaccacccttacataggaacccgaaaacttacagacctaatacaaaaactattcatgtgccctggacagcttgactccaataagcagcggaagaaatggactcggctcgacaccaaccaaagagggctcggcctgcagcaggagattaaacacgcgtcgctattctgcggggtgtcgcacgggttgtggcgtgcggcactgccgcagagaatttttttccgtgttactgattgtaatgcagttatttgtgacatatgtgaagacccaggtcatttggcacctaagagcatccccagcagttcctctaaccggtcatccgtccttcatttgccgtatagaaggggaaaaatcagctcgagcagatacgctaacaggccctccaaaaggggcggatgcgccaaattaggagagagaagaagcaaaaatggagtgtttctctcctcacgccattttgcaacagccgcctctcccgcccccatccagacttttccgcgacgcgacctcacctccagcgcgacctcccctccatcgccgtcgtcgccggccggtgaaggtgagtcagcggacggtggagagggagggtggagtgagagtggagatcgagaggtgtaccagatctggagccgcgccaccgccgtctgtagccgtcgccctgcccgtggctgaccgctggcgccctcgcgatgcgcgcggccgctgcttgcctcctccgccgccgccgccgtcgccatgctcgcggccgccgcttgcatcctccgccgccgccgtcgtcaccatgcgcgcggacgccaccttccgccgtcgcccagtagcccgcaccgttgttcagctcggcaccaccctgccctgcagcgccgcccgcgccgtcccgcatcgcccctccgtctgccgcacgcacgcacccgcgagaggataaggtagggtctttatttttttttagcgagagaaggtccgttcttttctgtttttcttttttttaagcgagaggataaggtcagtcgctagcgctaatgtggattagaagtccattcatgtaaatacatcatcaattaaaaaattattcattaaaactatatcggttaaaatttactcatttcaaaatattattgcgataaaaaatgcagttaaaatttagtagttcaaaatatatcccttaaaaatataaatataaagttagttggaagatattattaaaatataggagggtgggatatggatgatgtaatatagatgatctgttagagttgaaaggaatatgaatgatgaatcttttttggatgaccatccatataggtatttggaggatcaaatatggatgagctgctagggatgctctaattgcccacttcttctcgctcctaaacccactgcaattgtgtggctggggtgtagagggtggtggcttcttcatgattcctacaccagctaaggtatcaggaagaccaagggagtttagtaagactgcaacagttcgcgtagagaatggtcacatttcaattgataatctcaccactgagctgcgccggttggttcccgtcagatttgaagtaaaggagacggcacaggatacatttgttgttcagtttccctctacaattgaattagatagattgcatagggttggcagagtccgtagctttgattttggtgttgatttgttatttaacaaatgggaacaggagattgaggcaaagtttgtcctgaagaagacatggtttcgtgtctatggtgttccatatgaaattagggactttcttagccttcatgctgtcggttctgtcattggaaatacaacgatggtggatatggtttatcttcggaaacacggggtcgtaagaatgcaggttgcggtggatgatttagcaactttgccgcccagtgtgtacattgtgttccgtaaccatgggtatgagattttctttgaaccagaaatgcccgaggaggaatcgaaaggaaaggaaaagttagacgaagatgatcagcgtgatgacagtgaacaaaagaggaacgatgatgatgtcattatggaagatcggaatccaaagcgactaaaaaatgaagctgcgtcatcctcaatgtcattaagaggaggctcagttacagactctcagcttaattcacattgtgtttcagcgatcgcagggttgctcactgttgttgatgattctgcagtagagcagcaagctgaggaggttttgccaacaatttgcgtggcttctagcttggaaacggtgatgaacaaggctccagaagagagctcaatgcagatcccaactaccggacagaacgtgaccttggcaaatgaaaaggtggctgctttgtctttggctgtaccggatagtgtggttgccatctcagaggaagaatttacaacgacattgacggatgcgggagagatggcaccggcaggttgtgcatctctctcggaggcttcgacgggagcatcaacactagaaggggctgtaactgtgtcattggctgctcctgttgtcatggacgacgcagcccaggagatcgagtcggacaaggtgggcttggtggctgccgatgctccaactttgtcggtcgatgcaactcaggtcttgccgtcctcgtcaactggcacaatggacgctgctccaatggtgaatcaggaggtgacagaggtaaccacatcacaagactcgatgattttggatgtcgggactgcaggtgttaacacggtaattgagttggctgccgatggggcacaacttgatgcagcacgcaccatcatcgctgaagcaaaggtgcaagcagaagcaggtgggaagcgtccctctcaagaagctaaacgtcgctctcgtcgactgattcatcctacaccaacacgtcaaagtgaatgacagaaggcaatggcaaacggggatgcaccggtggcaaaccgagcagagtttctaaaaaagattcataacctcgaagtggtagcaggtaacaaattcaaccctacaagttcaattctatctttgcctaacaaaactctacttgcaaatatttctaagctaggagtttccctgggtagaaatgacatagaagtagatgagtctatttatggtacaaaaatttctgaagttgatagatttgtagctctacatgctagttcttctgtttacaatggttcttctagtaatgtagataatgacaaggatgagcttttaaaattatcttctatccagcacttatgtagtgattggcaagaagaaagtgagggtagcgctgacgagtcttttgattcatgcaacgcacctcaaagaaagaaaattttgacaaaagccaaaaataaagtggtatgtccacctttggctaagccaaaaatgaaacgcaacaaacataaaaaatgaaaggaattttttggaatagttgtggtttcggtgatccagctaaattcagatttatctctgagtgtgttaaggaacatcacttggattttattgctatctttgagaccagaaaaccgtcattcacttcagcaaatcttagaaacctatgtggtggaaaagattttttatggcatgagaaacctcctgttgggaggtcgggggcattcttttaggggttaatttagccgtttttgatatcggttcaatttcagagggagatttctatgtgaaatttcaacttagaaataaagaagatggttttaaatgggttctaatggcagtatatggtgctgcgcaacccgatttaaaagaacagttcttaacagaattagcgcatacttgcagtaatgagtctcaaccccttttggtaggaggagactttaatatcatcaggtcgcaagaagaaaagaataataattcatttgatccccgttggccttttctttttaatgaagtgatcaatagtctcaatttgagagaaattgatctatcggggaggcagttcacctgggcaaataaccttgaaaatccaacttatgagaagttggatagagtgttaatgaacactgaatgggaacaaaaattccctttggtaacatgccaagcactaccacacgccatttcagatcattcacctattattcttagatctggttcacatgcccattttggaaacctctcttccgctttgaactaggttggcttcaacgggacggtttctatgaaatggtccctaaagaatggcacaacataaataaggggaacacccccatggagcgttggagtcataggattgcccacttgagacaacatttaagtggttgggcacgaagtacaagtggcgcatacaagaaagaaaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7082 - DNA, 450 bp, Oryza sativa
tgtggatattatgggtaccccatacccatacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatgatgagacaactagatcgtcagatctataatacacccggcggattcaaatccccaaacaggagtagggtattacctctcattgagagggcctgaacctgtctaaatcatttgtctccgcctccatccacttttaggtctcgtgcgctacccccttttattattgccgaaatcatgtttcgacactgagcg

SEQ ID NO: 7083 - DNA, 617 bp, Oryza sativa
acttgtttgttttggatatattttctggtggaatttaggaaactataccattagttgttccctccttagagttcaaaagcatacctaacatgtttaattatgcctccgatattaatatttctaggtgttccacgaaagggaagcttccctctagggagattgttggacataattatttcttcactctcatatctaactattatttgcgtatctctttgttatttgatgattttaggatggtgggaaaatatatcttgtattagagtactgtcgaggtggtgacttacactcataccttcagcagcataaaagggtttctgaaacagttgctaagcatttcatccagcagctaggcaagcactttctcagaccctcagtgtcttgcactatttattgctttatctctccccagagccaaaatcacattctcttctttatgcagcatctggtctgcagatgctgcgtgaaaacaacgtggttcatcgagatctaaaaccacaggttaaattatttaatttactgttattgagcggatatttccattatatcttcatatttaatgaccaagaattgatgaaagaaaccggattttcctgacattttggtttggtttctat

SEQ ID NO: 7084 - DNA, 631 bp, Oryza sativa
  unsure (1)..(631): unsure at all n locations
gggtcccttacaaaaaacaatcgccattaagcccacaagattagcactgaactacgaactgttccaggggaagagagggatggaccaaccgtaagggtcgacaagggacgccgcggcggccgggttgtgctgctgctgcatcctctcggcggctctcttctgccggatctcctccagctgccagacaaacgcgcacacaaaccccaacacaaatttgagcctcaaatcccagatacaaacgagacgcggatctgaaacgcctcgcgtcacagagaagcaggagggagaggagaggagaggcatacggtgcggcgcccccgcgaggcgtgattggcttccatctccggcgaccggccgacgaaccggtcggctttctggaagctcgggatccggaggcgcgacgcgaaggaggatggccgatggcgggggctcctccggtatcgcctcgatcctgtgatgcccggagaagagaaggggaagaaacccaaactcgtgggcctagccaacgtgttggccttctagagttcacaagccggcccgtacgagcccgatcgggcaggttattcagtacccccatgcgttccaannnnnnnnnnnnnnnnnnnnnnnnnnnnnnnnnnnnnnnnnnnnn

SEQ ID NO: 7085 - DNA, 736 bp, Oryza sativa
gacggtattcacaatgctcccgggagaccaactaccatggccacgaggagcaaacgacctgtcaggccgccaatttgcgcgtacgtccggacgccagtggccccgccgctactacgagtcgtgtgaactgtgaggctgtgactgttccggtgggcccagcttgacccatgtgctactgttacgatgcacccgtttcttggcccacgttactaatacagatattgcaattggcccacgtaatacagtcacttgggctcggtccagtctagtactcgtaggaggccctggctgcagcgctaggcctaggcgacgccggctagaacggtccgctgctttgcccatctccgtgtgccgcgagaaggcggcggcctacggaaacggtgaaccttcacgtgccgcgcggcccagccattgcccgtgccggccgtgcgcgtgacggcccgagacgacagtacgccacggtgtcggtcgggcgggcgcgcgcgcggccacgtacacggcgcagcgtggcgcggcagaggcgcacctcttcccgcgatgccgtggatattccccggcaccgaccctataacttggaaggcgtattcctttaaaaaaaaaaaaaattgaaaggcgtggcgggcgacgctaccacaggtgtggaaaaaatctcttctacctaccggcacgcgcgaaacgagcagtttctatcagcacgtgatgcataaactcgttctatggcggcaagcatacacac

SEQ ID NO: 7086 - DNA, 12779 bp, Oryza sativa
ctttgagtttagcaaactctactcttaatttgtaccattgcgtggcaggattccaatcaaatactagtagaaaacaactcctatgcttacaaaaaacaggacattccaaggcaacctacctattcaggcgcgcacgtcgatgtgctatgctttacattgacatgtccagcaatcttgtcctatcctgttccaagacggtggcaatttttgtcagctaccgattgggcaggggagcacagctacctcctgcctcatcggagacagaaacagagtcgtaacccatcaaaagcaaagacaaaatacacttgtcgagaactcttggtttgtttggtttctcttcacgggcaacggaatcttcaaggtgtcattggcagaatggcaggcatgctaatttgttcagaaggtctctaattcatttgacgagttagcgtgtatactagcaatcaccctcttgattatctcatgctgtgctcgtcgtcttaggaaatgccatgtctggtagggtcaaagccaaaccgagtcaggtcagtatgaaaccaaatgcatttcggttagtggcgggagaaaaatatcgatgtcacaattagtcaacgagcaagcctactctgttctatctagcacatggaagaaatgggacctaacagtagacttctgattgttcttctagctctttgtgttttataatacatatctgaacgctcaaactaacctgtagctatagtcgtcggttcaaaccagtgtttgattcgaccacactctatgaacccaactacttccaccactccatctcttgatcctgaaagtgttaacatttcataattaggagatcatgctgggagattctgccaaaccacatttgcataccaacggcctagattttctatagcttaccagctgccactccaagcttgacttctgaacccgaataggttcacaacaaaggctgtatttagatctaaagtttggatccaaacttcagtctttttccatcacatcaacctgtcatatacacacaacttttcagttacatcatctttaattttaactaaaatctaaactttacgctgaactaaacacagccaaagccagattcgccgcgcttgccctctccggcaggcggcagcttgaccctacgcaccaaattaaactgaacagataggataggataggatgacctcattggagcgccagcatgaataacacagtaacctttttttctcgacacgaaaggagccaatgacctatatgagcgcttgcttttgctgaaactgtactttcacacggcagattaacctaacgtagatatatcctactgaaaagcatctcacgaccgacctgtactgctgctgtcctttctctatagacgatcactccgcagcaataattctggtccagtcggagacatcgaccccccacacacaatagctagatcgctagctagcccaaggacacccaagaacagcgagatggggcagatggcgatatcgccacgttctcgtttcattcgtttcagcggccgtcactttcactgcaaatttttcgccgcagatcgtgcagctaattataaaagctgataacaatcgatctgaagccgcctctcttcgtcccgttcacagaaattcatcttacctaattaccagaggagacactagctccttttgactttgcgtgtcgctgcacctgatcactctctctcacacacgcacatccattagctgggcatggctgctacttgcagctgagtgcccagctcacgtagcacgtcgcatacagtaatacacttacaggtcatgggctcatggcagtgacaaaaacaaggccgtcttcccaggctcgcacactggcaccggcagcctcgcacactggctagctaggtgacggagacggcatcgctttacaactcaaaagggcctccgcacctcggcacgcctcgttttctattgctcggccgcctttgcgcaccaaccggccgggtcggacaaaacacgagggcgtctcgcggatgattgggaggcggtctcgcagatgattgggagggacggggttggttgcgcgcactcgcgcgcggggcaatggccggttgtggaggaaacggtgctcctctcctatcccgacgtccccgcggcagctgatgttgaacgggctccaatccgatcgatgcgatgcatgcatggcttgactgcatgcgacgttaggtaccaaggctggctcagatcaggaccgggacgtactgtctcctcgcagctgtaatgaaaacttgcaaagcaacctggtactactaaatttgtcccaagatacaaaaatttttagagataatacagttattaagaaaataagtaaaattaaacggaagaggttatgattggatgagaagtgacggtagattaagaaattaaatggtgaacagttataattggttggaaagagaacgttgatagataagctattatattttgagacaaattctgaatactaaaaattattatattttggtacggataaagtaatagtagtacagtaggttattaagctgctagtaacatgatggattggaatcgccgtcgccgaccgtgcatgatctaacatcgatgccttctttgttttcaaaaagagaaaaaaagggtagaagaggattcggtggttctgttaatttgcagcccctgtcgttttcaggttctgtggaagcatagaagttatttcctagatattgactttgttattcttttttctttgacctcttacagctttcaatactttggatccattccaccacagctagcctaactccaattccttcgttgtataaacctattgcgctcttgacttttttagcatgagaattaaacaaactggaagtcttagcttagctgctgaacagcagtgcatcaccacaatttttttccgttattgtggtcattgatagtagcatctttgatctaagggatgaattgtcggtaacgtacaaaggaggcccattttccatgcagatgtgaccaccggaaccaccatcgtcagtgggcacggcaagccaagcggtaataagattcgcaagaacgtggggggtttgcctcccgtacgtgaagacggtgcgagcgtcagcatctgacaagtccagtggtgtcgggccttggcgcgaaattagcaagcaatgcttcgatcagaaattcagttatactataaacatgaaagaatcaccctgctcaccgggttttattttgttttgaaagggaaatctgctcaccggatttcgatcgcagtgtcaggttgttggggataccacgtcgagcaaacaataatattcccgtctctgtggcaactgcttccaccagcaagcccaggctcaccaatcgtgaaagcggccggccggcggcgatcagtctcctgtaaaacaccggaggagcaacatatatggctcggcactcacccactcacccagctcagctgtgtaacctctaaaaatactagcaatacttttaatttggaccatatcttatctgccttcactgacacctcttatccagtacttatgcgtatctagatcgtgctaatcattgacgctccgtaataatgtctgtgatccggccatttgattggagagtatgcaaaatatgcatagtattacagacggatggatcggatcgaatcagtgtactgtaaatgatgagtaaccctggcctgattgatccgtggatctcccatgtcgagcggcagccgggcaatcacaatgatgagacccgatctcacagagtggtacgtggtgtccatggcctttcgatctccagcagcagcggcagcggcagaaacctggttggcacgtcggaggaaacggacaggatctccacccccacgaacgcgaatacaataatcccgcgcgacgcgacgcccgcacgcacggggcgggggcggagcggacgacgctagcgtccagccacagcgcagcgcagcgtggacggaaccccgacccgccgatcaagccgtccacccgcgccggcgccgcgaatggcgcggcccaaccaccgggagcgtgaggataaaccaagccgagacaccgggaatctggcgcgcggcgtgcacagcgaagcggcccgatatcaagcgacgatcatggcggcaacctaacacgggggcccgggtgcacggtgcgtgcgcgcgaacgtcaacagcctacgactacaactagtactgttcgcgatcccctcctcctaatcgtttgaagccagtgccgcgcacgtaggcgccctaccggttatggaaagggactcgcgggccgttcggaacggattagctagtcgtaactcgtacgtactcaggcgtcatgcctatggttcgtgacttgtacgtactgtgttacatctcactccacggatgcgcgatcaggatcgagagagaaaaaaaaaaggcaatcgatcaattgcttcccaacaactccaggttcccattatcaatctgaacgtgtcgatgcttccatcgaattgactactcgtgcagcaacactccgtacgtagtatcatcttcaacagcgaagaatcggttaaatgcaagtttaactgataaagtgagtgtgtgggaacactgcagaacggcacaaaggctgaaagttgaaaccaggaaagggcaacgcatgatcgtgcgtatatgtgtatattactgtttggacgatgagcacaaggatatctcttgagaaaagaaatgttaaacaagatcgcagagtgcgtgcggccacgaccaaattttgggggggcaaaaataatgtaagagcaaatcttggaccccacctgccagctgcccgcacgactcatcaaaaccggtacaaacccaccgagacagggtaggcgtcataacgcaacacaaaaggaaccgcgcggcggcaccaaagcgagcagaagcagcagccgaaggcgatcggagctcgcgcaacaggagagctgtctccatgaggaagctgtgcccgaacctggagcgcgatgacgcgctggacacggtgctcgaggtgcccatcccggaggagatgttctcacgcggcagcggcggtggcggctcccgcggctccaggttcggctgcaccaacgtcaagtcgtgggtgcggccgaacgcgtccgaccgctccggcggcgccggagagccgtgctccatgagccgcggcgagctgcagctcatgctcggcgtcatcggcgcgccgctgataccgctccccgtcgaccacgccaagcagtcgccctgctccgtcctctgcgaacagctcaaggccgatcccattgtacgatcgccatcatcggattcttctccgtttcgtttgtccatcgccgcgcgctgattggctcatccatttatggcgtgtcccctttcaggagtcgtccacggccaagtacataatacagcagtacatcgcggcgtcgggcggggagtgggcgctgaacaaggtcacgaacatgtacgcgatggggaaggtgaggatgaccgccgcggagctcaacagcagcgacgccgacggcggcggcggcggcggcggagggcaccgcggcgggaagaagagcagcaagaacggcggcgaggttggcgggttcgtgctgtggcagaagaagccggagctgtggtccctggagctcgtggtgtccggctgcaagatcagcgccggcagcgacggcaaggtcgcctggcgccagacgccgtggcatcagtcgcacgcctcccgcggtccgccgcgccctctccgccgatcgctccaggtataatataaaccgcgagttcttcgttagttccatataaacgcttaccgtattcgcacgacttgactgcaatactgcatggtcgcgtagcatcatagaaaacacgctcaactctcagttaaagtttccaacgactaggagaactgcgtactgaattggatcctgtttatgagacggacgactacgagaaccaaatttggtggcacatattttcttttctggttcgacgtcaaaacgagtagtcctttgtgtttgggtcgatccaacgttgctgttggccgaacttacgtagcgagtccattgttgtcatcgttcctagtggtaggtactaataggcatcggtatcatgacatggaacgcatacgtccaaagtcgcaaagttctcatcttaatgggaacttactttctgtagttctttgtcccaagaagctctgtttttccccttcgtcctgctcaaaccggcctgatttgggtactaggtggccatcagtacgcgccgtaccgagcgtgcgtagtacgagtagagagtagagcatgcatggcaacttggccagtgtcacgtacctggatcttccctgcatactgtcggtaggacaggacagatcggtcgagtacccgcacggccgagcgacatgattacgcctttgccgcactcattgggccgttggcattagctgtggtcaaggtcagtccagggcggtgtcgggatagggctggccgatcgctcgctcgtctcatcatgaggcttgtacacttgtgccgttgcgcgagagatctggtccagggcacccggtacacacagatatgggggacgtactcatcatccatcgtcagtagcggtggctgcacgctgtcgctgtggagtgggggcgaatcatggcaaggggagggcgattagcgggaacaaagcgcggagcagcgggattaggggggacgggttttcaacaccgtcaccgcaacgtgccgccatgtgctgcagcaacgcggcgggacacatcacgtggacatgggcctaaaccgggacgcgacccacgccatcaatcggttggtggctcgcggtttgtcacccggccggttccacccgactcttgaactctccccgctaatcgcgctgcaccaaccagcccgatttaatttgaccgcggtgtcaactatcataccatgttcttttttcataacagctataaatagtactagtatatagtgtccacgtggattaaattaagtgactggagaaattaactaacttgtgcatgcatggtgtgtttggtacgcagggacttgacccgatgctgacggcgagcctgttcgcggacgcggtgtgcatcggcgagaggagcgtggacggcgaggactgcttcgtgctcaaggtggaggcggaggcgtcgagcctgcgggcgcgcaacagcagcagcgtggagatcatccggcacacggtgtgggggtacttcagccagcggacgggcctgctggtgcagctggaggactcgcacctgctgcagatcaagtcgagcggacacggcagcgtcttctgggagaccaccatggagtcgcacctccacgactaccgcgccgtcgacggcgtcaacatcgcgcacgccggccgcaccgccgtctcgctcgtccgcttcggggacagcagcgacggcaacacgcggacgcgaatggaggaggtgtggaacatcgaggaggtcgacttcaacatctggggactctccatggactgcttcctgccgcccagcgacctcaaggatagcaaggaggacaaggacgtctccgccgccgtcaagcccgcgcggccgccgccgataaggataccggcggtggccgtccgcgtcgggccatcgcaggtcgccgccgtcaacatggacgattccgactcgctcattgcgaggtcatgacatacatagcgggcagtgttacaccgtatgagtcgtgtgtgtttacgtgccttatcgccataagttacttatggtaagatctgtaaatatattgcaggttgagatatttttgttttcggggagtggattttacctcagatagatgctcaggggtgagtagtaaagcgagtaatccgggatagatgttctaattagcggtattgtaatttgcttatgacgccccttcactgtaaagttgaaagaatctccagttctgctagtcacacactgggcttcagcatgttttccacttctcctgaacatacttgtgctacaggtggctgcaatccaaaacgcacataacttgctgcaagtgttttcaagagtaaaaacttaagcctcagtcctcagattaacacaatgcagttccaggctttcagcccccagaacatgtacagagagtggcacaaacgtatcacaacatcggtgccatttctgcaaggggttgagtgacagaagctttgcgaggatctgctttgcttgcatataaaaagggtagctaagcactgagatgagccttgcagcaacacacctagtcattttacatgtacagttagctaccccgctaaagccgattccataagattcatcacatttcgatgtgagtcgcatatggatcatggcataagattccacgacgcaactcgagttacagaagaaaacgaaaagaaacaaagaaaaacatacatttttatcacaggaagctaggctcgccctacaggagatagcggcggccggtgtggcacatagcttgcctgagctctaccttgactagctgccatgatcttgttgagcttatggtcagcgagggatgcgtgctcttgcgatgcgtgcacacctgcttgcgtcctggtagggcgcctgccgtgaagcatcactatacacatagcaaaagcctgaagtaaagcaatggatgatctgaattcaactgtgtataacccttctctgaatgaaaccatactgaaagcatgcttgtcttctcgtgatcgaccctacaaatacagatttatataagcatcaactgattaggtcgtcatagattagatacataaggacataggcaagaacagagaagcacaaggacgcacctgaacaaacaagtcaaaccgttgacttccatccgtcgtctggtttgcttgagtggatttatcacctttgttttctcgggcgtcatcgctgaggacactgagcatgcagccttcatcccacccaccacagtcacacgctcctcctgatttccacctctcaatcagaggtagtggctgtcctgaggttgatgtaccatggaagccattaggaagtacggcaagaacactggatgatgcacaactatcatccctcgtattaggatggaaatttcccaatgggcaagaacagtcggttggtgttgacatgcttcggctggaatgctgtgaggatgagtgacgagaagtttctggttcttgctgagacaccgcactaataaaagccgcaaactctctgctaacatgtgaatcacctgattcttcagaagatggtagctgctctgagccaaccagaacaaattctctatgcaaatggtttttttctgcctggtagcatcttgattttcgatgtgaaaccctcatttccccaacaatattataaacaagctgatctttcttgttcttattacctgccttgatccaagccccacctcttttcttaggttcttcaacaccaaacagagtgtatgtgctctccagatcattgttatcggagatgcccttccttctcacggtagccaccaggatatcagaaccacaagaaagcatgaaaaaaggcaggccattcttccacgctagctgcagaagcgcatgccttgttgttgttgaatctatatcttgctggaggtacctttcactgttcaggacctgaggaggctggtttgtattagtttctgttcggcaatttgaatttaccactgaatcaactgacctacgttgaacattctgcaaagcagatcctcccaagctcagagattgcttatcaatatggccaggcagatgacactttggaacaaatgaaggttgaattggaccagaagtggatgactgacgtggctttaatattggatctaacatcctcctcaatgggctgcgtctactgcctttgttgcctgatgacttatctccatttatcttatccacagaggtgcttgcttcaggttgtcgaggacatggtccatccttcaggcttgaacagcggttcactcgattcagtccagaaacaagatgtctatgtggtgacgcatccatatcactgaactttgcactgatccgaggagttctctcagaggcacccctggaaatttgcttttggttgcgattttcacctatagttacagcagcaccaacagaatcaccttgagtcccagttctgctggtgccaagctcttcagatgaatccatgataggaagtggacatgagtatggaattcgaggaaattcatggtgttgcccaatatcttttgagaaaccaacaggtgacaaactggcatttctttccatttccatcaccgcactagacactagagtctcaaaaacctcaccagtcacgccactgctctgctgaaaatcaccacatgcagaatcattgttatgtgaggtgaagaaactttggccaatgttatcatcatctgtaaaaagcctgcgcgaacaatgatggacggcctcctctatattccttgtagtctcctcatcatcaaccatttcatgtcgcatggaactcccagtggcagtaagaagagggtccgagagtggagatatgtttctgagattcaagtcaccgtatttgccagtgttctctggaaagtgttttccatgaacaggcaacaagttcaacactgcagaatttgggctaggtgaatatctggccttcccatggtatttatcctcaagatcactttgctgaaactccatagaacaatgctgatggtcattgagtgtaggagattgattgctttcaagagatttgctgctgggacttgcagatgactgggatggagaagagaatatcagggacctactagtattagatggagaggcaccatggctgctagaaaactcatgcttttgttggtgagaccacctggctaggaggccccactcgagaactccaacattcaatgccttgtcctgaagatggcctgatgtctctttacgctgcaaatatgaaggaacatttgacatatgcttgacaagctcatcaaccgtagtggcctttcgaccaggccatggttttgagcctttcaaggatccacccgcatctgcactccgaggttcccgttgccttcgaaacttctcatttttcacaactctgattctatcttcaaattttccatcaatgttcccaccgactactgcaatcttctcttttggcacttgtacagattgatcttgtgaatttcccctttgacgtccatcacgacctaatgtggcctttacattcctttctctgctaaactgtcctttcgttggcatctttttttatggtttaacatacgccaacaagcagagcttttcacttgattcaaattgaatcgtcaagtttcaacaggatactacacttccttgaacctgcaacttcaatattagcagaaaaaaactcagatatgtagcttctgatatttccaccagagcactaatgaacagaaagaaaatagcaggcagcaccacagaaccaacataactacagtattgcagtatctcaattcagaactaagtatttgtcggtggacaatggcatcattttgtctcccgggaatcctggatttatgaaacattatgtttctacatgtacttagtggggttgggagttggccaccgacagttttgacacaataatgttctaattaggatatgtcaataaccatgcaaacaagactgaaaaaaaaagggctcccactaatgataaaaggtgcaaataattatagatatttgccctgatgctataccgtgtgtggcttgtatataaaaatagtttgcacattgttaagggcccagccatccataaatagttcagtcagtcctgataaatgtatatcaactatggctatggggcatctttccccgtttccctcaagaaaaagggcacctttctccacttgattttgttgggtggcttacaaaatgaaaatttagccgtgcaagcctagctactcacaaaaaaattaaaggtctaactacaagcaagaggggaaaaaactaaagttagttgcccggcaaaaataaaataaaatctggagttgcatagacaacaaatattttaccatatggattaggttgaaaccattttttccctttgcaaattagcctacaaaatgcatcatcatcaacgatggtcgttatagcggcagaacgggggaagttggagaaaacttgctgaactgaataagatggaacaccagctgcggcattaaacccaacagaaacccaccactcttcagcatctctctccaatcgagccaaccaaccacattacccaaacattgaaacagaagaagaaaagaaaaaagcacacatacgacgaagtcacgaagataacataccaagatgctcccaagaaccacttcaagaacagtccccccagctcatcgagatcccatatggaggtcacgcacccgcagatccgccacctcccctacaaccagaacacagatcagtgaacctcgaccaagcagagaaagaatgccaccccaagaaagatgcgccaccttgggggataaagcgagagcgagatggaacgagagcgcgcagcagagtgggagcgaaagaaagcttcggaggtggactggactggatagagacctggagcacggcgacgcgcactcggtgggtggtagtagtagtagtagtaggattgggagtgaggcgcggtggtagctaggagcctcctacttcttctactactcctgtcccctctccgtgacccgccaactggttaggtgggtggattggctttaggcgggtgagcgcccagtcgccagcgttctcgcaccccccccgccgccgcctactcccctcccctattgacagcccccgctttacttctaccgcgccgcggaggagggggagccggttataccaagaggagg

SEQ ID NO: 7087 - DNA, 5073 bp, Oryza sativa
  unsure (1)..(5073): unsure at all n locations
cttgggtgggtgacgtcagcaggcacggcgcccggcgcaagaggacggcgacttcggtgagtaccacccatactactggctacgagcactagtagcagcagctctcgccctcgcggcgtcccatcgagccatcaaattattgcaatcgcttccctgttcctccccatctcgtccttgtgatccgtgcggtacgtggtgtcgcagcttttgtttaccggacgcggctgggctgaaggcctgaagtaggagtaggagtgtttttttttcccctgagaaaacccagtggggagttgacgggcggagggacggacggggggtggagccgtggaggtgatgtgaaatgtgatcgctgatgcgatgcttcggagacctggtggtggctggtgaatggtggtgatacgtgtaccatgcaggtgtaccgcgcggttggccgggaacgtgtttcggactttcaggtttgagccgttctcttttggaccacaggggttacgaacttcgggtgtttcagtggagagctaaagcctaaaaggcctgtctatctaatttttgagctaagtttgatcaccggtgttacctaaaagaggtactctattcgaccacttgtgtctagcggttagctcattatcatggttagtgcgctatctcatcttttctattctactggcccaacaatcatgcactcatctattactcctacctcatctagatgtagagatagagaaccaaacagaaaaaaaaatggttgacataacttcatagcttcaatgtaagagagtacccaccctccgttccaggcatagctgctcatgttgtttaaactaccatggtggcgcgtgcagattacgtggctaacataattatattttctctcgtataatagcatatatattctctcaattaattattaaaatatattagaaataacgatataattttaaattttatactaacattaccaacctaccgatgtgtaataatcatattacattgtatatacgtaatagttattaattatttttaatatctaattttagttatttctaaattatatttctatatgtactctaaactcgtcttccaatatccttattttttaaaatccggatatttgttatatgtaaattgtatttctatatagactctaggctattctttcaatattatttatttttaattttgattttttattatttataactgtatttatatgtggactctaaactcatctatcaatattctttatttttttatttcgaatttcagttacttctaaattgtattcctatatggactcgtcgtcccttttttaaattttgaattttagttatttgtaaattatatttctatacggactctaaactctacttttaatttattatttttatttcgaattttagttaattctaaattcctactcctatatggactttatactcttctaatattccttttttaattccgagtatttcttaattgtatttttgtatggactctatactcttctttcgatatgtttttttaattccgaatattagttacttctaaaatgtatttctatatggactctaacctaattttaattttctatttttaattctgaatttccattaattctaaattgtatatcggcatgggctctagtcacatcttccaatatttattactatgttttaattccgaatttcgactaattctaaattgtatttctatatggactctgtttttctttttcttcgattaatatgagaatttctagggcgtgagagtgaatatggaggcgcatttttctattactttattaagttaataggttttatccctaaatgtggaaactagtagcaaggatgctaactactccctccgtcctagaataaataaagttcattttcatccatcccgtaaaaaccaatgtagaacaaaaaaaaaagactataataccttcactttatgaaatccctatgcaattattttttatctactcccaatgtacctatacatactttcacaaactctgatgcaatgattgctaaaaaagaatttatttgagataaataggatgtgctaaaaatgaacccattataagatgaagagaatattttaactgtgaattttgaaaagcgaacaacttctttccaagtctaactgtgttagcaaaataattaatcccttcattctaaaatacaaggaattctagggttcagatttcgtattaatatgagcatgtatacaccagttttcatgatttccatcactcaataattctatagccaattagatgcttgataagtaaattcaaaattcaaaaaaatgacaactagagtgacttaaaaaagaaatctgttgaacttaccttagtacttactaaacaacctaaaaatcattatactccctcctttaacaaaagttacacatgttatttttgtcaccaagaccaaggataaattaacttatcttgcatgtaacaaagaacaagaaatgtatgcacgcatacaaccaatgagtatgaagatggcttctcgggttctgatcaaacatttaatttatctctccacttaagtctgcaatgcatagagattacaaacagaacaacttatttggaaactcaaatataaaatagatctaactcttgtggaaggagtgagtactatatgacatcactacgagagaagtttattaatgaacattgcatacgcctttagttcttttatatttatttttgcctctaccaatgagttaactgttttgtaaaactagataaacctcgtgcgttgctatgggagttctgtataataatagtgtaaataacatttaatatagctagacaatatcactttatatactttataaaattttcatttgtgatcggccatgaaaaaagttataaataattatgatgatgacgtggttataacagtttaaatcatatatataggatgatcaatcaaaagcaaaactacgatgatacatcttaataacataagagaaatgaaaagataatatagattaattatccaaagacaaatttaagtaatatatgattccgtaggtgaaggaaaagagggaaataatttagaccatagattaatcatctaatagctaaaaacaattaaggtggtatggcttaattagataatagagagataactttaactgtatttattgataatgaattttaggattcgtatatatgaaaatactatggaattctttcgttccaaatggacgactttaacttttatcggtgatacgtgactaaacgtgatgaaaaaacacaacacgtacaccggaaaacaaaacgtagtagattaacttgtgtcatcctgcttgcttagcatcgatcctttgcttcccttttctctttagattgagttgctttcctttgtttcttcttttactccaacataaaacagacgttagatatcgttcgatcctttacagagccggccgttttgtttggcacatgtggcaagcttctttattccgaaaatggtcgtgaaataggtttttgggtgccattctttaatcatcaacacgtacttcgtatctttgtccgcctcttttctggctcacatgtgcaagcgagaacacaaacaaatatggcttatacagttcaagcttttccgagacgaaataccactacacagtacacgtcttggacggcatacaatgcgtgtgctagacaccgatccaacaacatccagagctactgcaccacaaagtccacgacgaatcctctttcggcaccgatctcccatatgctgtgctccaaagttgcccagaacaagttctctcctgaagcagtggctttgggaagtactatacgcgccatgcagatctttttgttaccatgcgaaatctgcgagacatttgcaagatccacaacgccgctggggcccccggggttctacgcccttgtgtcgtgtgttctaactaatgcagcatactaagctgcttgcctgcagttttgctgttaaatttgacccgctcttttcttattcacttacctatgttatttcatatttttgttagcacatttttaaactgctaaatgatttatttcgtatgtaaaatttttatatcggagttattttaaaatatcagctagatatttttttaagtttataataattaaaactcaaataattatgtgctaataatttttatgctttccgtgtcctaactttatttggatcttcagtaaaacaaacatcatctttgatcgcatttttatgaacactctactactagcagatatgacaaatgtctctgagtataacccatgtgacacacacggtcacggtgatatgtgaatcgaataataacaaggtgattagtactccgtagtcagcaacgcagtggttgctagtacgcgataagaggaagctcacgaggagagataaggatcacgaattttactaatacacaaacgcacggacatgaggaaaatgcatcgaaatgattgggagaatcttgtcctggtccgatgagtggattaaagaaccagctttccgtcctgtcgtggaatctcatggtgattgagttctcatcctacgctcggcgagaccacagcctaaaaagaggcctattggacgctgtacattttgacagcaaagctcgggaaaccggcgaaagtgtgaagctggaaacgctagaaatgaaagccctaaatactagtagtactgcaccatggagttgagtactttggctaaagatgagtgtttgtcatgatcccatcgatggctttggaagaatccaaaggcaaagccgtccgacgcggggcaagaatcagcaacgaacgagtagcgtccagggggatgaaaacggccacatgctacgggtggtttcgcccattacgaggctcgttcgttcgtgctcgcgccatggcgcggtgtcgcgttgtcggatgatcagcgagccggggctgccgttgtgatcggctggatttctctgcgattgcaactgaccgagccatccgtccattgtcttttgtctccattccatnnnnnnnnnnnnnnnnnnnnnnnnnnnnnnnnnnnnnnnnnnnnnnnnnnnnnnnnnnnnnnnnnnnnnnnn

SEQ ID NO: 7088 - DNA, 715 bp, Oryza sativa
taagcatttagctttcgttcatcgtagtctagtcatttagaaattactaatgtcgaagttgaaacagtgataagtatttaagaagggagggagacacctttcaagtaaacaatggcccctcgaatttgaagtatgctgaacagtcttcagtgacctgttaacaatcccctaccacagatcaacgcctttgcgaatcgcagccaatactcgtgcaaaggtgcaaagaagcagcggaaccagatgacatgcattctgaggaagccatcagctgtggattagctactccgttctcacattatgtactgctagcattgatgtcactgagcatttgaactctgttctcacattatgcactagcattgagccattgatgacgacataatggctctgccgcatatgacactacacttcattatatgtcttctcaacgaagtttagcagcacctctcttcacctgagttaactaagcatttgagattggttcatttgccggaaaaggccacgcgtttctcagtccataagcagtggagacatgtccaatatttcccatagacagttttgtccatcgtgcgagcaagaagttgaacaattacaatgtggatctaaaattaacttttaacttgtacttgcatccaagaagaggccgcattaacaaactatcgtccaataaaggggatacaacgttccttgctcactaccaggaaatttgaatgac

SEQ ID NO: 7089 - DNA, 649 bp, Oryza sativa
ggctggtggggtggtgcttgttggtcatttcagcagctttgtgcggtcggggtggtctcggtgccgatggcgaggaagcagcatatcgccatattcaccacggcgagcctgccatggatgactggaactgccgtcaaccccctcttccgagcggcctacctcgcgaaggccggggactgggaggttacgctggtggttccatggctttcgaagggggaccagctgctggtttatcctaacaagatgaaattcagtgtgcccggggagcaagaaggctatgtgcgacggtggctcgaggagcgaattgggctgctgccgaagtttgagataaaattctatcctggaaaggtaaagtaaaccaaaatttccaaagtactgtatagttctatctgatattatcatgatctaaatgtaatgtcaaagtgaatggcgtggtacggtttattgcttgtttgatatgatgcttctgattttcccatggttcgcaaaaattcatcacacagttgagtttaaattgcttggccatacagttgtacacactacacacgttgctcttagctcatgttagtgtcaaaactaaaatggagcacgatttgtatgtctgattcttgttgagatttgagaagcaaaacccattaaccgtagaagt

SEQ ID NO: 7090 - DNA, 749 bp, Oryza sativa
tgccacacattttgatgatataattacatttctagtaatttataaattatctataaaaatgacagttaattaaagtttaaattgaatagtatccgcatgaattatttgagaacggagtgagtacattgtcgtgttcatatatcaccctccgttgaagaaaaaacaattcagactaaatatctagacaagatatgaaatgtatgttcaaattcttcgttaggattggattatttttaggatgaaaaaactaattttaactatgtacatagataaaatgcctgttcaggattgtgttactccattttggaacgcatgggggtactgaataacctgcccgatcgggctcgtacgggccggcttgtgaactctagaaggccaacacgttggctaggcccacgagtttgggtttcttccccttctcttctccgggcatcacaggatcgaggcgataccggaggagcccccgccatcggccatccttcttcgcgtcgcgcctccggatcccgagcttccagaaaggcgaccggttcgtcggccggtcgccggagatggaagccaatcacgcctcgcgggggcgccgcaccgtatgcctcttctttctcttccttctgcttttctgtgacgcgaggcgtttcagatccgcgtctcgtttgtatctgggatttgaggctcaaatttgtgttggggttgtgtgcgcgtttgtctggcaacttgaggagatcccgcagaaagagagccgccgagaggat

SEQ ID NO: 7091 - DNA, 6431 bp, Oryza sativa
  unsure (1)..(6431): unsure at all n locations
nnnnnnnnnnnnnnnnnnnnnnnnnnnnnnnnnnnnnnnnnnnnnnnnnnnnnnnnnnnnnnnnnnnnnnnnnnnnnnaatcgctccatgttttgataatatgttgctacagtaaacatttgctaatgacggattaattaggcttaataaattcgtcttgcggtttactgacggattctgtaattagttttttattagtgccaaacaccccatgcgacatcctatataatattcgatgtgacacgctaaaactttacacctctggatctaaacatcccaacatgtactgtcatatagacagtcccaaacattaggggcccttggaggcctctataataagcttagtcgcgcgtccgtgcaatggatgatgtttgcctataatatttgttcatgtgcatagtccatatatggaatgggggtaggcaatgcccctgggttcaaggatacaacgcctgtagtattccacgtcgatgatagagtggttttgtaagccgcccaggacaccaacttgcattatatgtcagccgaatcaattcaacgtgctcttcctactcaaactacgggtgtgttttgtttcttaaaaaagttaaaatttgaagaaagttagaagtttaaaaaaaaagttaaaagttcatgtgtgtagaaaattttttgatgtgatataatatgatggaaagttggaaaagggagaaactaaacacatactcctacgactgcctactcctgccaaaaggaattaaggtggtgtttggatcagagacttaattttagtctctgtatttatatattaatttagagcattaaatatagactacttacaaaactaattacataaatgaaagctaatttgtgagataaattttttaagcctaattacttcataattagataatgtttactgtagcatcacataggctaatcatagattaattaggctcaatagatttgtctcgcgaattagtccaaggttatggatgtgttttattaatagtctacgtttaatatttataattagtatccaaacatccgatgcgatagggatttaaaagttttagggcccctttgatttggaggaaaaacataggaatttcagaggatttcaatcctataggaaaattttctatgaagccctttgaaacaaaggattgaatcctaatcctttgaaattcctatggaatagacaaccctatagagattttggaggaaatttaacaagagcttcaacctcttgctaactttcctttgagtctatatctctcatccaattgctgtgtttttcttgtgattcaatcaaacggtaattcctgtgtttttcttgcgttttgcaatcctctgttttacacttacattcatattaaaatcttacttttttttctatccctatattttctcaatcctatgattcaaaatgcccttagtcatctcttatcgcgtcagctggccgtgcggccaatcacacatgtggaaaatatcacgatggagaggagagatggaccagatggctggctaacggacctgccgctcctgctcatattttaaagcacggcccgatgcacgaggcaccgaaccattgaacctgacgacgccaacgtgcttacgtgccaccccgctgcgtccaaacaagtagtagtacgtgccggccggggaccatatatatgccacacggcgagaaggctaccagaagccggcgtgccagggacttgtgtcctggcgcggcccgtctccggcacatacgcacttggctatacttgccatccccccttgttttttttcctcttccaatacaatgtaggaggagtacgtatgggcgtatggcatatgtatcgcgtatcggggtgatccggtgaactgtaccgcgagattgtgcggcgccctgtgttcatcggaaaatcgcgcgcctttccaaagaaagcagaacaattcgataccgtgtgcttgtttgtcgcatgcttttatagttatagtactatttagttcccggcccgcacaagttccgtgcatcgtactagcagtagcaggcaggtgtaaccttgtaaggtgtgtcgattttgtagtacaatttacagcatgcatggacggcgttgacgccagaaaggacagatatatcacgatagcagtgtggtccgagttggttattttcacatttttagcgtgcgggttaagtaattcctccagattcaaatactggattacttgttaacaaaatgtatataaacacctaatatattttatttagaccaatagtatgtttgtatgtaaaaacggatattgattcatgtgctaggccgctagggtggttaactcccggaaggggaccgaggcatacgatagttaggggtctctctgatatgatattatttcggccgaaattttttgtttttaaattttttcgtgaattttggtaatatttgttcaaattcaactaaattctcattaaaatttcggaccaaaatttctaaaatttcggaaatttcggtatttcgatgaggtccgatcaaatcggctaaaccgaaaggtttaaccctgactatagtacgacacatatgcttttcgtttttggggtgagaaggagggtggatgaacgactctacatttaagtattagagaaaagtgtatggctattaatatttaaactttgaacactcgtattattttgaaaattataaattcctaaactttaagtaattgtataagtactcaaacgtatgctatatcaacaaaatatgttgcatccttaatatagtcgtaaaactttattatctaatcattcaaaatttaattactttatcaattgtcaaagttaacaaccgtactagtcacagtaacaaatattttaaaccagtcgagtatattttactatagctagtggacatttccttataattttgtaatacacatatacaatcactctaatgtaagatgaataattgcatagaagtatagaacgtcataaggtaacaaatgaacaccctcgtcaatcatcaatttgtcgcctcacataaaaatagaccgtcaacaaagaaaatccaatatacttacgaaagttaagtatactgttagttttcaaacttatagtgttgtgccatctcagtacttaaagtctaaaaatacaaaactttcctcctaaatttgttaatgtgaaatgcaagatctaagggcatgtacaatatagaccacagacaccagtggtttcaagaaccaaacaaaggtcatactacctacaatggaaactagtacaaaatatattttgcatttcagcccctatatttatatgacaatccttatagtgtatgttagtatcaaacctattaaaaactttatccctataacaaccaaaagaaatacatatgcacccctaaatactatggatccgttgtctgcctcttccccctctcttttttattctctctctctccctagacatctcgtcgccttcttctccacgagaccatcggcgctttcctcccagtccaccctgctggcgagacccctcccctcccagtgacctcgccagcgagaccccttccctcccagtccctcacgccaccgcgagctccccatctcccatctccttctctctagacgagatgagggcgacgagatcggtggtgcttgagctctccggcgatgagagagagttgggcggcggatttgccaatgagcggcgacgcgaccacaacggcggcgacggttcctctccccctcccttctttgcaagcgtcggcgacggtgcttctccggccatgagcttaccggatccggcggtggggagcagcaatggcggcggatctggcaagtggcaacgcgaccacaatggcggcagtgagcggcgacgacgaccatgacgagatggggatttggggtaggtgcacgaggggaccgatcgaatgagacgacgcgcggggctccgactcctctaacgtgagtcttcgagctgtggcttcgcggctctcgagcccaggtgcgacgcttcaagcgttccctctgcaagcgcatttccagcctgcggaaccacgcattcggctgccagctcggcttggctccgacatggagccgtgaaaccacaggacagagtgaagtgttgtacatggcctaatgtggcttaccacctactccctccgtccaaaaaaaaactcaattcctagagtttgaattttatcccacaaaaaacctacttctaccctcctaccttctctcatcacgtaaaacgagaagttttattcctttaataccctttacctacctatcactcttactacttttttcaatgattaagggcattttagtcattctcactctccactaattccatctactaggagtgctaggaattgactctttgtaggatggatggagtagaccatttctcatctcgatctctcctcgctcccatggagcaatagcatcggctaaccaaagtagagtagagcacttcaggaaggcaaaatggttgtcggtagacactgaccatggccctgttttgaagattagcctcaggctaattttgagaactaatgtttagtcttgaattggtaggctaaacattagcctagggtgatatgtttgaatccataggctaattgagggctaaaaggtggagagagagtaaagagagaggagagagagagggagatatggctgctttttgatggtccccacaaaaaattagccccattagcaccccttggaggggctaatgttttgagggggactaattcactttagccccaaattagcctacatgtttgtatccttaagggctaatttagagctaaaaggtgggggctaatttagagctaaaaggtgggggctaataattagccgatgtaaccaaacagggcccatatcgtgcatgacagtaagataagattaccaatggtaaaatgagtcaaagtgggacctagccaaggaaaagtgttttcataaggagatatcttctcgttttgtacgtgtcacctaaatagttatttttaaaaaaaaatcacaagatagattaatataaaatatattacttcacagacatgcaaggccaaatttaattttcaaaaactgtaacaaaaataacaaatataactgcaaacatactataacaattttcagtttaattggttctttttgttgcaacttgtagaaatcgattttggccttacatgtttgtgaagtgatatatttcatattaatttatattattattttttaaaaaaaaattaataactatttagataacatgcaagcaaagagggggcatcctcacgagggatgaaaatccacatctaactagccacagcagtaatcaaaaggtgaatctcttttaaaatattttacaatattttctttttaaaaatattttaaaatattagaggggcttgatatgcatgttaagtttaaagttgggggtgacaccaggtacaagtttaaagacaaacaccgtgctttaatttgattataaagtttcaatgcaagtctatctcctattcacattttaggaggagtgttgaggagaaattctgaaataataaaacccacatcgtagaaacacgatcagacgctggcaaacacgactcgaacaaaatatctagctgtagaaacacgaaatatcccatgaaaaacacaagccagtgtcaaatttaaacgcacaggtccactcacgtccacatgggcgaagccgcaggtacgagctggacagagcctgacccggacggcgacgcaacgagacgacgtagaaccgtacaccccaccgctaaccccttccctccacgtgtcccctcctctcccctaccgacctctacccactcttagtgcacccacaatagttatctataaactctctacaagaaatccatgtcagtatattttcctatttggaaggtattaaatgaagagagagagcaaaactatctactaacttagagatagtctatagagaaaaacaaggcaatgcataagagagctatagatactgacggagcgtggggctcctcaccgggagaccgcgcagacccccctttgccggttcggccggggaccctgggtgagactctaagctcccaatctgtggaaggttcgcgagacaggaagcacacaagacgccggcgatgtatacaggttcgggccgctgagaagcgtaataccctactcctgtgttttgggagatctgtgtatgaaggagctacaaagtatgagccagcctctccctcgttctaggttcccaatctggaaaagtcccccccaaaaaatcatgccttctaagtgggcaaggtcctcttttatatcttaaggggataccacatgcaccatttttccctctctgtggggacttaccctaccttttcataaatggacggagatttgcatggttgccgttcgagtcaccttctgatgggacggcccgcacctacctccactttcgccgggagcaggcgcgacgcgga

SEQ ID NO: 7092 - DNA, 62073 bp, Oryza sativa
cctaacccatacacgcggagcaaaaaacccacgaggggtcggggcgcctcggccctcggggccgaggcgggtgcagcccgacccctcggggagacaaagagaagggcggccgtatcaccctcgggcccgacccccccgagggggttaggccacgtgggtgatcgcgtctgcctcaagtctctaagtcatgatactcccggtcccatgtcaccgacagtagcccccggcgttatgccagggcgatcgccctcctcgagggaagcggtcgggcgtgacgccacttctaaggcctggtgacaggtggggccggttcctgcaggtgccgtcgaactacatcacccagagggcggtgtgaggcagctgctatgggctcgagctggcctcgggggcggagacgagctcgggagctggggtccactccgccacaaagtcggcgagggcctggctcttgatcgcgtggcttggttcaaagcgcaaatcgaattcagagagttcgattgcccatttcaccacccgtccagtaccctctcggttatataagatttggccgaggggataagacgtaaccaccgtgacccgatgcgcctggaaataatggcgcaacttcctcgaagttatcagaatagcgtaaagcattttctgggcctgagggtatcgggtcttggcatcccggagggcctcactaacaaagtagacgggccgctgcacctttcggtggggccgatcctcttcgctaggggccgcatccctggggcgctcttcacccaagcggcctcgcggggcgcactcgtcttctgtgccgatgacctcggggtcggaggacgacaggggcggccttcccacagtggcctcggggccgtcctgggggtcgggggcgcctggcaccatcggacaagcaggcggagggccagctccggccgtcgggggccttgggccgccgttcggctcgggggcctctcctccctgctctctctttcttcgggcagaatcccggcggtcgcaaatcgcgcgtatcagcaagggaaaaccgaccgacaataatgagcggcccctcggctcgcgtttgccttcaactccgacgaggagtgcggtgacaacggtgcggacgacagcgacggcgaggccggctacccgggcgcgtcggagtgagcccccaggcctccgccaatcttaatagcttttccttcttcttccgaggccttcgggcccccttcttgttataggctgatttaatctgcaatcaaataaagaggaaattttttgtgtcaattctatttgttgtgtgtatgagacgaggatgcctgtgccgcggtccttttgtgtcttggtttgaacaagggctcgtgccctggtcctagtcctcaaatggctcgggtcggggctagtgcctggggagatccacatgtcgagactggccaggccgggaacgtggtgaccgagggttatgggtgacccgattgtgggtttttgccgattcccccccggagttcaccacgccctggggcacggctcggttctgggccccgtttggcgattttagccgacccgagcccccgagggcaggattgaacacgagtgacctatttcaagtcaagattcttcaaaaggaaacaacagcacagatacagcctttaggaaatcgaaaatgcttttattgaaatacggaagagaaaaaaaagaaaaggccccggccaaccctgcacgcccgaggggggtgcggggttggcccgagtccgaaacctgacacccgatccccctttaggggtagaagcgacgaaggtgttcgatgttccacgggttaggcagctctgtgccgtcacccgtggccagccgaacggagcccggccgggggacgccgatcactcgatatggaccctcccacattggtgagagtttgctcagtccagcacgcgtttggacacggcgtaggacgaggtcgtcgacgcagagtgatcgggcccggacgtggcgctgatggtagcgtcgcaggctctgctggtagcgcgcggctcgaagggccgcgcgccaccttcgctcttccaagtagccgaggtcagggagcgtcggcttccttctttttgtcgctcgcaggcctcccctttcgggtggccagcgaaacgccttcgacggcgaggacatgaccctcgtcgtcggaatgggccgacctcttcttcctcctcctgtcccgccgccctgaccgagcggcggacccggggacggccgaagctgccacaccggaatcggaggggttccaagtccaggcctcctccttgcgagccactcagtccgcgagctgaaaaagctccgcggtagtctggggctccttggaggcgatcttttcgagcatgcggttgtgccgcacgccctccctgaacgcgtagattaccgcgtgtgcagggatgcatggtatggtgttgcggacttgacagaaccgctgaatgtacgatcgaagtgactcatcgtcccttcgctgtactgcgtgcaagtccgcttcctcaccggggcgcggatatgtgccttggaagttcatggtgaactgttggcacaaatcctcccaagagtggacagacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctccatcatatttttcggcgatggtgggccggaaccttgggggccaacggacattccgaaggctcgccacaaaggctctacagccgacaccaccaaccgggggcacggagggctgatccccgcgtccgtggtgaggtgacactctggacgaggaagcgccctccgttgtgtgggcagcacgtcggtcattacgccggcgctcgatgctggtgcgggcgtccggccccccacgcagatcttcccgggtcgaaggagtcgacgtaggagtggcggccgaatggcgaacagcggctgccgctcgtcgtgcccttcgtcttgacgacgcggagccggtggtagcagcaccagaggccttggtggcggaggaccgcccaccagcatctaggcgctgccttgcagtcatgaccaatttggccacatcgtccagccaacgttgggctggagactccgggtcatgggcgacgggcgggtgacgtaggagcgcgcctgcagcttggagcgcgccctggggcgtgctgccgtcgcggtagacgaggagacgacgctccccatctcgccgcccttcttcacctcctgtggatgtcgaagtcgcggatccttcagccctctcgagcgccttttcccgcctaggactttggcgtggagggggcggtggagtacgagctcgacggcgtgggtttggctccccgtcgtcaccgctcatactcggggagaggtcgcgcgcctttgctggctcggccattgggctgaacaggaaaagcttggcgcacacgaaggagtgcgagagctcagaagatcactcgcagagtcccctacctggcgcgccagatgacggagcgtggggctcctcaccgggagaccgcgcaggcccccctttgccggttcggccggggaccctgggtgagactctaagctcccaatctgtggaaggttcgcgagacaggaagcacacaagacgccggcgatgtatacaggttcgggccgctgagaagcgtaataccctactcctgtgttttgggagatctgtgtatgaaggagctacaaagtatgagccagcctctccctcgttctaggttcccaatctggaaaagtcccccccaaaaaatcatcccttctaagtgggcaaggtcctccttttatatcttaaggggataccacatgcaccatttttccctctctgtggggacttaccctaccttttcataaatggacggagatttgcatggttgccgttcgagtcaccttctgatgggacggcccgcacctacctccactttcgccgggagcaggcgcgacgcggaatcatggctgtctgctgacgacatgaccggtgtcagactggtcacaaatcggtcattcttgtccaccacgcgtcagctcagcaatctgcacgttggcccttcttcacacaacatcttgcctgtaatggttagggtgaagcctggcatatatctgaccaggactaacgtgccatctctgggaggtaacacgctagctccagctggggacgagcgcctagaagccctcgtcctgacgggatggggcgaggcgtgcgtcagaccgcctgtcgccacctaacccgcgatctgaccggtctgtgactggtcacagaccggataaatgagtgcactgcactgcgttacatgcggcgtgacacgctcagccaaaccgcaataaatgtggttaggtgagccccactgtgctcacctaacccatacacgcggagcaaaaaacccacgaggggtcggggcgcctcggccccgggtgcagcccgacccctcggggagacaaagagaagggcggccgtatcaccctcgggcccgacccccccgagggggttaggccacgtgggtgatcgcgtctgcctcaagtctctaagtcatgatactcccggtcccatgtcaccgacagataccaatgtagatatactattaatgtggtttcctattaatcgaatctattgctaagatgtatatgttttatagagagcaccttactttaccattttccattgcggttactcttatctctccacggatccgcgctcaggccacgtcgacacggtcccccaccccctccgcaccccgcacacagccgagccgagtgaaccgaaccgcggctcgctcgcgcctcgcctcgtttacgtgtcgccccgcccatcccgcgcgccgaacagcaaacaccgccgcggctactagcgcctcgcccaactcgtggcgcgcggtgaagcctcccagctcgcgaccgcccggtggacgcgtcccagcctcgacacgcgtccgggcggcacgtaccggccacgggcgcgcgtcacgtggagccgcatccaacggcccccggcgcgatcacacaactgtacgtgtggcccgcgcccgccgcgtggcacgtcgcctctcccacccccaccccttcccccacccacttttatatcgccggccgctacttgccatcacctcttctcaatcgctctcaccgcttcgaggagagaaaacatttcttgcttgacgagctgagctgagctgagcagaggagctcccaccttctctccctctgttgcaagggatctttcggagattttgttagttcatggcggagatttgctgcgaggttgtggctggatcgtcgtcggaggggaagggcccggagtgcgacaccgggagccgagcggcgaggcggcggcggatggagatccggcggctcagggtggtcgcggagcgtggggcggaggaggagacctccgggaagaggcggaggcttgatggcggcgggggagaggcctcgacggacgaggaggacagggaggtggagcgcgctaggtacggctttacgtcggtgtgcggacgccggagggacatggaggactccgtctccgcctgcccggggttcctccccggccaccacttcttcggggtgttcgacggccacggctgctctcatgtgcgtgccttgctctctttgctcgagttgtttaatcgaacacctttttgatggtgtcaatagatctatgcgccgaaacgcgcggcgcgcgcatgtgcggcggttttgactcggagagtagtacttattggaatggtttgcatgtgcatgcaggtggcgacgtcgtgcgggcagcggatgcacgagatcgtggtcgacgaggccggcgccgccgctgggtcggcggggttggacgaggaggcgcggtggaggggcgtcatggagaggagcttcgcgcggatggacgcggaggccgtggcctcgtcacgggggagcgtcgccccggcccccacctgccggtgcgagatgcagctgcccaagtgcgaccacgtcggctcaacggccgtcgtcgccgttctgggccctcgccacgtcgtcgtcgccaactgcggcgactcgcgcgccgtcctctgccgcggtggcgccgccatacccctctcatgcgaccataaggtatggggatgtgtgcgtacacatggtcaaccaaaaaaaatctaagtttttcttactttaatcgcgttgctctaaacgtatctgctctgatcgattcagccggaccggcccgacgagctcgaacggatccacgcggcgggagggcgcgtcatcttctgggacggcgcccgcgtctttggcatgctcgccatgtcacgagccatcggtgagctctctactctagtacttttgaaaatctctcgctatgacacaaaagaaacaagcgccatgtgctgactgtttacatggatgcgccattgcaggggacagctatttgaagccgtacgtgatatgcgacccggaggtgagggtgatggagaggaaggacggcgaggacgagttcctcatcctggccagcgacggcctgtgggacgtggtgagcaacgaggttgcctgcaacgtcgtgcgcgcctgcctgcggagcagcgggcggcgcgagaggaaccggtcgagcccgacgtccaacctaagcccgaggcagagcagcagcagcggcgacgaggcgcccaacgacggtgctccttccgccgccgctggctcggagagcgacgaggagagcgccgccgaggaggacaaggcgtgcgccgaggcggccgtcctgctgaccaagctggctttggcgcggcaaacctcggacaatgtcagcgtcgtcgtcgtaaatctcaggcgccggaaattgtgacaagtggatccatcagacatactactcctctcggtttcctggccatctctaactcgaattcacctggacgaagccgtgatcaaacagaacgttccgaattatgtgatcaaacagaatgtggcatcctcaaagcatataattgcagattattatagcattatttcgttcacttcctttctttgggcgtttgtgatctcgtcagacagatcagcccgctccttatttcagcaaaaaaagctcatgtgtttccgatgtttgaagagaaacttcctcaagcgtcagagaaattgtagtataattgagtgtcccctttgctcgtggaaatataaagaagttcctactttgctctgactagattactagattgcgacacactgctgtgttcatgcgtttatagttaaattatttccgttcatcctgatgattgtgcaaacgtattagacgtgttgggcaaccgaatcgcttgtgccgtctcgattagtcaattaataacaccccacagatgttcctctcttcttgccgtttccgaaaagctccgattttaaattcagtttggaacgggtagaacacataggcttcaacacacatacaatatacgtgtgcttttcgcacgctaaactcaaaaaacgtatcattatcatagtgtcgttggtgtcgtgttcccctatttgatgatcatgatgcgggctttcgtggtcgctgaaaagtccttgctggtgggtgaaccgtgcagtggtgtgagtcaacaaacacgcgagcctaagattagcaaccaaactaatagtggacacgaggcacgcagccgtgctacgacgacttgacgagcaggcgaacacaggagagaaaaatgaaaaagaaaagaaaagatgggtgaaatgaaatcacgttttcaggaagccgaatgccatctgtcgcgtggtcctctgtttggccgatatggctacgatcgcatcgaagattctctctccggattgtgcattgtttgattgggacggcatttatcatctcgcgccacgtaagggggccgtcctcggctgggacttttcggttctattcgttcttccttttttttttcttcctctatctctttctgacgatgccgatgctgtacttttcgtccctctagtggaaggtagctgtgtcgtcgtcgtgtgttacacacaggtcgcgcagtgtaacctggctcctgcctgctggatcgtcccggggccttttggcttttacctcccctaatgctttccgtgttggaaatcaaatgcaaatagtttatgaatatagtcaaagtaaaataacatggttttgcccaacccaccatggtcggctatacgaggagaactccaaagcatccctaatttggaaacaggaacatgtcggaagtaatgcgcggttcaagaaagtgcacgaaagtgcagcattaaccatccatacttgatccttcatagtattgaactaaccaaaattccgataaaaaaaatcgcataaactgcagagaattcacccgtcagtctgtcaaagccggagcagttagtttcagaagcattagaaacccaaggacgcatcctacgtttctcgccccactttgcttcgcggcgtggactctacaattcgttccccgtgaaacacgagtgcttgcgtaactctcccagatcagccacaataataagcatatacacgctcctaaccttactcttacactgcaagtctggtaccctgtccacctgccctgctgtcattgcacacgccttcagaagttcaggaaaaaaaaaagagcacaaaaacgagcaaagctagcgttatctgcggtgcagcggcaaactactcaggccgcagaaccagagatgccaaaccgagagctttcgcaccatgcaaagcacgtcagaggtcacttgcaacccagctcggcattcaacattctgatctcaactctgttccactcgtcgttttgacagcgatgagaagagcaaataaaaacgtagcaaaaagtagcccctttattgggggaaagggataatggctttgggtagacagcagaatcggttcgacctcaacgaaggccaaaaaaaatggtgataagccttcgcactgggatggcgactcggtgagtagcgagtcattcgcgttgggatctcgcgacataattgggcggtcctgcgaatccaactggggtagtattctcgttacaggattgctggagcatgagtatgacagggcatttgtccccgtcatgagtcgttcaacggggccgaaatagttggtccatctcatgaggcctcgaaggcccaagatagaagtttactgttcacatattgttaggccgtccatgggctgtcagattatattttgggggaataagttcactatgtgaccctcgaaagtgatcgaaatataatccgtgaccctaaaccacaaaaccgaatatctcgacccccaactcttaaaaccggtacaatttgactccctcggcggttttggagggcggtttcgctgacatggcgtctacgtagcgatgttgactcagtctgcggtccacgtggagttgacgtggcgcttatgtgttatagaattaaaaaaaatatgtgcgggtccatttgtcattcacaccaaaataatgtgagacccactgatatgtggagcccgcatgtcattcctgtttccttcctccctttttctcccttctctctctttctctttctcccatttctcttcgtcttgtctgcaggcggcggcaagcgctcgagggtccaagcggccgcagtggcgagcaggaagggaggcggcgatccggtggcagctcggcggcagcagaggcgtgcgacccacagggagaattgctgcattccacaaccaaattccaatgaaaaaccaattatggcacaagatatggattaccagtgaaagctacttaacgagattgagcatcgcgtcgttgattctaagtacctcgagtccaagaatatggaaatcaactcttccaggctcaccggcgatgcccgccatgaatcaacctacgaacatgtgaaatcctctcatttcacggcgtgcccaaaatggcaaggcacagcacgagccaatagcgccataaactcgagcttggcctcagactggagcgtcgtgagcacgcgggggaagttgctggactcaaggaatgcggcgaccgtggccaccatagtgggcctcgtcgtcgcgtcggggacggcggcggcagcgagcctttggaggacgaattggtcttgctcttctccttcctcgagtccttcgtggctccctctttcgtctacgtcgctgatgccgccgagccgccgccgggttgctgcctctcctcccgctcaccgccgcggccgcttggacccttgagcgcccgccgccgcctgcagacgaagacgaagagatatgggagagagagagaagggagagaaagggaggaggaagaggaagaaggaaacatgaatgacatgtgggccccacatgtcagtgggtcccacattgttttggtgtgaatgacaaataggtaccgcacatatttttttaattctagaacacataagcaccacgtctaactccacgtggaccgaagactaagtcaacatcgccacgtaggcgtcatgtcagtgaaaccgcccttcaaaaccgtcgaggaagtcaaattgtaccggtttcaagagttgggggatcgagatatccgtattttgtagtttttgataacggattagattctcgtcacaaagtgaacttattcctattttggggggaagttgggctgtcagatttagacgtatcatatgctatgatcttctccaacaccaacatggtaatttttctgcagatcaatctcttgaatccttgatgctcagcaaaaactagtccgcctacgacagtcatgtaccttgtgtcttgtagcattggtgatggggtagtatgcaccgttcgaactgcttttcaagttttggattaaagtggcacgtttttcaaactgttaaacggcgtgtttcacgcgaaaacttatatgaaagttgttataaaatatcagattaatcaattttttaagtttataatagttaaaacttaattaatcacacgttactatcacctcgttttacgtgaaacacttcatctttattattaggagattcaaacaccacctatatcttgcacacgctgctccgcagcgacatggcgagcactatcgagtggtgcgtccctcgtctccgtttggactgaattggtccggactgaatgcaagagcatcagctggaagagttagatttctttgacctgagcattcaaaggatctagcccttgcagctggggaaaaaaaggataaaatcgagtactatagtattttcagtaagccctttgtaaagctgtcatcactggcacagtacttgcatcgatctggaaccataaaaatctcccaactgtgacaatgggttgccactgctgtaccaacccgctgcttcttcacgcaagctgtgtttcacggcgccgacttcctaaaccgcaaccgcgaagcgctataaacgctgcttcgcccacgtacgagacgtgcacgatgcacacctgatctgaaatctgaaaccgatcaacggagtaatggaagggctcctgccgttcgtgtacagggcgatcgtgcacaagagggacggccaccgcgccatcggcaacccgttcctgaacgacgatccggcggcggcggccaccgcgtacaagaggctcgccacctgcgactccggaacctactcccggcccgccacaaccgtggatgcgccgtttctcggcggggcagtagtcacggtacactcgccgcgttggctgccggcagcagtggcagccggcaacggcacactgtcccctcgccatcaccgcccgtccgctcggtcgtgaatggacggcagacggagcacgctcttcggatttcgtgaattgtctttcgacttttgcgctgcttacaacgcgagtttgtgcgtgtaatgtgtttgtctttcacctctgttctttcagcttcttggtttggtctttccaaaagggaaaatatactgcgtgaaggttgtttactggcttctttgtggggattgcgctccatgtgcaaccggcaaaccatatagatcttccttccaaatttcttggtaaagttctgcctgttctggggaaaagcgatcgagtaggggaaaatgactattctcgatcatgattggtcaaaaagggcccatttgtttaaggcgcccccaaaattatggatctgaaaacaactgggccctttttttcattgttcgattgtctggtcccctcaagaaatttggccaagtaaattggaactaagacctaccacacacttatcctaaaatataataacctagtaataaattatatatattgtagattataaatttgaacaaattcgattgtggggctgtccatattcgtagtacctttgtccagaatcgtagtactggattgacaatccaaatttgtagtattatggcatgtcgaatccaatatacttcttccgtcctcaaatatttattattttagatagtttagcatatatattaaggtttaagaaaaaaaaagataatagtcccttattagaatgatgtatggttggaagtggagtgatggttgagagtagaataggaaaaagtttaaatgaaagatgatagacgggacaagcaacactttagagtgataagtattttatgataaattttgaatcaattttgggacgagtactactgtacgtacgacccagttgtacaactcatgtataattagagatatgcaactatagatcaatcaaaggagagcatgtttcatatgcactgtaactgtttacaaccattgattaaatgcaatcgtatgtgagtcgaacaattagattgtatgcatagtaatttccttttgggaccaaggtaaataggttgtcatagtttttgagatagagggagtatatgattatgcatggtacttatgatggaggattggagggtgccacactgccaatctctacccgggagttctttggtgcctccagtaattcttaggtgtatgtaagattttgtgtgggggcggacggatccatcttttcgctcgccctctccctctccaatccaaagacatggattgagccacgtgtagttgagtcgttgtactcccgttttaccctcatggagttatttttgttgtaggcatgttgtgtggctgtgtttttttcttgattatagcctcctagggctatggtcctagaattttcttctgttgtatcaatatgaaacattgcactatattgagtggttcatttaaaaaaagttagatatgtcatgcgtatatgctgtgtgtatattacctaacaaaaatttagttcacacgtctgaattgtgctaaaaagaaaaggagatctgaatgtttagatcgaataagtgctgaaccatgaagagctcagaaaagaaaattgaggcaaaggagctcggaaaatttggaggagcaatttatcgactgaagactatagtgccattatcatccagctgaatttgcttcttactctcccatcggccatcacgaaagatagaaactctgacaaaatgacaactcacaagttgcaagttgcacggatcagataaacaatgtacatgactacaatatacaaacggtattcaacaacaaccgaaatatacatatgaacagattgacaggtcatcatacattacattactcttatgttgccaggagtatcaaccgacagcccaaccgacaaattaagaaggcctcagtgttttcacctagctaatggacaagctgaacttcccccagaatgaaaatcgaacaggatgattgagacttgatagcactgtcgatgaggcctacgtataaatctagaatgcgcaccatgaatgttctgtattgaaacatgaaatttttacacttaaccatcatcacatgaactgatactctgatagaaatcagacactagtacacggcaataacaaacgagataggagtactactaacttgtgatcagcgcactaaatgctggtcctgattgctgtgcagtccattaggtgcacaagaagatgcaaaactcagatgtgtcggtgacgttcttgattattgctcaagcagcactgtctgctgcacctcgggctgaatcaggttggtattatgatattatctaatcagatcatgtgacactctgactatgaacttgcacagatgtgatataggatcatgggattaacaaactaattctgtattatttattaagttctttcaattttccgtactgcaagcagggaaatcttgattctttaatcagcgcttaaatcatgatccaggccgaaatcagagcttaaatcaagtactcctggtattatgcaatagtactagattagttattcaggtcttgtcagaattaagacagctaatacgaatgaacgatgcgttcttccattttggagtactgctgttgcatacagtatatagctggtacttggaacgtcgataactaaatggttgttcagattgtagctaaaataaatcttatcaaaatttattaatatcaaatttttgacaggatttcttatgcgttatcaaaatttggctaaaaactaaatgcaaacacatctttaacaactttataaaaaaaaaggtatagttagaaatgccatcaatctgaacatactctaaaagcgttaatttacaggtaactctatttactgcattgttctctttttgacatgatccagctgcagcatgatttatttgtgtaccacttaaaggagggcgcgcttgtgtgattctgtggcaattcattccgtactcccactcaaaggcagatggacagttcattttcaacagaagtgggcagatgcacaaatgtacaacaagcaggtacatgaacatcataagcatttgctgcattagtggtttgtgtagcgtaagaaattattgagctctgtgcaatattgcttccaattgtacaagttgaagaatgcatcaaccgctgaagctagccaggtcaaacatgtagtagcactagcacatgaagaaaagatcgtgcttttttacaatgggacggtacccgttcgttgacctaggaaacggtgtcaagttctgagatctttggtcctgatgttggcctggctactccatacgagtagaggtgaacgacctgttcgtgcccttataggcttgtagtacctaccaacaatgtataaaacgtctaaatttgattcagaaaaaaatgagaaaaaaaaggggcaaaaggccatgtgccagatgatctctcggcttgacggggttggcgtgccaccgagaaatgtggcggctggcccactggccatggagccaagccccgcccaccaaaacacgtcgaaaccacgcgcggcggcgaggagaaaagcggagaagccacgtcaagtcgtctcccgcccggtcgtctcgccatcgtcggaggagccttcttccaccgtgccatccgcccaaaaacgcgcctaaaaaccaagtactaacgctaaccgtcgcctttaccgattatccggttctttactaacacaaaagcacagtgctcacgataaagttatcatggcaaaacatgtgttggatgaaggggtgacacctgatacctggtggcccgcatgtcatacacacactgtacaggagctggtgggccacctgttgtttaattattgttatggataaacaaatgggctgtgattaagccgggacagcaaatccagtggtaaaaaacaaaaagatgacataataaagaagagataaaaggaagaaggaaagagatgagatggcaggtcgcaacctcgcagggattgattaggatcgaaacttgtgttaaacacgtcaacttcatgcatctgctggaggggagagaggccatcggaggcgggtgaaggcaaagcagtgctactagtacaaagagcgcccgcgtcgctggcagccgctctgcgacgcggccgacgctgtcttcttcctcgtcatcaatcatcttcccccctctctctctctctctctttctctgacttcttctttctcaattcccgccaccccggcacgcccgctctcctctgctcggcgcaagttcttcggctgcctcaaggtgcgtacaccacgcccgagtctctgctctgttttttacttgctatgcatctctgttcgtagcttatcgatgtcgagtcaccatgacacctgttccgtgctcgtgccgttagagttagcaatgggaatatgggatgcgaatggcaattccgttggtagagatcgagaaaggcgagatctttcttgccgcggcgcgcgcaggcagcgcccacagacaagagctagcagagcggcagagaaggccagcacccagatctgcaatgggtggtagccccaccgctcattcctttctccttaatttcgctcccctccttcgttttttttttccctttttctcgtccttctctcgcgtgtcccggtcggagggtgggggcgtgccggcgcggcgcggcgtgggtgctcgatggccgcgaccactccgtcatctctatctcgtctctcctcatcatggatccagccatggagaagaaccccacaaaagtcatacaggagagatagatagagtcgtctcttcgtgctggctcgagatctattattggctagcaggttggtttttcggtgggaagcagagtggttcaatacaagcggacaacgacgcgttcatcggcaaggttaggtggatggatagattaggaggcgggccgccatatctctcctgacgcctgcaatttgccgtcttcctcgttacctacccgatcaagagagatcatcattccctctccatctcccctctttttccgcacggggtttggagagatcagccgatcaggtcgccgatccttatcccaatgccgtctttcagtccgatttctactgtatacgcacgcgtatcgcgttcttgctacctgtactttcagaattctgccgcttctgcagcggctgcagcggcgcagatgccatgacatgggtgctgtcctgggacacatcacacatggcatctgcgtactagacagggcggatgggtcttggagttcaggggcatgtcccgactcccgcactgtggcctccgtgatcacgcgggcattaagcgggttctggattagatcagatcagatcgtctcatcgttcttatgctgcttgctgcatttttcgcagggtgaggaggagctgagttagcagggctgcgaccatgaaggcgctcattctcgtgggaggcttcggcactcgcctgcggccgctgactctcagcgtgccaaagccgctcgtcgatttcgggaacaagcccatgatcctgcatcaggtcagcacaaatactccaatctttttatctcacaatacagtcttttcagttcgtcaggcatgacaatagagtagttatggagaacttatttggggaaatggtaatgcaagatgaaaaatgtcagtttgttccattacccgagttggggataagatgtagacagttgatgttattggcctcacactctagtcatgtctcttatgatggatcgatccatatgagttgattcctcacaacagtagcatctatttgcatcactgaatttgttcattctagtcataaatagttgtgacaaattgatattacatccgtcccaaaataagtgcagtcgtagggaaccgtgtccgacgtttgaccgttcgtcttatttgaaaaatttataaaaaaattgaaaaaaaatagtcacacataaagtattattcatgttttatcatctaataacaataaaaatattaatcttaaaatttttttaaataagatgaatggtcaaaagttgaacatgaacagtgcaaaactgcacttattttaggacggagggagtagtaaacaattagtactccattttcctatcgaagtgaactaatattcgaccttttccatgtcccaatcaaagatctgattcagactggtatttagtcgttcttttcagaagaaaaaggacttgttgctacttgcactgatacatcatttctcgatgcatctttggactgattttacaatgcactgctcaccagatcgaagctctgaaagaagttggagttacagaagttgttctggccatcaattaccagcccgaggtaaactgacatatcatggcacatggggcgctgttgaacatcgtgcttctgtcggttgctgagatcttactgatgcacactgttttactttgccaaaatcataggtcatgcttaactttctcaaggacttcgagagcaagcttggtatcaagatcacctgctcgcaggagacagagccactcggaaccgccgggccgctggccctggcacgcgacaagctcgctgacggctccggcgaccctttcttcgtcctcaacagcgacgtgatcagcgagtacccattcgccgagctcatccagttccacaagtcccatggcggcgaggccacgatcatggtcaccaaggtatcacgagacaccgaagaatctggcattcgtggaaaaagtgtcagaccatcagtgcactgagaaatgttgctgcttgatgcaggttgacgagccttccaagtacggcgtggtggtcatggaggatgagaccgacaaggtggagcgcttcgtggagaagcccaaggtgttcgtcggcaacaagatcaacgccggcatctacctgctcaacccgtcggtgctggaccgcatcgagctgaagcccacgtccatcgagaaggaggtgttcccgcgcatcgccgcggacaatggcctgttcgccatggtcctgcctgggttctggatggacatcgggcagccgagggactacatcaccgggctgaggctgtacctcgactcgcttaggaagaaggcgcccgccaagctcgcgtcgggcgcgcacgtcctgggcaacgtgctcgtccacgagaccgccgtcatcggcgagggttgcctgatcgggccggacgtcgccgttggccccgggtgcgtggtggaggccggggtgaggctgtcccggtgcacggtgatgcgcggcgcccgcgtcaagaagcacgcgtgcatctccagcagcatcatcgggtggcactccaccgtcggcatgtgggcgcgcgtcgagaacatgaccatcctcggcgaggacgtgcacgtctgcgacgaggtctacagcaacggcggcgtggtgctcccgcacaaggagatcaagtccagcatcctcaagcccgagattgtcatgtgacaaggcgaggcgaggcgaaggattaatctgcgcgtctttcgtttacatggtggtgacgatgctaagtgcgtcggaagaagggggccattatgtgcttgatatgtttgttgtttgatttgttcctgaactgtctctgaaactggaagtgtaacatgttgtcccaagtagtatgtgtcatcaggctatatggttgaatgagtccaagtttcagtctttgcttgtagataggtgtcacatgaatggaaaaaaaaacaaaaaaaggcagttctttttgtctaaacatggtatcataaagtgcgtgtgcatttctgtgttcttgtttcattacaagagggagagagtttcttcatcatggactttgcataactttttgagaacgactttgcataactggattgttttttctctcttctcctatgtgactttcagtccatttaccaaacctcaagctcttctggctcttgcagtaccttgctttcagagtcagactcagcattagagtactattacctgtttttgtcaatctcgaaacaatccagttaattaaggctacgagctttcatcgaacaacggatccttccatggcgactttaccgtacccaggttgttaaaacagccctatcatgacatggggtccatgagaccatgactttgtcacgttttcatcttggtggccctgatgcagaagtttcttatttgttgaaaggaaaaggacagcgatgaatgcttatgatccaagatctcgatgttggcaaggaagcagatgatggtggtggtgtgcagtgtacatgccactaacactgctggataattaattccctcaccacaattaacagaaggacgctgttctttcaagcacatgtcttcaccagaaactttcttttatcagcttccaaccgcagcgtgtttcagttttacagctagacttccatggccagcgctcaattgattctccctcaacaactcctcaaagctcctaggattcctagcttccccatctgagcatgaaacagaaaacaagagttttagtactccacctggcaaaattctctagtagtagtaaattcagaatctgcagacacttgagcttaaaaagggctttgctactatggcatgtttagaaaatgggttatgaaaatgtcatccaatgccaccctatgaatgaaaacttttaatcttagccatccatttatctcacctccaaagaaaaacgaagacgaaagattttggaaaaatacatagtagaatttgttgtgtctcggatacgaagatatcaaataggatttcatcacaatctttcgttcatttccattttcaattccactctttataacccattatccaaacacaccctcttgggttgttctgctgaagtcaaagaaatctagtcataattcggtatattttaattcaaaaatgtaacatgctaaatatggcatgtcaataaaaggataatctactgatagtacaaaacatgaacacgctaataacatgaatagcatcgtctagtaacatatttaacacaaaagtgaatataacaacatactcagagaacactccatatctagagacggtgttggtgttggggttgacgttggtgtcgatgttcctgccgttctccccagacatggtgatgccattctccccagacatggtgatgcagaggaagcaatggagacgtagcaaagcagtcgcgccgaataagcgctcccagaaacttgatcgcccgcctacttatgcaggtactccaactgacaaagttccggaggcttgctcgtcccgagtacccatgtgcgcaaatacccagaaaccgaggaaagcctgagttgcacaaaaacagaacaacaagagtctaccaacaaaaccgtggaaagcctgagctacacataaacaaaacaacagagtctacccaaggagaactagaaatggaaccaaagagacaaggaggaagatcttatctacctttgacctagaatataagtatttttggatcttgacataatttgtgagatactattttgaccaataatatctataaaagtaagattttttaaataaaagagttacatattatgatagtttgtttaatgataaatctagtaacatcaattttacatgattgattctttttttattttttctattaatagtcaaagtaaaaaatatttgactttacactattctaaaaatatttatattttggaacggagtgtgtatttaattcgaggtggtatactggtctcgttggttgttaaggtgatattaatattttaatattaattatagacccataaaatttattatgattaaattagacctagctaatttaattctaacaagaagtactttactttttgagttatccaaaactactgctagactgctactggttgctggatttcagaatgcgagatccaccgaacatagaggcaagaaaattctactccttattccataatataaacgtatgattttgccatagagcaacaactcactgctttgaagtttgctcaaatttgaaggaactcttgtagctttattgtttcgcttataccttccgaagtagattttgtgttttttacgtagtttattttatactatttgctttagaatcactaagtacatacacataaattttttacttatagataatttcttaatttgttgcgttcggcagctgaagaaaatgagtgagtttgtttcgatttccgtgcgtatgcttcccaaactactaaacggtgcatttttttacaaaaaatttctatagaaaagttgctttaaaaattcatataaatctatttttcaaatttaaaatagttaatactcaattaatcatgcgctaatagctcacctcgttttatgtatcttcccaatctcctcctcctcaaactcaacctaagtagtacgaacaaatacaagcacaaacgaaacgatagaagttatgtgttggaaaagataaaaaaaaaagatatgtgtcggagggcccaagagacagacaccgaatagatggagagacgaaagattcacgtctcattctaggcccaagcccaaccgcacggggaatctgggccctcatggcagattcctgcgggccccggtgccgttccgttggggatgactgcgaggtgcgagcggtgacggcaacctccacacccaacggccaaacctgaaacgccatccactccacggcaccaggctcccccttctccctcctctccgcctcctcccatccacatccgcggccgcgccgatcgcacaggtaaccagctcctcccctccccttcccctcgccgggttcctcccacccgcgcgctgtcctggaaccgcgattaggatctcgagctgggcgggttgagtttgaatcgccggtgggtagggttggaattagatcgatgctgcggtcatgctggatctctctgttttagccccccgagtgttcgtgaatcacggctgcatgttggtgggcgccgaattagatgctccctggattctctgtttttctttaaagaaaaaaatatccccaagagatgattcgattctccatgcgtatgggcgggataagggggaaaaatgatggcacggctttgcgggatgccggcattgttctttggccacttgtaatggtacgctttggcgatgtgatttaagggctggtggggtggtgcttgttggtcatttcagcagctttgtgcggtcggggtggtctcggtgccgatggcgaggaagcagcatatcgccatattcaccacggcgagcctgccatggatgactggaactgccgtcaaccccctcttccgagcggcctacctcgcgaaggccggggactgggaggttacgctggtggttccatggctttcgaagggggaccagctgctggtttatcctaacaagatgaaattcagtgtgcccggggagcaagaaggctatgtgcgacggtggctcgaggagcgaattgggctgctgccgaagtttgagataaaattctatcctggaaaggtaaagtaaaccaaaatttccaaagtactgtatagttctatctgatattatcatgatctaaatgtaatgtcaaagtgaatggcgtggtacggtttattgcttgtttgatatgatgcttctgattttcccatggttcgcaaaaattcatcacacagttgagtttaaattgcttggccatacagttgtacacactacacacgttgctcttagctcatgttagtgtcaaaactaaaatggagcaggattgtatgttctgattcttgttgagatttgagaagcaaatccaataaaccgtagaagttggttcttttttttaaaaaaatgcatgcatctagtaccttcaacacaagaattactagaaatatctatggtagtggagtgagcagaaaatgagacactgagtgttataaaacttgaaaggccagtataagttgagcgggtggtcatgtggttgatgttcttgtgatgtcataatgaggttgattgacatattttctccccatacagttctcaacggagaaaagaagcattctacctgctggggacatcacccagactgtatctgatgataaagcagacattgcagttcttgaagagccagagcatcttacatggtaccatcatggacgaaggtggaaaaacaaattcagaaaagttataggtgttgttcataccaactatttggagtatgtcaagagagagagaaatggatatatccatgcatttctcttaaaacatatcaattcctgggtcactgacatctactgccataaggttagcaccttcaatttctattatatttttctgggtttgcatgtttttgaagttcttttctattctattttgctggtttgcatatttttaaagtttttcagtagttcaactatgaacatctcaatttgcttcatataaccttataagtctcctgtctcagtaatacccttcatccttgatggcaaaatatgttcttaacatggatatgattctttgctctttggacgtatgtgacattgcctaacttctagaagttcattaccagctgttgtatgacattagtctatgaaatgaacagctgtgatatgcctccatcatgcatggaatcaccatgttcgcatagtgaccagataaatattgccattttttgaataaagttaaggatgttccacatattatgcacagtatgatgccgaatggcataaaaacctttgtaatgtatccatatttatttaaataatgagagcttgagaatttattcttatcaagttatggcattttccgtctataatttgatatgtaatcatgtgctttatttttatctttcattgttatttcttttgtaggttataagattatcagcagcaactcaggaagtcccaaggtcaatagtttgcaatgtccatggagtaaatccaaaatttattgaaattggtaaactgaagcatcagcagatatctcaaagagaacaagcattcttcaagggtgcatattatattggaaagatggtctggagtaaaggttatacagaactactccagctgcttcagaagcaccagaaggaattatctggtcttaagatggagctgtatggcagtggagaagattctgatgaggttaaagcatcagccgagaaactaaatcttgatgttcgagtctatcctggtcgtgaccatggagattccatatttcatgagtgagtacttagcagaaaagtaatggtttaaatgttattcacaagcaatttagctgctagattgtattttgggctatgtttttattagaagtgatttatgttattgatttacttatgatctaactgaattttgttatctccttttcagctacaaggttttcataaacccaagcaccacagatgtggtatgcacgacaactgcagaagctttggcgatggggaaaattgtgatatgtgcaaaccatccttcgaatgaattcttcaaaaggtttcctaactgccacatgtacaatactgagaaagagtttgtgagattgactatgaaagcattggctgaagagccaatcccactgtcagaggaactgagacatgagctttcctgggaggcagcaacagagagatttgtcagggttgctgatattgcaccaatcatgtctatcaagcagcattctccctctccccagtatttcatgtatatatctccagatgaactgaagaagaacatggaggaggcgtcggcattttttcataatgcgatttctgggtttgaaacggcccgttgtgtttttggtgccataccgaatactctgcagcctgatgaacagcaatgcaaggaacttggctggaggctccaggaatgacagtcatttcttcccacgctgttgtcaatgacaatagaatgccaactaacagcccagggaacttggcttggggaactaactacgtaacgcaattatcttttgctccaaaactacgaaggactgaacagacaagggtgattcttgttttctgctatggtggtacactggtattgcaattctccttcacaattgtggagtgtccatcagacatcagttactgtaatgcatcatatcttggaattgtaaatgtgcggcagttgaagtgattaccaatgctgtcttttcatgtagcctgtgtaatgtaaagcttactgttgcttcccgagtttggcacaattttaaagatatcttgtctggtgtttcacaaccatttttgttggcgtgctgctgctccttttccaattaaaaatgatcattgtatccttgtattcctgtcatcctgtgtgccacttgatagaaaataacttgccttctgggacttaggttttctatatgagagtagccgcaacagcggcaaagctgtgacgtgatgcgtcgtcttgcttgtggtagcaattgaccccccattcgacgcatcatggcatttttctgtcttcatccggtccgcaccaactacaccaaaaatatgccaaactgatttcaggagaaatccaacttacacaaagattcaatccaagcctagaatttcgcagctgccatgaccagattactattgctacacaaaatgtcaaattgttccatactcctgaatattactgaatattatgggacaattctgtgagaaaaaaagaaacaataaagcatgctagaacctccatactcatactcgtaaaagtaagttgtttaggacagtgacacggtctctaaaacacaattttgacttcttatttatataaaaaaatttattgagaagtgatatatgtatacttttatgaaagtatttttcaagacaaatctatacatataatttttacatttttcaaactcaacaacttgagagttattcatgatttatatttccaagggttgatttaaacattattgtaaacgacttacttactgtggggtagtacttaaaaacgttatgatgcagatactatatcgttttttcggccaaaataaatgggcacatcaggagaatcttgcaaaagacggaggaatctttataaaaccagcggaaagggataaccatacgccgcgagtagagacctggccctcctccccttttctctctctgttccgcgcggcgagataattcggttgcttctccccgcggccgcggcggcatctctcccggcggcggcggagctcacgtccttcgcggcgaactgcgctccaggcagcgggaccagaggggatgggggaccgcgccgcggggagcggcggcgggggagggggaggaagcggcgtgcggagggtaggggactacgtgctggtgcggcagatcgggtcgggggcgtacgcgcgggtctggctcgggaagcaccgcacgcggggcacggaggtggccttgaaggagatcgccgtggagcggcttagcagcaagctccgcgagagcctcctctccgaggtcgacatcctccggcgcatccgtcatcccaacgtcatcgccctccacgagtccatcagggtaccccgatcctcggatcaacgcccttctactgtttatattttgcgcaattgcgttcgatttgttaggatttcatgcggacggcgactgtttataaacctcggatgaataaaatcgggagttcttatagtctctcttttagttgaattcttctgagctttcttggtattcagatgcctcaagcaaaggagaactcattgggcttgacgttcatttgggtggtgatactatgcaaagttttaacttaatgctagtaccatagcgtaagttgtttaactttggatgtttgttcgctggctgtggaagcaaaacattaaaattccaaatttggtaacttgtttgttttggatatattttctggtggaatttaggaaactataccattagttgttccctccttagagttcaaaagcatacctaacatgtttaattatgcctccgatattaatatttctaggtgttccacgaaagggaagcttccctctagggagattgttggacataattatttcttcactctcatatctaactattatttgcgtatctctttgttatttgatgattttaggatggtgggaaaatatatcttgtattagagtactgtcgaggtggtgacttacactcataccttcagcagcataaaagggtttctgaaacagttgctaagcatttcatccagcagctaggcaagcactttctcagaccctcagtgtcttgcactatttattgctttatctctccccagagccaaaatcacattctcttctttatgcagcatctggtctgcagatgctgcgtgaaaacaacgtggttcatcgagatctaaaaccacaggttaaattatttaatttactgttattgagtggatatttccattatatcttcatatttaatgacaaagaattgatgaaagaaacggaatttcctgacattttgttttgttttctatcctgaatttgtggctgttcaaatagaacattcttctagttgcaaataatgaaaattccctcttgaagattgcggactttggatttgcaaagtaagttacttatgtttgattgcttttattttggagttatattatcttattttccacatggccttttttattgagtttatcagcaatgagtttgatacctggtttaagaatcccctaataggtctgtagaaatcgctcctacctgaaatgaaattgcagtattgtgaaagaaacggtgttgtgcattttaaaatggaataacttctcaagaagttctgaaaaaaatacagtcaatttgcactatttcaaaagaaaaggtgcatcatttgaaagtctcatcttcatgtcttgaaagatgttagagacattccatttaaagaatgaaatattatgtgcatcactttttaggcccccttcaggatttggctccacaactacagcatgccttcattgttacaaaaaaatatttcatgtaccaatacacctatgtcgcatatgtattactccaattaagctatcattgttacaaaaaaaaaagctatcttgagtccaattaattctctacactcaattctacttttttttattgaacagtcctactccgtaatgtaatgtcctttgaattcacacagagttttacacaaaaatctgtgcataaaagctaagtacgaaacattcttgaggacaactagataagtatcgtgcagggaaagagaataagatcatgttgctttgtgcttgatcctgtgtttctctgcttccttgcatatttaattacagccatgacaaaattggcacctcagctttctctctgcttctcattcatcgatggttggatcaagtgaggcttggtgggagggttagacgcggatagtatcagaaatgtgtacttaccttttctattcttgcaagcaggtttttagaaccttcttctctggctgaaacactttgcggttcaccgctttacatggctccagaagtcatgcaagctcagaagtatgatgcaaaggtcagggcttttttctgcttccttgtgagctttatcatgtacttttacctgttcttgactcgtgcttcatgcccgatttctgacagaacaggcagatttgtggagtgttggtataattctatatcaacttgttaccggatctcctccttttaccggggatagtcaaatccaggtttattcaaattttccacatgacctgatttctagtgcattattaaatcaggctactactgaaaaatgttatttcccatcagttgctgagaaatatactcaatacacgagaaatacgatttccatctgattgcgacttgagccatggctgcattgacttatgcagaaagttactgcgaatcaattcaggtacgaatcctctgctacacttatgtatagttatatataaaaacaagtttcataagacttccacatgtcattattttttcttacatccttaccaggaagggtaaaattttccagaattatactgtgacatgactgatattacgccaaagaaaaacatgaatgactatcatgcaagagtagacttgggtgggtgacattgtaattagtccctgttttctcacctatattattcacatgtgaccttctagatgtagtcttgtaatcagtatgtcttacatgaagacagcttagagatttattcgtgctagaaaaaaaaaaggttctgcgtgtataaagctgttgcaggaaatatgttacactccatggcatgcagcaggacacaactcatgaactatgctgcacccaaggaagtttatatatttggttgcttctcagtagtttatctgatcaacaatgtgttagaagccattgcagttgtatggtttcttcactcgatcagtttataccactgcttactgtctgtcataatcctgaaaccctgtgggctgtcgcacttataaagcaacttaagtttgttcaaaagtagcagattaactatcactttacatgattattgttatgctgacgttacaagtgagaattaatacttaatgattctgtgccaatattaatgcagtggaacgccttaccgttgaagagtttgtgaaccatccatttctcgctgaacatgctttggagagaaccttgaggtaatatattctttgctatagttttacttctacagcatcacgtgacatgtttgatattctgtattgcattgacagccggacaccatcggacataagagatggctttccattcattaatagcagtcctacgagaccttcaagccaaagttctcaggaagattgtatgccttttcctttggatgatgagtcaactggacaggatgaaggtcctgtttctgatagtaagagtgcaataaaatcctatgggtttgccacgagtaaaaggcttgataaaacttcaggtcagagtccaacgaaacattcaagtctggtctctaaatatattaggggaaataattacgcatctagtagtcaacgcctggaccatcctaggagaatcaaggaaaacaagggtgatgaagggcacaaccctaaaggtggttatccagaaggtattgcagtctgttgtgactatcacatgtttcattataattgtgaaaaagttcttactaaatttgttatttccttacttgtaaatgtagattcccctatcattgattcattagagtttgtagatcaggaatatgtctttgtgcacccagagggatcctcctcttcgatgaatgactcccgacagcgcaccatgccatcaaaacttgacagttcttctctttcaccaccgaagttattaactgctgtgagtgcaccaaggccaatacatggcatggcaattaacagacagcaatctggtggaactggtagcttggacagtcactgctctccagtatctggtacttcacaaggatctgcagatctcaacgatgctatggatcaaccaccatctgattgtctgaccagggttagattattggagcagtatgcgtctaccatagcagaattggtgaaagaaaaggtaactttcttctcagtggactcaaatttccttgcctcctatttgacttccttctgtttaacattgaccaaagttctcatccttttgatatgtttggattctctgtccaaaacattgtggtgaagcttatttaccatataaactaaggtcttgtgtttcattcatctgcctgagacaagtctttatctatgcaattgcaaatgctaaccatgcttttgttttgctgatcaaccacccaaacttttgtagattaaagatgccaagcacttagagggattctcgattcagctagttgttcttgcaacctggaagcaagcaatttacatctgcacttcttatgcatcttctgccacaagagagaatccttcccatgatgtcaccgcgaagggttttggctcaaatgctccccatttgcttgcaaactctcaactgttatatgatacatgcatggagatagagagtcagtttttggttcaaatggaatatgctgaagaacttgccaacactataggacagacagttggtatgttaccttgcctaggagctttaaatcgttggttgaacttcttgaatgctgaattgctgattgtgagcttatgcttgcagatgctacagaaatgccagatgcgatagaaatcatatttcagaccgcgcttaacctgggaagacatggtggtgtaagtcaatatcaagcacactgtcttacatagcagaacgaaagcttggtgtgcactcttatcccactctttttgtgtgttttgttatgctaaattgcaggttgatgagatgatggggaaatcagcatctgccatggtgctgtactcgaaggcagtatccatgctgcgctttctcctgactgaggcaccgtcactcgccctgaaccccgctctgtccctaacaagagatgatcgacgccgcctgcgcacatacattgaagccgttaacgctaggctcgtcccgttgcaataccagcggcactgaccgctcacctgtacaatattctttcatcctgtacatatattcgttggcccaaacgagggcgtgtaagatatgtcatgtctgagaacgtgctccgattagggagaagtagcgaaaaatccagtgtaacttgcccaaactgcctactgtaacgtgagctcggtgtgcttgcatggtacgcctgattatcaggcagctcaggttggcagctgaaggcccgaccatggtcgtttgtggacatgtaaagcagactgctacctcgatggtttgttcattaaaatttgggcttttacactgcatatgttgtccaagtcatcgttgattttgagttgtgctgtctaacttgtccaagtcctgttaattatgaattgaatttgtgtgtgtgttttttctccgccaccaatgcacccaatagatttgactggagtggataatactctcttccttcttgaataactgacacaactaaaacaaataactgacaatttactagagccatcctgctttgaccataaatcacttttaagtgattatattactataaatgaaagttttaagtgattatattactataaatgaaaggttgatggttatttttcgcgaacgcgcaaaataattgcacgtcagtatattacaagaaaagaattttgttacacgacgtaataagaagaaaagaatttgagaaaggttgatggttatatttgtaatgccacacattttgatgatataattacatttctagtaatttataaattatctataaaaatgacagttaattaaagtttaaattgaatagtatccgcatgaattatttgagaacggagtgagtacattgtcgtgttcatatatcaccctccgttgaagaaaaaacaattcagactaaatatctagacaagatatgaaatgtatgttcaaattcttcgttaggattggattatttttaggatgaaaaaactaattttaactatgtacatagataaaatgcctgttcaggattgtgttactccattttggaacgcatgggggtactgaataacctgcccgatcgggctcgtacgggccggcttgtgaactctagaaggccaacacgttggctaggcccacgagtttgggtttcttccccttctcttctccgggcatcacaggatcgaggcgataccggaggagcccccgccatcggccatcctccttcgcgtcgcgcctccggatcccgagcttccagaaagccgaccggttcgtcggccggtcgccggagatggaagccaatcacgcctcgcgggggcgccgcacagtatgcctctcctctcctctccctcctgcttctctgtgacgcgaggcgtttcagatccgcgtctcgtttgtatctgggatttgaggctcaaatttgtgttggggtttgtgtgcgcgtttgtctggcagctggaggagatccggcagaagagagccgccgagaggatgcagcagcagcacaacccggccgccgcggcgtcccttgtcgacccttacggttggtccatccctctcttcccctggaacagttcgtagttcagtgctaatcttgtgggcttaatggcgattgttttctgtagggaacccaggagccggagctgaggtttgcccccctttcctttgtgtcgaatagttcggatgaacattgatcgtggcaagtacgtatccaaattctcatgttgtttctagactataactaaggcttttggtatgaatggtagcttcttggtcgagttagagaacttgaaaatgggaacatagcattggagagggaaaaccaaatgctgttatccaaggtattttctctgcagttcagtattgttgtggtacagttacctgaaggatgaagtagtattaacaaagcatagcttcgtctagattgctgagaaggaagtcgagaaggattccctcgttaaccgcttgaacgaccttgtgagtttcatattgtgcattttaatttggtacttgtgttgcagtttgatgcatatggcttacattttgcacgcgttttactttggggattaattcgctgtttgcaggagcggaatatagtaccctccttgaaaaaggctgtgaatgacatttctttggagaaagatgccgcagctgttgctaaggtacttgactgtcttcgtgtttatggtattcacgattctgatatgtctaatccccattatcacttctacctggtatgctaagtaggaggatgctctcgcacaactaaggagcatgaagaaacgactgaaggaggcagaagaggagcaatacagggtattttgaaaaattgtgcatccttagtcatatcattagtgtgctaatcttatgatttacaggcagaagaggactctgcatcattgagagcacagttaaataccctgcagcagcaagtaatgagcaactcttatactggatttccagttggtgtatcaaatgagcacattcttgctatggaaaaggaggtagaaaatttgcaggctcagctgaaggtaggtcattttgtcttgcttcagtgttatgcttgtccttattattgattattctatctaagcaaactaacatataaaatggttaatgcagcaagaatcattgctaaggcagcaggagcaacagaaactttctgaagagtccctattaaggcaacaagagcaacaaaagctaactggagaacagtctcatgctgcttccttggttgcggaaaagaaagagttggaagaaaaaattgctgccttgacgaagaaagcatcaggtgcatatgaaacatattttgtagcttcatatagggtactctatctctagtaaacgtgccattcagcatagtcttttacttccacatttgtcatgctgctctgctttccgttccttcagatattccatattttactggtaaactgcatgaaataagtttcccctaccatgcagatgaagcttctgaatttgctgcacgcaaggcattttcaatggtaatgtatcgaacaaacttcaagttttttgtttttccatgagttaagattttgccaaggtaaatacttcatgtgttagtccatagttatcaaggactcaaaagtaaaactgagatgagatcttgcattacaacaggctaggtggacacctgtaagcctgaatgcccttgtcttaattcaaaattttcaggggtgattagaaacttgtaatgctaagtgttcgccgtaatcttcttgctgggctcgaatcaatcttaaactgtactggccattttttaattatgcaggaagatagggaaaaacttgaaagccaattgcatgatatggctttgatggttgagaggctagagggcagccgccaaaagttgttaatggaggtgtttgatgctgccttccttttctttgaacaaaataagttcccaatgagctggctaagttttggattgtgtttgacagattgattctcaatcatcagaaatagaaaagctgtttgaggagaactcagccttgtctacttcataccaagaagctgtagctgttacaatgcaatgggaaaaccaggtgtgctgttatcagtcatttcatgcatggagagacaaacatttatcatttatggatgataccagcatcttgcgtgttcaattaatcacaatttccaggtaaaagattgtctcaagcaaaatgaagagctacgctctcacttagagaagttaagacttgagcaagctactctattgaaaacaagtaataccactatccagccagatgggcagaacgagaccagcatttcattcccgccagagtttgtaactgagaatctctccctaaaggttgattgctggagctgtcgagaatattttcttgtctataccatgactagtcaaatctatttattgtcatgtcattggtttacaactgcatatttcattgtctacaggatcagctcatcaaagaacagagcagatccgaggggttgtcggcagaaataatgaaactttcagctgaactcagaaaagcggtgcaagcgcagaataacctcgcacgcctgtaagtatactattattgtttgtccgattctgcattttattttcccctctgtttggtgaaatttaactgttgccatcacttatgcagatatagacctgtgttaagaggcatagagagcaacttaatgaaaatgaaacaagaaacatatgcaacgatccagtaattttggatgaccgattattttccccccttacctgcctacacacaaaaggcagagcttacagcaagtaacgatcatttgtagagttacaatcaactatagtcaacattgttgtacgtgtacattcggttcactgttgtattatattggaaatgggggcagtaacaaatgaacgagtacacccgccaccggactttggaatcagatttgcttgtgttgaaattaaaactattaagggggctgttataccacggttttctgttctggaacggtacgatggtatgatataagtagtactcctaggtattaagtcttatgcctgttggtactagattggtacatataggtattggcgcctgttaagtacaaaacctacaacaaattgatgatattcatagggtaacaaatctgacgtgcttgttggcgtcgtcatctttgcagtccattctaaaacattttatttgagaattgattcaattcaaattaaatttctacaaagaccatacatttggaagaacctcttgtggggttttagttttgaatttaacatgtagtagattgtatttttaaagaaaaaacatttaaactgacctcttttaatgcattttaaattcctaagacaacaaatccggataggtggctgtcagattcgttgtcattagattgtttaccatacttacctaagtttttttttttttggatgaagggacaccattgacttttaacatgatgtttgaccattcaatttataaaaaaatagggtaaatatgctaaaatataaatcagacttaaaattcatttaacgataaaacaagccacctcaaaccagatcgctcgtgtcggcagctcgaggttaccatagggctctggtttcaggtggactcttttctgtctgagaggtggtagatacttttttttttttggttcctggtggattttgcccctttagttcgcttctagatttttcattgaattggttgttggatcaaaccagattgaaaggatatgaaggatctggatgttatgttgacactcaatagtctctagaatttatttatttttctttttttttgaaccggcttgtcatacaattcacacaaattgggagagaggagaagcaacacgtgtcaacaaactattgcttgccacatccaccaatcacaagccggcagaactaccgacgttagaaatacagggtctgttcggtactgctagtggacagccagccacagtataatacaatgaagagcatgtttaggttgtagccaaaataaatcttagcaatactaaaattttgacaagatgacaatattgccaaaattttggcaggacttcttatgtatttaccaaatttgacaacaaactaaaagtagccaaaattttagcaattttaccaaaaaaaattttatgtttgaaaatagcatcaaagtgaacaggcccgaagatatatggtggcagctgccgctgctgtacagccgtggtatagggcagccgaacaagcccatagatagatattcatagggtaccaaatcttccaattctgatacctattggtaccagatttgatattcatatgtatcggatcataggttacaaggcctatgtgtagcactttcgatgatttaatactccttccgtttcgaaataaataaactcattatgtccacattcacgtacataaactcattgtcctttgttattttgggatggaggtaatcctaggtacgaagatgatactatgcaggtatggatggtgagcagctacaactcagtttattactcccaccatcccaaaaatataaaggattagttggattgtactatctccctaaaatctccgttggagagtactctctccgtctaaaaaaaagaaaaaccctgggttgttggagagtactctctccgtccaaaaaaaagaaaaaccctgggtttctgtgtctaacgtttaactgttcgtcttatatgaaatttttttataattagtgttttattgttgttaaatgatagaacataattaatactttatacgtgacttgtctttttaattttttttaaataagacggacgatcaaacgctgaacacggaaacacgctggacacataaacctaaaagttgtcttttttttctttttggacggagggattgtcttttttttctttttggacagaaggagtagtatacaacgtactagtggcttttatttattctcattttaggtaaagtgacactccatacgggcagaatttgacaggtgaagacacgtgcatcatggtatagctggcataagaatctggagtctggcaaagaaatcaccacccagcctcccacgacagatgcaaggctcacccacgtttgctgtttaaggctgcgttctttcttcttctcaacagtgattacggaaaacggagcgatccattagcacatgattaattaagtatctgctattctttttaaaaaaaatggactaatatgatttttttaagtaactttcgtatagaaactttttacagaaaaatgcaccgtttagtagtttgaaaagcgtgctaacggaaaacgaggccgactagcctgaaaagaacgcagcctaaacattgagtgggacacatggaaggaaacaccatgacaaaataagtatacaatgtagatcacgcagcacctgtcaagctggtccagtttacaggataaaccattcattagcctttccagaggacttctagactctagaattgcagttcgcaaatgcttaaaggttcaatcatccagtacattctagaattgcagttcgcaaattgttgccattggcaatattagcacgctatagaaaacaagataaaaactcatccaattttgcttacaagcaacagaaaacacgggcttgcataagtaaagttgttacctccatacaagtgatacatgtgcttttaaatagtgaaactaccaaacagaaactccatattcagatttttcctggctgcagaaggaaaccgcctcaggtcaattggcaacttcatccttccataatcaatatatctacatctacaagatagtttcacgcatcataacagaaaatggaaaaaaaattggcacttgccatgaagagtaaccttccagaccaactgttagatatgatattatttggcttctccggtagaattagcccaatgttgcttcaagcctaacgcctgcacgttgatgtctagatgcatccacaggacagcctacagtagacatgatcataattaagcgccaaccagctgaaaccataaaatgatgtttgcagtatcatatctgactaacacgagcagaacatttgtgatggttgattatctgcctaacacaagcagaacatttgccgtacgactgcaccagcctacttacatgatgagctaggctcttgcaaatgagttatggttgtatatgtgaaatattctcccaaaattggtggtgggcccgatttgcagttgtttctctccacacattatattgccaaattatgtttccaactatgatgtcacaactcacagttacaggcccagataagattatttcaatcaataattatatcaaaaggacaaaaaatagtgtttttttaataaaaaaccataaattaacaactgtatcgtctgaagggctcctaaattattctattcatattcactgagtgcataacacctgctggtgaaccaaaccaataacctaatgaaattccaaggttacaatttgtaactcaaagtaggcactatgaacttgacctggtatggcgattgtcaacaaggcgaccagcatagtctttctgcttactccctccatcccataaaaaatgaatctaggaccggatgtgacatattctagtacgacatatgtccagattcgtagtaataggatgtgtcacatccggtactaggttggttttttatgggacagagggagtactccacaagattgtgcacaatacaattgaaggattttattctggaaaatgttattggtggaaaaacactagcaatactattatattgcttagtgtagaacaagtaattttctgctagcaattttccaaaacaaagtataatcatgaataatacattatatgtttttgcgactgaagggagtactaacgactactcaaaagataatgactactcaactagtgtaatacatacaaaatagatttgcgcggaggcgactagggatctattttgtattcctacctgcataacatcagcaatggagaacaaagcacctaatcaattcttttactctccatggacaggtagctttttttttgtgtaccatatgctactgggataaaattctgatacaggtatggcctataaggtagagccaattttactccggagagaaatatcaaggccaacacatacaacaaactataagaaaaactaagaacaacttaacatacttataaaataaaatttagttgtaagttatgatacacattactacatcaaacatagagcaaatacaccatacattttaaaacttttcaagtgaatagttaaatgcagcacacagtaaacatgttacattttcaagccacacaaactatatggcaaacttatggaacaaggtaatgcaactgacctcagagtcgctatgagcgaaatgggcttcaccatttcacattttgtttgatgccataaatttgccttttctctcagcaggtttaagaatttgaaaagaacacatcaaagtttcatcaacactcatcattgcacctgcattatcaaattcaccacaatagtttggagctgagaatatggtgacaagttgtctgtcggcaaagaactcatatccatcctcaacaacctgacatcacatgaaatataaatatgatcacctcagttgaccaaaaaaaatactgaaaggaaaagatgttgcattaaaattgtacctgatgtgcccggcaaataagatcaaggtcatgtttttccaggaattctgaaactttgtcagcaccaaaagtgtatgagacccccctatcattcatgccccaaccttgaacgtcttttcctggatctgaccaaagtaggtcgcatagcagacctgtatccggtacatcagtaggacggggcaagctctttatctcatctaaatgtgtcagatcaggagagaggccaccatgcatgcataatattttatcatcaattagcgcagccacagggagacagttaaaacaatcagtgaagaccttccatagacgcacattaaatcggcgtttgcattcatcataaaatccatatatcctgtttattgatgcacactcatgattgcctctgagaagaaaaaaattctccgggtacttgattttgtatgcaaggaggaggcatattgtttccaaactttgtttgcctcgatcaacataatcacctaagaatagataattggcttctgggggaaaaccaccatactcaaaaagccttagaaggtcactgtactgaccatggatgtcacctggataccaaatgacaagtgaaaaaaaagttaaatacacaccttagagccaccagctacaaatttacaggctcactacagattgaaactccccaagaaggcgctaagtagaaatgagctcaacattattttggactccaataaacacaaccctttttttagatgaatacaacacaaacaggtgctgtagtagataatataaaagagtaaatttcagataactgcaactattttgtcaaaattatcaatttactgcaactttatctagacacttcagagaattgcaacaatagcgtacgattttatcagaaaactgcaattttatttgcctggcaagttttagtcgcacctgtcatacacacaaaggggggctaaaggtgcggttttgtgataaatcgtttgctattgtgtgaaatacccatctaaagttgtagcaaagcaatggttttgataaattaattgcagtttatgaaattcactctaatttaggagaattattgcacagagcattagcaccctatttagctcatgtagcgtgcctccaataccctcgtcacacactatgccacaccatgctctcccacttatccgttccattccgctactacctccatcccaaaatataacaactcttagctatgaatttggacaagtggttgtccagattcatagctaaaacttgctatattttgggacatagtgagtttactagcgcaccataaccatatccccaccccttggcaagcggtgcctccacggcggagatcaactgcaaatcgatggcgactgtggcagtgtgctacagattggaagcgaggcagaggttccaacgcaagcaaagcccaaggtggaggttgggtcaaggacgaggccatcggcgacagatctgcgcaatcaacgcaatccgtgctatctgctcctctcgtgcttccctacttcaccgacctcgccaagctcctccatctccgtcagcgggaggagcagggaggaaactggcccctcctgggagatctgcagccaaggacactactatggtgaggttagccgtcggtgtaagatttactcgtcttttttttgttgtccggaagatcggagtaaatatgttactaatcacaacatcactaatgaacctaaacgcaaagacaagacgaatgtgtataatttcttttaccactgatccaccttaatagggagtgggttttttaattgaacttatagaagtatttttttactcagatgacatacagtattttttataaaaaaaagaataaatctcaaagttgtaattattttactcggaccagagagagatgcagaagtggacggacttaaaaagcaggagggcggcaggggataccaggatagtaactttttattcagataaaagacgggatcacgggagaggggatgccgaagtggagggacaggaacagaaaaaaaaacaggatggttgctgggaacggaaaaggaggcactagcttacgggatgattagtgctaccgctaatatagataatctcattttcatgattacaatgtttcaccgaatatgatgcaatgccagcaattcaacagcagaggataaaaatactaacaatacatgaaagtagcaaataaatagtctaccaactggtgttctcaatgagcaaatgctcagtagatcgtattgctaaggaaactactgcagaattacgaattcatggttgggaatttcaatacggctgcaaacctggaagtggttacagctgcccacatttactattaactcactgaccacagaaaatcaagtcaacaaacttgaagtcattttcaaattggcatgtacaaagtggttgacgtttcatcattaatcagtgtcatcaggagaaaacaattcaacatgaccctatctacactctgccgtgcctaactagatgttgttacaaatcatctatggacgaacagttgtcaggacagataggtttaattatctagtagaatcagatggcgctagacaatagaagctgctgtgcacacgaacaataccgaaaattaaaatatcaagcgaactaataaaatttgaaataacacagtcagaattaaaggaaatctcactcagcccttgtgaatgtgctcgttttgaaaatgttcacgaaacaacctgttcaataaaaatctacctcacgagaactacaatcgagaaaaaagttgcaaaaaaaatagataacgcccttgaccatactttccaagagagacagattgatgctagccttgttcaaggccgcgacacagagaagcagtctcccccacaatacaccagctttcggccgcgcggccaaagcagatctacacgacggcgggagagggtttggggggggggggggggggggcgaccccctcctatccggattggtgggcgccggaatttaaaatgcattaaaagaggtcaggttaaatgttttggattcaaagaaaagctggcggatctccgactcggagagctgcacctgcttccccgggcgcgccgtccgcaccttgagcaggcggcggatgatatcgtcgaggaggacggcgtccatcccgccgacgacctgccctcccgcccccggtgccgccggcatcccctccctccccttgggcacctggagagatcggcggagttagggtttcggctctgcggggggaggaggagggggtggaggaggcggcgggaggtgttttactcggcccgtgaggtgtatagagagagagattgggcggcgggccgccgctggctagataaactcgcctcgccctcgccgctggctcgtttgtactacgtgtattttcctttccttttctttattttattatttcgttttacttctcgaaaagaaattctctttttaaggtggtggcgcggtgtggggtcctcggtctccaatttggcggaagcgccaacggccaccacgtaatatgcaggtatactagcacctccttattatgtcatgatccacctctgatcttttctttgcacaaatcctatacccgcctgtggttttaccgtagaaaacaacgaaaaatgcatttatccgttcagaaattagcgttgttgaaagaaggatggacccaacaacacaggaacaaagagagaaaaatacacgtcgagcagtttttatctaatggatattcttgtgacatctttatagacacacatgctatacaccctgatttcgtcgatggtcttgctcaataggcgtggtactcttttgttccgctcacatcatatccctcaaatcactagcatatgaattaatttcatgatctacgttttatgcttttctccttgtgatgttcgcctaatccaccaattcaccaatgtatcatctttgccatgcgtgtttgcgatgtcatgtcttactccttgtaaagttcattcccacatttgccgcacgacattacagtctttacagcggtgttgcatacttttcaagttccaatagtagaattgacagaagtgattgttgagccattgtctaatttgcagcttatcggccatccagatctcttttttttgcaatagcagccaaccagagttctcgcactttgaaggtgcccagctctgatttgaggtgttattctcactgacaagggaaaatgcatgtggatatgtagaagaaagaagggtttccgctgcatttcaggggcatggaaatttatataattttattcaactttagtcgaagaaaagaacagggtcatagtttttcagttggctaaaactacattgtcagatatatgggtccgggggtatgcgaagtgtggggaatctacctttctatcctgctatgtgtccctacagcctagtcctgcccccgcagtccgcgaaccgcaggagcggccggggggtcgaggcctcggggtgccacgtcatgcccctcgggcccttgcaccgctttgccccgaggccctcgcccagccgccatttggcggggggagcgagcgagaagggggcccaggctgagcctcctttaatgagcgcaacgccccaactgccccctgtcgcatttaatacagtgaggcagacgtgcggcgtgctaagctgacgcgccatagtcaagaatgaccggtctgtgaccggcctgacgccggtcacgtctgactggatcgacaaccgtgctcccacgtcgcgtctgcttccggcggagtggaggtacgtatgacccgtcccatcggagggtcattcggacggcagccaccacaagtcttcacctattaataagggaatgacagggttgtcccccgtgtcaggcgagggacggcgttgggccccactcaaggacaagctgtggcttagcttccaggcgaaggcacgggtcgagttccagtcaagatagggtgggtccccacccgaaagaagagtaggtagaggcggtgcatgtggtatccccttgaggtgtaaaaggaggaccttgcccaccgagagagggggacgaccctcaaagaacttgagctctaggagaagagtgttctcctgagtttaggaacccttgtaactctcaatctaaatcccaaacacaggagtagggtattacgcctctcagcggcccaaacctgtataatttgattgtgtgcgagctagctagtagccttagggacggacacgtggtttctagaggtgagcttcttcccccggccgaactcatgaaaggggggtctcacgacctcccgctagagaggatcatccctcgacatacatattgctaagcctacactaaatttaatttagtgctatgcattctgcaagttttgttcattctagccctgattttgtcgttgtagatttatgtttatccaagttggatacttttacatgtatttatttataacttgataatttattccatgttaggtcagtgcaattttttgtttaatcttttatttgtgaaaataaaggattttcttttgaataattaatagtgggaatgataagagccattggattgtcatccaagggatgagaaaagtgactgacactcccaagaaaaaaatggaagttttcatgcccctgcatgatgatttgtaccaaggttgtgtttagttccacgtcaaaattggaagtttgactaaaattggaagtttgaagaaaaaagttgaaaatttatgtgtgtaggaaaatttttgccgtgtttagttctgttagaataggtgtcgaatatactagttctatttggttacaattggacttggagctgtaataggtgttagagggtggagttagagtcgaactctgtaacccgtcatctctctaaaatagagaggggggcaccacaatgtaactatggcaactacaatatatcgtagacacgcagggagaggatggcgacgaggccatagactcgtagcggctaggagctatattggttggggaggagcgcccataatcagagccccggggatgtatgcttcggctgaacctcgttaacaaatatcgtgtgttcctatgtcgtcatctggcatgttgttaacgatgaaatttggtaagcccaaagtcatcatcagcttagagtcagtattggcttcagagttatggaatcatccaatgggagtcgtcaaatctccaacaaccgtgttctcgatggagtcggatcaactaaggggaatttatccagaagagtccgagttcaagaaagatgcagcatggcagtttatctattaattaggaatagtttgttagtttccttttatctttaggaaagtgtgtttagtgtccgataaggactttatgttttccttttatctttaggaaagtttctttcttgtccgacaaggacttgtatcaacccatgggtataaatatgtacacctggggtctatgtaatttatcacacagatcaatacaactactcttggcgcattgccaccctctttcccgaggtttttacttatcatccgacggaacttggcacctgacgcggggctgcatcggttttcgatctctggcgaaggggtaagtcctacgtttcgtcggccctggtgaatctgtcggctatattggtgttgttcaaggctgcatcgcttcgatctcttggatcgctctggtttggttgatatatccgcctacctgatatctcaattctatctctaattgtattatgtttagagacacatcggtttagttgggattgtcttagttaggttcgatcttctgtcttagccgatatatctctacgatcacagtgctgttctaaatagatttgttatatccatcacattagatagatctatcggctcaccgagtattagattatcatatacaatctcgtgctgcatcggttaggttcgacctactatattgttgttgataatataagtcttattaagccgataggttcatgctaatattttatcggggtgctagccgataagttatctgtacgttgcatcggcttgtaaggattgcatatacatataagttggatttagctgatcggaacaaaggtttcactatttaatctaatcttgtagattttatgacaatggacctacagccgatgtatgctttaacctttggattgatgtttatctatcatatcattattagccgattggtttccactggattatattgctatattattgttatttatcatcatcagccgatcgcctttatatcattatttacatcatattgttagctgattggtttctactggattatattgatatattatattatcatcagttgattgcctttatatcattatctacgttggacatatagccgattgatcaaaaccctatcgctatcggctggtatcggcatcggctgagattgctccatcggcttgtcagccgatcggctcattgatctattatttgaatatcttgtcagttgcaggatcaaactaactggcacgcccgcatctcagcaacctgcactgaagctaagcagatctcccaggccagtgtgtgtttttcgtatcaacacatgtcttaggtgatcaatgactgaagcgatcgggaaggttagttgttgttccactatatcgactaactttaacaagttccaaagttttttttcaaacttccaacttttctatcacatcaaaacttttctacacacataaacttccaacttttccgtcacatcgttccaatttcaaccaaactttctaattttactaacactgaactaaaacacacacttagtttccttcaaacttccaaaatttatgtcacatcaaatgtttggacacatacatagagcattaaatgtggacgaaaaaaaaattaattgcacagattgcatgtaaattacgagatgaatcttttgagcctaattacgctatgatttgataatgtgatgctacagtaaatatttgctaatgatggattaattaggcttaataaatttgtctcacagtttacaggcggaatctgtaatttattttattattagtctacatttaatactttaaatgtgtgtctgtatacgtaaaaaaaattggcatatgaactattaaacacggcctatgtataacagttaacaaacggcctatctagtggtccagctattatattctagtagttcagaggctgtttggtttccagggacttattctaagtccttgtcacatcggatgtttggacactaatttggagtattaaacatacactaattacaaaacccattccataagtttggactaattcgcgagacgaatcttttgagtctaattacgccatgattttgacaatgtgatgctacagtaaacttttgataattatggattaattaggcttaaaaaacttgtctcgcggattagctctcattatgaaattagtttttttattagtccatgtttaatactctaaattagcgtccaaacatccgatgtgacatgggctaaaaagttttaaccccatcttaaacaccccttgctggctccccttgcccattccctacgtaactctctgtgcattctatacactatgaattcagttaggtggatgcttccatgatacagcatgtgacttgccatgtaagttagtccattggttaagaccatcatagggtaaccatgacgtggacttttcttttcaaagacagggaaatgctgttttcttgaagttcttttagtgccatagaatacactcaaacagaggaaggcagtcatagatggaggaggttccatttcaattcctgcacacagctaacaaaaatacaaatgtatctgcagcgaactaaactaactgagaatactagttaaaaacaggatttcaacatcacagataacagagcaatgtgtagatcgaatttgtttatttcattgtgtcgatcgattttggactatttttcttttagacgatagatgcatcaatgttaccattttgtaagtgagaagcatggttgggggggggggagcattgactgaagtgtaaatgccaacatggttgaaacctgaattgtagccatgcatggaagcgtctccatcaatttcctttttttttttgggtactccctatccaaaatggctcgctatttctctgcacgctcttgtaccaccctaatttcccagtcgcatcatcggcagttcaagcatcgtatattcaggtcagatgcttgcacttttgtaatcatgccaattaaaggcaatttctgatcaagagcgtgctaacgcacaaaccaatttgtacgagccgaaatttccttaattatataccaatattaggctgtgttcgctccagcgtgttcccaaccggaacatgcgcacggaaaatggaacggtccattagcgcgtgattaattaagtattagctatttttttaaaaaaatggatcagtatgattttttaaaacaacttttgtatagaaactttttgcaaaaaaaacgcaccgtttagcagtttgaaaagcgtgcgcgcagaaaacgatggagatgagttggaaaacctagggtaagaacacacccttaaactaccgaatatgagatagggagcgagcttgactcatatgaggaaggagaagatacataaatgaagtaggatggagataggtgaagaggattgtagaggtttggtgcagaaatgcgaattgtcgtgggataactaagacaaaattctcaaataacgggatgtacattggagttttacaaaatctggatgtacattggaattctacaaaatctacagtaaagtggttatatcatgaaagaaaaataatatcagtcctctaaacagtctagaataattcttatggtcccattgatatattgcatttctggtgcatgataaaactattactagtacagtaattcctactcctacaaaggtggaaaaaaaatgggcaggacctcggtgctccgctccgatgaaaagaccacgcttcctaattgccacgtgtctacacgaatcttggagcattgaccttctacctccaactcaagtgcttaacttttcccctcatctccccacctccattcctcagttctcttttgaccagaagctcccttgccgccttctccttcttattgctgtgtgggaagacacgtggtgtagaagcagcatgccacgacgcccaaccggcacccatgttggtacatgcgctccttgctagggaagctattaaggttgacaactcatgccccgacgaatggaagagctctctaccaccgccgacatcattgctgcgcatcaagctctaatcaaagattagacttcccacctgaaagaaaaagagaggaagggaagtagtggaagtggttcaagtggagaggagagagaggtaaaagttgggtgaacgagctcgatacctcttgcgcgtgaaacgtaatactccaaagtcccaacaattgggcctctgacaaggaagggaggcgggaagtggagaggagaggagaggggcgaagttgaggacttgagctgaggtaagcgatgagtgctccaagattcgtgtggacacacatatcaattagaaaacaaagtcttttccattaggtggaaggaccgaggtcctaacttattttcttcctgcaaaggcgatacgaaaccagcgtccacaaataacatatgtgaatatcagtgcacgagagcgctacattcccttaggctaccaagttgcaagtaagggtccctttgaatcgcaggattcagaaaacagaggaataggaaaaacttaggaattgaatgccatacttattggattcctatgggattttgaaacacaggaaagtcttcaaactgtcgtttgattagcacacaggaaaaacgtaggaaccttagacacatgaagaggaaaacatgaggtgagacctcatgcttatttttctccaaaattgctctagtaaggttcattccataggaatttcaaaggaattgataggaaacaatcctttctttcaaaggactctatagaattatttctcataggataaaatcctctagaatttctatggtttttcctttgaataaagggcctaaactttggcctttgttgctttgctaggctacccaccgccgcgtcacgcgagctcaccatgagtccacggtccatggggcaaaacaccggggcgggctcccccgaacaacggaaataatgggctgtacactcgccgactcgcgtgcgtgctggcgaatggcgatcgacagcggcagcggccagctttcagggtcgcaccctttttttcccttttcttttccctatccgagaaaggaagggaaaaaaattttcagagcaaacgtactcctcccgcattgctagtcgcaggcccagcgcagcgccacccccgccgccgctctgctctcctcccgtttccgcgtagcatcaccgtctctcagcgagcacaaaaagaaaaccaatccaaaaaaaccaaaaacaaaaaaaaaaaagcatgcaaatggaggggcatacattcgcgttgacacaacgaatctctttcttttcccctcccgccgttaacacagaaccgaaaatattccccccgtgcatccgccactaatgcgccatcaactggcggcacggcgactaccgaatttcgatttttctttctttcttcgctaaagaagacgctaattgcgatcgagttaacccggtgagagatcgtttgctttttgcacggaacgcggaggaggcgaaggcgaggagaggcgagatgagatgagatgccgtgcgttgtgggcgggcggccgccccgcgcttcgcttcaccctcaatcctttcctttctgtcgcggccaactcctcgccaccacgccgctttattctctaagaaccccctcccctcccctccccctcctcctcctccgtccatcgcagctactgcctccttcttcttcctcctgatcctctgctcatcgtagaaatcgcgatcgccatacttgaccttgcagagctctgtctctgtctctcgctctgattgaagtgttctgctgccatctctctcccgcttctgtctccgtgtgtgcatatatatatgctgtattggggacgttgcggcagcggttcttgggtacatggcctactcctcacggtcttgtgatcagtgcagtcacggtaatttctctgatcctaatgttcagccgttgccatcgtcgtcctcctcgtactttttgacgttcttgttcatgttggacacatggttggtttgcttgtgcactatgggtagattagatttcacgtactttttcagcagcagagagctattgttttcatggcaccagtagctggtcgttgtctcttgcctgactaagattttaactttttatttgttgcctgcttgaaatatatgtgctgtcttgattgaacttcaaacaaggcaggctaaactactgtcggcagtgcaattaacgtcagatagactaaaacgaggttgatttcagcaagtaaagcaaaatgaacttttagctttcctaaagatgatactccggggaacacaaaaatggatcccagttgatccctttcagagaaaaaatttagcataccaatcgatcgatgcgtcaacatccatggcaaaatagccgattttttaggcgtttctttacacatgagactgttatccgttagactcgccacatcatgtccactctctctgaaagaacgttcttgttgccattaggctgtcctattctaagggcttgtttgtgaaacagggacttctgtcacatcggatgtttggacattaatttagagtattaaacatacactaattacaaaacccattccataatcttggactaattcgcgagacgaatcttttgagtctaattacgctatgatttgacaatgtgatgctacagtaaacttttcataattatggattaattaggcttaaaaaatttgtctcgcagattagctctcatttatgaaattagttttttattagtctatgtttaatactttaaattagcatctaaacattcaatgtgacatggactagaaaattttagccccatctaaacattcatggcgtgagcgtggcgcaaatggtgatggtacaggtccatattattggtctagcttcgaatcgacctttagctgtttgatcctaacatcgatcgccgtgcaatcacatcagatgaacatttctaactgtcatgcataaatcataccactgtgctattcagaggagggaaattaaggcaccgtttagataataggaaagggaaataatttcccacttatgaaggggtaactttgaatcctagccattcatttcctccaccttatttcatcctagccattgattcattttctaatcccaatcccatcctttatttcctattatccaaacatagcataaatgggagactcaaactgattcttataatccaggataaatttgagggccaccaagatttgactgaccctgactgcgcctgcgtgccccgtcaatcggaggtagaattgaaaaaggaaaagaagataacgctgtgattagcacggtgtagagaggggccatgttagcaacgcaagcaatttcgtgtggcgttttgtccctgtgtttcttgatcttgttcaatgcaggtacacgcatctgcctttctttttctatgacagtccaattaacagcctcatacaaacaaaaacttaaaaatttagtttagctgtacatgacatgatgactgatttttttttaactgtgcaactgtgactatctgatcaaagcaaagggctagcgaaattatgttgttgataacccatcacctaatccacttacaattagcatccaaccgagcatataagacaaccaaagtgtttaaatacatcaatttttctttgcctgctttcagcgggcaggaagtgttaggtgggatgttgctctccacatttcagttctagccatgtctgagatccttctttgcatagtgcctgaagccctgaacctgtccggttctaacatttctgcaacgcagagaggagatccggcttcatgaagtggctctgcgctttcctgaaggggacgaaggacggcgaggccaaccgacggcgccctcgggtgacggcaggagaagagaccacgctctgggaagaaccagttagaccaaaggtaatgtttctcaattcctccgcaacctgacatttttctgttcttttctttggttcatggagtgccactatccaaattccccttcctttatcagttagattatggtaatgatgtagcactatcatggggaaaagagtttctgaacctttctttgttatgtttctagaaggaagaaccacctagacataacaatgaagaaatggaccatgcacttgcccttgctcttgcagacgatgccaaaaatacaaaaggtgccatatttgtgaattctgtgatattatgatcatatatttttaacctatctcttcactaagcaccattgatgcaactttttttgggtagagagaaaccatgacaagggagaaaacgatgaagaactcgctagagcaatacaggacagtctgaacatgaatccttaccagccttacaatccttgtgcaccctctcagacccaggccaggtcgagaggatacaggttagcaaatctgctttcactaacctgtctacaattcacagaaacagctggtatgtaaagaagcaatatatatctttcagggtctgtgggggttgcaagcatgagatagggcatggccattacttgagctgcttgggaatgtactggcaccctcagtgcttccgctgttcttcctgtcgccaccctatccgtgagatggaggtaacctttctgcaattcagtttagaatgtctgaaggtgtgtgtgttcaggtgttctcaggaagtgacagtttactttattctgtttcccagttcaccttgctaggtacagatccataccacaagctgtgctacaaggagcttcatcacccaaagtgtgacgtctgccttcaatttgtaagatttttttttttgtggatgaactatttgcagaagtgctagaactgatttttggattagcatgccgttggaacagcatttgcaggaaaccctttttacgtgtttggtttttattgcagatcccaacgaacaggactggtttgatagagtacagagcccatccattctggggacagaagtattgtcctttgcatgagcatgatagaacacctcgttgctgtagctgtgagaaaatggaggtttgtactgcctttcttgcatatgatgaatgtatttcatgcttacaaatacacattaaaaatattattagtttctctattttctcggcaaaatttctataaattgcaattgtactgatttgtcagtttaaaatatgagttcgtacttaagacattttgtgaatccctgcagccaaggaacacaaagtatatgtcattaggggatggacgcagcttgtgcatggaatgcctggattctgcaatcatggacaccggtgaatgtcaaccgctataccattccatcagagactactacgaagggatgaacatgaaactagaccagcagatacccatgctcttggttgaacgtcaagcccttaatgaagctatggaaggagaaagcaaagtgggttctttacatctgtttgttctgtaatgcataatgcattactccgtctggtcataaatatttgatgtttaggataagatttaatcaaactttgaagtttgttcaaatcttgtcctaaacgtcaaatacctatgactggacggagtatgtgttattgatcattgcatcttgtatttctgcagggaccgcatcatatgcctgaaacacgaggcctttgtctgtcagaggagcagactgtgaccagtgtaagtacaacgcatgtcaacctaaacagtttttaggatggtacaatttctctaatgaataactaacaaatcaaggaagaccaagtggtaatatgaaatcaacatcgttctgatcaaacgatgagattctctgataaatactgatcatctaatgagattccctgttcaatgatgtagttgcaataaactagacagagtagttgctttcagatcttacatccacagttccactgagtagcaggttggccaaatgaaatcattgactttgttcctttgtgttctgattttctacagatacttaggaggcccagaattggtgcaaatcggttactagatatgaaaacccaaccgcaaaagctaactaggagatgcgaagtcactgcaattcttgtattgtttggcctccccaggtcagtgcattcttcacaagtatttccattttcatgtaaatcaaatgctacaattcgtgtatcatttgtgtgaagtcataaacattccatacaattgcaggctgctaacgggctccattcttgcccatgaattgatgcatgggtggttgcgcctcaaaggtaatcatctgaacatccatttctcccattttctgaaatcctatctgaacattaattaatttctttgtatcctgtctgacaatggcacctacaggttaccggaacctaaaggcggagattgaggaaggtatatgccaggtcatgtcttacctgtggctggagtcagagatccttccatccacttcaagatatggacaggcttcaacatcttacgcttcatcttcgtcgtcctcctgtcgaccaccaccgtccaagaagggtgggatctctcacaccgagaagaagcttggagaattcttcctgcatcagatcgccaatgacacatcatcagcatacggcgatggtttcagagctgcctatgcagctgtgaacaagtatggccttcgccaatcactgaaccatatacggctaaccggaggctttcctgtgtaacacaagaaagcactgtctatcagtctatgtccatactggatgcgggtatacagatatcatacacacatacatatggagatcatatgggttatggtaatggagtaagatttcggatttgggtgaccttgagttttcagagaggtcctatcagagtaaatcagttaaggaactgcatttgctcgaattaacaggagctgaggttgcaatctaataaggtgactaagaaacactaatgtaatgcacagtatggcccatgataatgcagtgaagtatttatatacgtctatgtgtataatgtactaattatttactgttgatctgcatgactaggggtgtaagtggctaacccgcgaaacccacttataggctaaaataaaccacaaacccgcttattttgacctataagtgggttcgcagctgacccacttacagccctatgcatgactgcatacaagcaagagtatctttcaaatgaaaattcagcgagaagaggagaaatattttcctaagcaatctgttcgttctcaaatacttgtcacgggacactattcatgattaaacttcaatcatttgtcgctttttgcaaaaatgtataagtacttaattgtgttcatcctaaatataagcatttagctttcgttcatcgtagtctagtcatttagaaattactaatgtcgaagttgaaacagtgataagtatttaagaagggagggagacacctttcaagtaaacaatggcccctcgaatctgaagtatgctgaacagtcttcagtgacctgttaacaatcccctaccacagatcaacgcctttgcgaatcgcagccaatactcgtgcaaaggtgcaaagaagcagcggaaccagatgacatgcattctgaggaagccatcagctgtggattagctactccgttctcacattatgtactgctagcattgatgtcactgagcatttgaactctgttctcacattatgcactagcattgagccattgatgacgacataatggctctgccgcatatgacactacacttcattatatgtcttctcaacgaagtttagcagcacctctcttcacctgagttaactaagcatttgagattggttcatttgccggaaaaggccacgcgtttctcagtccataagcagtggagacatgtccaatatttcccatagacagttttgtccatcgtgcgagcaagaagttgaacaattacaatgtggatctaaaattaacttttaacttgtacttgcatccaagaagaggccgcattaacaaactatcgtccaataaagagggatacaacgttccttgctcactaccaggaaatttgaatgacaaggccattcacaataatgtagccgaactcacttgtgaattgtaataagctcactaggacaacatggataaacagatcatcttggaggccatctttcaatagtattgtagagctgaagacaatggcctcatgtaccattacaaaactgaaactgttaacatacactaaaactggtggacagaaatttgaagacctatggcagcggctcttcttttaccatgcactacaagaaaatctgtaaccatatgaatatccttccattccatgatattataaacttaaaaacctagtaccatctagatcctaacatatgctacaaagtcatttttctcgctctaatcagcctcaagtgttattctggcccaaacatcaaaattgtcaagcgtgacaaatgttggacagctaatcatctgatgccagttccgtgaggatggacttcagcgtctcatacgtcataaaaacaatgccaacacttgggaccactttgcagtactcgggcaaaattcctctatacaatcctcttaaactttctgtgcgaacgatatgcccaaatgttccaaaaagtccagtttggtagacacgggcccttccagctgcgccttccaactgcatgcggcgtcttactagatccaacggaaatgtaactgaaatataataaatgataatgatcagagcaaggttcacttagtgacaaaaaatacaacagataattgatctttgaggtgttattgaccaatttgctccaataacaaaagtctagacagaatcagagcataaactagtggaacagtgcaaaaaaatagttcctatgttattcaactataaaaatagtttgtggattacatggtaacttctttagaagtgggggaaacaaattctagcaaagtggggtctttctattttgcacataatttgtgtattcacacaaccgttccacattgtacgtttcattcttgagaaaagctcgtcacacctcagtaatacagaatactttgtactccctccatttcacaatgtaagtcattcttacatttcccacattcatattgatgttaatgaatctagacatatatatctatctagattcattaacatcaatatgaatgtggaaaatgctagaatgacttacattgtgaaacggaggaagtagtaatcagcattcgtttacagattacttactagttgaggatgcaattcctgaaagacttccacaagccaaactgatcagaacaggggaatcatatggcctggtttaaagatcaaaggtaataaatacagttagaacaaatgcgagaagtggcatggatatgaataaagagcccacttgtatcttgtgcaacttacctctctatttgccaatgagatcgcaatgtctcatagacacagaagcttattgctatgctgggacctactccctgtattttagataaatatcaattggataacgaaaggtagaatgctcaaaaagatgggagagaatggcagtgtcgaacattcttaccagcaaagtggcaccaaggcccttgtagagccccttgacaccctcgtctctgcagatggcgtaaagagcatgagatatgcccctgtagtaagcagtgttcgtctgcaaacatttgatgaaaaggcttcattattagtgaagattacatattaaaaatgcaaagcttcaatggaaaaaggcctacagttcaataatgcccaaagcagagagcataaatgcaatatgccttctaccctgaacgtgaaactgataaagaagggaatcaacaggggattttgagttatctatgtccttcacatggaaatagatgttgtttggtctaattgcagggaaactttttcaaatagtggcttttcaagtggatgagaatcaacacaggaagccagtgatatgcagactggtgacaataggcttacctgagcagcaagacgagtccgtactaagtccaagggatatgtcatcgaagctgctgttattccagacaaaccaccacctatcaatctaacaccaacatctgcaccaaatccaccattcctgtcaagaccaggtatcatttgtagcagctgcacagtccaaatttaattaagaaattagccatataataattgtgatagagaatgagcatgcaagttcatctgaagaaatctgtacttacgttcttgtacctctcatatgtgtaaaagctaattgaggagtaaggtaaccggtgtgcaatagttacaagatttcctttccagaatgctcggaagccttcttcgtagacaatgcgggatgcctcacgccatatgctagtcttccgcatggtagccacatctgaatgcattccttgcacctgcacatagaatacataaattggattaacagccacagtattttaagtaaaatattgtaagaaatgtgctttcattgcttataaagaaaaagaaatgagtttgtgcctcgtttcacacatcaaaccagatcaagatttctcaacaaaagatcttgtgcgttgagttttctcttcacagttaagttgtgcaaaatacttaatagttgctcgggaaaacaaaatgccaaaaatattcccccttattccacctatctgaagcaggattagtcctcgcagctcagctaaatagtagaaacaaatgtctcaccttttcttagttatacaaacccaaatatcgcatggattcatagttgtctacacatgctcagaagaagttaaactacccggtcagcagctaagacgaacctggaatagaatagtgaggcgggcgagaggcgcggtacaagtcttgctgacggcgcccgcgacgccgccggcaaggaggtggggcaccgtccc

SEQ ID NO: 7093 - DNA, 1110 bp, Oryza sativa
catcaaaccagatcaagatttctcaacaaaagatcttgtgcgttgagttttctcttcacagttaagttgtgcaaaatacttaatagttgctcgggaaaacaaaatgccaaaaatattcccccttattccacctatctgaagcaggattagtcctcgcagctcagctaaatagtagaaacaaatgtctcaccttttcttagttatacaaacccaaatatcgcatggattcatagttgtctacacatgctcagaagaagttaaactacccggtcagcagctaagacgaacctggaatagaatagtgaggcgggcgagaggcgcggtacaagtcttgctgacggcgcccgcgacgccgccggcaaggaggtggggcaccgtcccgagctgcggctggtggtggtgcagctgcggcggcggcggctgctgctgctgctgctgcgtcgagtacctccgagcggccgcggcggcggcgccgctgtccatcgttgcggcggccatccccactctcgcctccgtctgcatccgccgcccctcccttccccttccgcccccaccaactctggagagcggattctggtgggcttgaccagatcagggagcgccgcgggtgggaggaatgcgtggggagaaagcgaacataaaccctagacttgggggacggaccggcgaatcgccacgggaaggggaggagggctttagggtttgggaatattatttgggatcccctctttagttttctcctttgtgtatgaagtcggcgcccgcgaataaaacgacacgatgcccgtcgagacactgtattttctatactgtcgttgtcgacccactccaagaagtgccagtgatacatttcttgtaaaactacggtgatgcagtattcaaattgcatagtacaatattttgaccacaattatttttttacttcataccactcttatcttgtactacgaatgtacgatggcagtggtactcatttcagtttttaatatgtctggagtcattgacttttagaaatatatttatcattcatcttatttacaaaaatatgtatttgctattgtagattttgcattcatgtatgtttaaaatcaaacgacgttataataaaat

SEQ ID NO: 7094 - DNA, 293 bp, Oryza sativa
  unsure (1)..(293): unsure at all n locations
nnnnnnnnnnnnnnnnnnnnnnnnnnnnnnnnnnnnnnnnnnnnnnnnnnnnnnntacagtgcagagctggcggatctccgactcggagagctgcacctgcttccccgggcgcgccgtccgcacctcgagcaggcggcggatgatatcgtcgaggaggacggcgtccatcccgccgccgccctgccctcccgcccccggtgccgccgccatcccctccctccccttgggcacctggagagatcggcggagttagggtttcggctctgcggggggaggaggagggggtggagga

SEQ ID NO: 7095 - DNA, 1064 bp, Oryza sativa
ctcccttccatgtcgttttatgtagtagcccatttaccagatttgaaatttatatagtcacaatttagttttagtactgatgtgcaataaggtttataactttttgtctataagaaatttggctcgtctatatttcactcttttcttcataaatcatgaaaaaggtcatttggcatatatctctttcatacatgttcacttttcatacaagtttgcaatacgagaaattttacgatctttacttagaggtggcatattttctaacgtaaagtttggtacctttgtacttgaggttctgacagacaccatttttacactaaaaatggtacttactcatggatcattatataaagagtgaagtatattagcggtctctaaacttctgccggtgtatcatctaggtccccgaacttctaaaatacatttttaggtccctgaacttgccatgtgcgttatataggtccaaacggattctaacccactcgatgcgctgacgtggcaatgccacagtgacacctacgtgttagtggaatccacatgtcaagcatatatacaaaataaaattaaaaaccatattttctcctattaggtagacagaaaaaatataaaaattctaaggtagagaggagaaaatatgtttttctacttatatttttttctatgtggctgacacgtgtgtccaactaacacgtatgaactatcatggcatgccacatcagcgcatggaaggggttggagctcgtttggactcatatgacacttctaaacaagttcgagaatccgaaaatgcattttgagagtttctggatctagatgacacacccacataagtttaaggaccgctcgtgcacttcactcttatataaaatcactcttggaagaattttttttaagcattgtttttttacagaagatatatgatttctcctacatcacaataagggagatggagggtaagaaaacaaaatagatgccccttaaatgagttatggttgagagtgaaagtggttggagggaaaaatagtactgctctttttttggacaaatttgaatagtagaagtgc

SEQ ID NO: 7096 - DNA, 566 bp, Oryza sativa
tgtcattctgagaccccgcggtaccaaagaaagcatgccatatacgaagattttttgatgccactgcttcaaggatcatagtaggaacaccttgtttaccacttgtaaactgacccgcccaacctttcggacaattcttccatggccaatgcatgtaatcgatgcttcccatgcacccaggaaaaccacgagcctcattttcttgtaagatttattcaagttcatcgcttcttggaggccgtagatattcgtcaccaaatgtttcaatcacaccttcagcgaattttcccaaaatctccaaacaagtgcttgcagctattttcaagacctcatcaagttgatcagccgaggttccataagctaacatcttgatggccgctgtacacttttgaagtggtgaatgactatttctaccaatagcatcgactctttgggtgaaataaggggaccaatcgctaagtgcatgcacgatacgcaggaacaatggcttattcatcctaaatctcctacggaacatgtcatcggtgtagataggatttgcggaaaaataattagcagatttgcgg

SEQ ID NO: 7097 - DNA, 454 bp, Oryza sativa
ctgcaaatcgaggcgaggccacagggtaccgcattggccggacatcgccgccgccattgtgcgtcgacgccgggcatgtggtcaccatggaccggatatgccggctgttcccctccggcgatccactcgtcgcttctaacccgcagatcaaggacacatgcctctcgttcgccctgttcaagctgcagctccggcggttcgtcgggtgccccatcgccgaggcgggctctcgccgttcggtggcgttcgtgctcgacggcctcctcggcgagagccacgagcgggtgttccgggtgatcgagaccgagctgtccttcctcgccgacttcctctactccaagctcaccgtcttctacgcgagcgggtggtggttcccggtgctcaactcgatgctcgtgttcgccacgtgggtcagctgcctcgccgccggcggcgccatcgtgcacgacatgac

SEQ ID NO: 7098 - DNA, 158 bp, Oryza sativa
atttacaagtggatattcggctgaaatgtggcttgatgcagcacacaagttctatgtggatgacaacaaagaatgcaaagacgtggttggaccttatatgctgacagaggtttggaaaatttgcagagatgtgccaaagtggaaaacatataatgaaa

SEQ ID NO: 7099 - DNA, 163 bp, Oryza sativa
caggtgtatgaagagcgtctgtgcaagttcaggtacttagctggagacttcctgagccttgcggatctgagccatttcccaactgcgtactacctgctggccacccctcatgctgctatgctcgatgagttccctcttgtgaaggcttggatcgatggcatgt

SEQ ID NO: 7100 - DNA, 167 bp, Oryza sativa
ccatctccgattcaacttgcttcattgtgctgttctcctagtccaggattttctcaacgtccttatcaatgatgaaagggccaactttgtcaaatttttgggaggtatgtgaagctatcaaaatttatgctacaaaatttgatacctcatagtatcttctgatatcc

SEQ ID NO: 7101 - DNA, 337 bp, Oryza sativa
acaaagggagatgagaaggtaggtgttgctggtgggtttcttgaactagatactgcatcacttcctagtaacttggacgtagcctttccatcggtactcttgattcttgcatgcctgtctgcaagacaatgaacagtggatttaatgatttcactggatatgagcaaggtgcgctgaaagaaaatttgatgaacgaaggtaaacgtaaagatcattcccttgaacgaaccccagtgcatcaacagagtgctgcctattcctcccccagtacttttgattacccaaactctgaatttcataactttgaagaatatcgatcatatagtaagtttgaacg

SEQ ID NO: 7102 - DNA, 2403 bp, Oryza sativa
  unsure (1)..(2403): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcagcccttgccgcggtagccgtcgccgtcccagccttgccatattaaccgtcgtcgagccattcgctgccagatctagcgccggtcgccagccccctttgctgctatcgccgctggtggcctcatctccttcggacagatctaggagagggaggggagaggagtaggaaagccagcaccgttgctccctctgttgccgctgcggccatcgtccttgatccccgccagccaaatccgggagagagatgggaggcggcttcatcgctgtcgctccatccatcgatgctccccttcctccacctctccatccctcccctttgccgctgttggtatttcttaacgacattactagaaatataattcccagcaatggcacaaaaatattactggtatattacgattacagatatggtctgcaagcgcacggatatactattatagcatttcacccagaagactatactaataatttatatgttacttgtataaatcagagtgtaagcaggggttaattaattcaagggtagagtgacacgaagaagaagaactaagttactctcattaaataaatccttggctaagtggagaaagaataagaaaagaattcatcctaatacttctagtatacaagtatctttaatttaagctctatagtatacaatcatgcagccaatacccctctatgccttcctggtatttcaagagaccacccctgattgccgagtttcttacgacaacccgtcatggccgtccaaccggaaatgaatacggaggaataccaattaacttaggactatatactaacgtggatgaatacccgtactgagctgtcaccatcagtggcccaactctattgtcccgcagcatataaccccaaataatgatatttaataatctaagcaccatgcttacattatcaaatactactctatatctactagcatgacatagagcaatcatttgcatgaacattatatccacaccattacatatctttggtaagctagctacacaattatatcaagataaatataaagtaaagtcggtactcagataataagaatgaagtaaaataccaaaactgaataaagaagaatatttaattaattgtacaagtattacaaaagagagagaagctactagagccatacccgaattctcctgaagacttgaggactaagaaaactattctatttcttacttcactagcactagaatactaactaaacttaagagagagcttttgatattcttgcttgagtgtgtggagaagtgagtgaggtgagcttcttttataggctgagtatgatggttggaaaggtcggaaacgccctccaaccggaattggagtgaatcctgaacgtccacgctaaacctagcctcaacggctgagatgggggttcggccgaaccctggactggcccaatcggcccaaatcttggcaagcctcctccccgttgattccttagtccactgacgtggtgtttataggccttttgagattatctttggatttataggcccatctatccacaaatctacctctcgacggcttccgattgattgttcatctgttttcctctcgacggcttccgattgattgttcgtctgttttccatcgattcatcttctctttatgtagcaatctctaaaatcaaatagaatccaagtacaagtggaaatagattattctaaaacaaatatgcattgcaagcatagctagttctccgttattttgagtatattgatggttgaaattggtctataatgaccatcaacagccacccctacccctttgctttcaccggacaccgccgtgacccttcgccgctgctggccctgctacctttgtcacttgggccaaccaccgtcgaattaagaaagagagatgggagggaggatgtgaggaattgagagagacggagagaggggtgcggtgggaaaaggaagaaggagagagagatcgatgtgcgatgggataagggaagaaggacctgtcccacattgaacccgacccgttttcacccctacacctcagttcaaagtgacatttaactatttgccgcttttaagatgtggcaattaagaatt

SEQ ID NO: 7103 - DNA, 6171 bp, Oryza sativa
gcaattaagaatttaccacttgctatctatgacatgtgtgccttcatatgtatatgacatgtgggtctaatgacaaatcctttattaccactcataaatgtggcaaatagtaattattccccattcaaaatacgtgacaactttcccctatctacatcacgtattcacgtgatagtgattgatccccttgtgtcgaaatatgaattcggcaataatgaaagggggtagcgcatgagacctaaaagtggatggatgcagagacaaggatttagacaggttcagaccctctcaatgagaggtaataccctactcctgtttggggatttgaatccgccgggtgaattatagatctgatgatctagttgtgtctcatgcccctagagggcctcctgcccaccttatataggatgggggggtaggattacaagatagaaaccttaaccaacacggtatcggtttcctaaatctactttacaatattaccaaaccaggactttaggccgttccgtaatatacaaggaaacgtaatacccaagtcatgatctgttatatattccatagatataagttatcccctataactagtcggataaccatgccgtgtgggtatggggtacccataatctccacagtagcccctgagaccttcacagtcgaaaagataatcttctctcgaaccagattactccaaagccaagtgcttcaatcatctttgccatggtctcccgagtacttttaccaaatatgaagactgtggagggctgaaaaataaagtcaagtgcatcgactagatgcacctaataggtgtagcccccgactatgtggtttgctgaacaaactaagcatacagtcaaggaataaataatccaaccaaccgagtggttttgataattgtaatcaaccaagtgacttgatatcaatatatagcatatgcggtgtgaatcccccaaataacatgatccaagtgatataccgactgctttataaaaattgatgtgagcaatctaaagttgactacatcattgaaaattcacatagcaaaatagctataaaaaagctcgaatgctgtgaataaagaaatttctaaagtattgggcatacgccatgtgcacactgctttaacagatgtgcttaagtctctaaaagacacatggtttcaccacacccgaaaatatacggcatatgtggtgtaaaatccgagtaaataaactcataaaggatttaccaaccgcctggaaaatgaccaatatatataatcagcctaagccataatattggtcaataaaattgcacacttacgtggcaaaaagcaacgatattgtatccaatcaattgcttaaaaacccaaacaacaccttgacttatataaaaaagtcagcggggcagctatataaagctttactatttgacattttttaagatgcattgtaccaactcctaaaaagttgagtaactgcggtataaaaggattttaaggtattgggcacttgatcacgcgcactttggcctaagcaaaaagtgtttaagtccctaaaagaacgtgacaggccacacctaaaaatatgggctgcagacatattaggcctaggccaaaaaatatgccttcgacacccttcaaaggatgacgcatgtaacatgctcccgagtaataaatcttccgggtgatatagaccaagtgtagcttatataaatagcttctgatctgagtgattatctcttatgggatactccaaaatagatataataattgaatcccgactggcgcaagtattcggttgataacccttattgggaataataaatagttcagtctttgagcatagaaaatagacccatgatcatgaattcatgttgcatgtatccggaacaagtccaaattgaaggtatgatacttgtatttgagctagtaagcccctgagcatatagcttgtccttctgtcgtagtcacaattgttcattgatggtagctgacacagttggcatagagacaagacgaccaatatagagataatattgcccaccagaggtggcaaaaatattggtggtagtgaagatagtgataccaatcaaaagtgatgaagtcgcacagccgtggaggagaagaactcagtcgacagcagtcaggctagcaagcagtgtagatgaagccatctggcaacagtgacagagttgtgtaaccatggcggcaaaataatcagtcagtggcagacaagacggccagtggagaagtcaaagtcgcacatcagtaaaggcataataagccagtcgtgaaggcgatgacaccagtcggtggcgacgaaggcaagctgatggtaaagatgtagatgctcatcaagagtaatggcgaaatccaccaatcatgaagattaagaaaataatcaacgactacaaatgcaactaacggtaatggcgattagcagcaacagagatgatcgactatgatgacgaagttgcccatgaacggtagcagagtaggctatgttgaagaggcttgataggatgttgatgaagatgagatgtcggtgatccagtcaatagcagtgtagcagccaatgataatgacgaagacgctcatcagcgtttgtgtagtaggtcaaccgtgaaggcaaaataataagtcggcaaagtcgtagtcatccattagcaacggcggagatgtcagggccgatgaagctgaggtgttggtgatgatgccagtgacaataatccatcaatctattgagaagatatcaaagctcgagtagtttccttgatgcgggcgtgtgcataaagaagacgatccaacgcttcttgatttacgaagatgactgcagaacttagtgttatagctgttgtagatgcttcacttggaggaaagtagatgttgttgtccactcgtctaaactgagctgattggttgataactccaaactcccgaacctgtagattaaatcttgaacttgatactttgagaaatttggagtagattatggcagcgtctagaaaacaaaattgccagtaaaataattggagttgctaaagtagaatgtcttctctgaagcgaagacgaaaataataactcccagagttgactcgttgattgattgatttcttcatcttgacataaaacttgtcgaattttgagtcttgtatttgtgtagcccccgactctttctttagttgggaaacaactgaacatagagtcgagaattgtagcttcttgtcgtcgagtagtcattgcttgagtgaagatacatattgaagatgtccaggtagaaatattgaagattggaacaccacttgtagtagtagaataacacggcgtcgaatctggaagtgcatgccaagatgtcgaagctcttgtagacgtcatggctagtgaagtagcaaaacttgcgaagtagtagcaatagagtttgctggtgccgaagataataaaaatgaagtcgctccaccatggtgacaaagttgcatagccgtgataaagtaaacacgagtcggcggcaacaaaagcaaaccagtagcgaagacgcgtagttgtgaagataaaaacactagtcggcgacggcttaaccagtcggtgacggaagaagtagaatgatgacaaaaacaaagacgtccttgaacggcggcaaaataggccagctgtgaaattgaagtcaccatgaacagcaacggaggcaaactggcgatgacgatgatgctagtcaatgatgacgaatacgcgcagtcgtggaggcgaacaaaccagtcggcgtcagataaagtgaccaacaatgaagacgatgacgtccatcaatagtggtagcggcataaaccagccgtagaggcgaggacaccagtcaacagtaggcgagacgtccggcgatgaagacgataaggccaatcaacagtggcagaatcatgcagccacggaagtgaagaaaccaatcggcagcagcttgcgttgaggatggtaaggcctattagcggtggcggcgacatggccagccgtgaagatgacaacaccagttggcatcatacgaggcggccggtcggtgaagatgtagacgtccaacaacggcggaataataggctagccgtgcaggcggagacaccagtcggcggcggcgaaggcaagccggtcggcgaagacgtagatgcccgacaacggcggcataataggccagtcgtgcaggcggagaaaccagtcagcggcggcgaaggcaagccagtcggggaagacgtagatgccagacaacggcggcataataggccagccgtgcaggcggagacaccagtcggtggcggcgaaggcaagccggtcggtgaagacgtagacgcccaacaacggtggtgtgaccaaccaaccgtgcaggcggaaacaccagtcggcggcggacgaggcggccggtcggtgaagatgtagacgcccaacaacggtggtgtgaccaaccaaccgtataggcaagggcaccagtcggcggcagacgaggcggccggtcggtgaagacgtagacgcccaacaatggtgatgtgaccaaccaaccgtttaagcaagaacaccagtcggcggcaacgacggcaagccgatggtgatgttctgactgatccattcctgaagcgtaggagataagcttaaagccatgaatccctactgtgcatatctggatctggatcctgcagaacaaacatataggatgagtagtatctgatgtaaatataatactcgaggaacattcaagtattttaaaatgtttataaatatatatttctcctcttgtcaattttgatttccccgagcagatgactccttacgtttaaacactctgcccgactagtcatagcccccaagcactgggagtcggcctaggcacttcccaaacatgcaaatgagtgacatgagttcgtcattaatggagcaaagtttcatggatcggagtttactactcaggtacttttgcaattattaagagtagaaaataaattattttatctatatgcttttgatttattccgaataatacttagcaccttgcgttactcggtccatccaacgagcccccgagtgctaggaatcggcccaaaggcaactatccattgacaaaccaaacgggaagcataggaagatagaactccataactcgataggcactttattgatactcggattatttcgtaagcaatcaagataaatattatgaaaattgttgaaaaaatatgatataacatctgtagcccccgtctcactagtcaatggcgaaccagttgatgtagtgaggcagaggaaaatgaaaatatcatataaagaataaaataataatgacttagcttcttggtatttccctcgatgacaacaaaggagaccgatgtaggaacgaagtcatccgtcaatggcgacgaaataagccagtcatgaaggcaaagacaccaatcggcggcaacgaaggcgactagtcggtgaagaagtaaacgcccaacaacagcggtgtgaccaaccacccgtatagacgagtacaccagtcgcaagccgcggtgataatgaaggcgtagacgcccgacaacggcggcgtaataggccagccgtgctggcggctagtcggcggcggcgaaggcatgccggcggtgaagatgaagatggccatcaacgggggtgtgaccagctaaccgtgacggcgaggacaccagtcggcgacgttggaggcaggacagcggtgaagtcgtagacgcccaacaacggcgggataataggccagccgtgtaagcggagacaccagtcggcgacggcaaaggcaaccacggccatcggtgaaggcccatcccggtgagatgtcctagctgactgccaacatgaattggcagccatgccaaatatatagatgaacatactgtagatagcttgatgtactgcattgttcctcaaaaaattgcatggtgttgggtttggtccaattgatctgaacagagatgaaaccaccaaagagggcaaaaactctgcctctgtgtgcacgtcatcgaggccgtggtaagtgcagatcatcgtggcaaacaaaaactgcaaaaagtccggcggccgtgaccggcgctcggaaagctatgcatgtgtgattgttgattaagccatgcacgcacgtgagatggaggcgactggcggcgacttctgtggtgctgatgcggtggaggccccctggtcaactgaatgcatatatactc

SEQ ID NO: 7104 - DNA, 17121 bp, Oryza sativa
tttgtgaaatatgtaaaattatatgcctacatgaaaatatatttaacaatgaatcaaatgataggaaaagaattaataattacttaaattttttgaataagacgaacggtcaaacatgtgctaaaaagtcaacggtgtcaaacatttcaaaacggagggagtatacgcatcttagatagataaatcacttgactaatcaaattccttcctgattgcttgatgtgttacgtgcaattgctgatgacgtggcagctcgatagacaatgtcttcgagtattgctgatcagggaaatagcacggcgacgactgctctgatcggttgcctccctgtgcaggctgactccgatttggtgatcatgccgatcaaggaaagaaatctgcagcagctgagattgaatccatcgaggtcaccgagattaacccttccgactagattggatccgagttggagaagaaaagcttggcgaagtcgtcggcaggcaagtccggggctcccaaagcggaaagcctatcctggagcgaagacgataccggcgacgtcgaagattggttccatcgcactcgtcgacaggaaactcggcgccacccctacctggcgcgccaactgccgaaacatgaattcgacaataatgaaagggggtagcgcacgagacctaaaagtggatggatgcagagacaaggatttagacaggttcatgccctctcaatgagaggtaataccctattcctgtttggggatttgaatccgccaggtgaattatagatctgatgatctagttgtgtctcatgccccctagagggcctcctgcccaccttatataggataggggataggattacaagatagaaaccttaaccaacacggtatcggtttcctaaatctattctacaatgttaccaaaccaggactttaggccgttccgtaatatataaggaaacgtaatacccaagtcatgatctgttacatattctatagatataagttatcccatataactagtcggataaccataccgtgtgggtatggggtaccataatctccaaaccttgcaaattggaattaagattgactcaaccaaatccgcaatcattccgatcgctatcaacccaagaagcaagtacaacgaacaaacggcactaccaacgccccacacttggccactagccacccgtgtccgtacacaaaaggtcgcacattacacgcacgcagctcctccaaacgcacgtataccaaatcaaccctccataccatccctccgaaaagtggtccccaccgtccccatggccccaccatgtcatcgatctaacccttgcgcgggtatgtcaccgctgagtagacaccggataacaaactgccacgtggacccgtggcccccacctcccgagacattaggaaattattttttttaaaaaaaaaagaaaaagggagatagccaaaaacgccatttgggcaaatctagctcactccgaaagatcaaacgccccacccgaaaaagctttcgtaaatcgagagagagaaaaaaagaatcgcgcaccggaaaggcgagaggagggaggaaggctgcaagccctagcgccagggcgaagcaaccggatgtccgggcgcgcgcgcgcgtgggtgcattgcgcgatcccttcacgctgcggcaagccagaggcgaccgggccgccgcgcgcgcgtcttcaccttcttcccgggcgccgatccatggcggagcggcggtggtagaagggtttcgcgagcgggcgtggatccgggggcgggggcgccggtggcatggcgctcttccgcaagttcttctaccggaagccgcccgatggcctcctggagatcaccgagcgcgtctacggtgcgttcccctgcctcgatgccccgtctatatgggattgtatgccatttgattcgttctgggatggatacgccattttggagttcttctatgcgtgtggcattgcggaatcggtaaggtggtgtgcttgcatttgtcatgcaagttttgtgaaatgtttcatcatttttgtgaaatggtttaaggcaattttacagttggggccgcaatccagtttattgggtagaagttgtagttagtgcagagattttggactgttctagaggaaattgtagtaaaacggcatagctgctatctgagcattaggctcgtactgtccaatggatgatatgccattcatactagtgttgtataaatatataacataaggtatttgctgaatggagggcagcttacctaacttctcatgagaagtgatcgttgtcattgttatttactggtgtccatgggaggtcttctatttaatcttggtccactgatgggaactcgaatgttcagtcaagattattttgaattaatgttacttttttgtttgcaattttaatttttttcctctgcaagtttaaatatttttagaattaacttagtaatggcaggtttaaatccgtctttgtatactcaatttgcttctgtttgctgtaccattaatttgtctcgtatgctatgttatgcctagatcctctagattatgtttccttaaccatttatgctttctctaatgatattaataaaatataccattctgctttttcagaattttgaaaaaaaaaatcatttttcctggtgattaataagatccatttatgcctttcaaatgtatgtggaaaagtaaatcttgttttgttgctaaaattctgtcgtcaatgtcttttccttctgtagtatttgattcttgcttcactacggatgtctttaacgatgataagtaccaagactacattggggacattgtcgctcaacttcaatgccactttgctgatgcctcatttatggtgttcaactttcgagagggagaaagtcaaagtttgctggcaaatatcttatcgagctatgagatggtagtgatggattatccaagacaatatgagggatgtccacttgttaccattgagatgattcaccatttcttgaggtcaggggagagctggctgtctttgagccagcagaatgtgttgataatgcactgtgagcgaggtggctgggctgtacttgcattcatgttggcagggctactgttgtatagaaaacagtacattggtgaacagaggacactggagatgatctacaggcaagcacctcgtgagctgattcagttgctctcaccactaaatcctataccctctcagatacgatacttacattatatatctcggaggaatgtgagcgcagtgtggccaccaggtgatcgggcacttaccttggattgtgtaatactaagaaatattccaggtttcaatggggagggtggatgtagaccgatattccgtatttacggaaaagatcctctacttgctacaagtaacacccccaaggtgcttttctcaacaccaaagaggagcaaatatgttcggctttacaagaaggtcggttgcaaactacttgaactactttccgattttagaactggtagattaattggtcagattgtgtctagtgtttcccatgctacctttcctcttaaccatgtagaagaagaaatatatatatttgcttgaagacgttctttcagtaattcctatcatcatcacatctcatttctttcatgttactcaggtagactgcgaattaattaaaattgacattcactgccatattcaaggtgatgttgtccttgaatgcattagccttgatgcggatcaacaacgggaagagatgatattcagggtcatgttcaatacagcatttattagatctaacattctgatgctaaatcgtgatgaaattgacatattatgggatgcgaaagaccgattcccgaaagaattcagagctgaggtatgtattccttgttgaactaaacacattctcttaaaactcgtgcagtatataacaatttttctttatcctctggttgaaggttcttttttcagaaatggactctgtaaatcagttagattccatggaggtgggtggtataggagagaaggagggcctcccagtcgaagcatttgcaaaggttcaagagatgttcagcaatgtcgactggttagatccgacagcggatgctgcagccctactttttcagcagcttacttcatcagaaaacattcagctgagaaagggtttgttgtctccaaataagaaagacttccatcttagctcaatttctccaaccaagaaacagtctgacaatgttgaagataaattaagcaatgctgaactctcaaccatctatgtgcacaaacaagaaaataatgacgttcaggggttgatcccacagaaacaagccaccattcctgatgaaaaatcagggtcgtctgtcatccatgagaagatgatttctctagttcatgaggagataacacaggtagttgacatcaatactggttgcctatcttcattggatatgacagttccttccaccatgaactctagcagaccagttctaatcgaccaaaattctaagcttgatgatcagtttggttcactacagagctcttcacccacaatgattatgtcgcagcagtttccagtttctaggtcaagttctgtcctttccagtgactttagtcctagattactttcagcctgcccaagatttcacagtgcaccttctgcccttggaattacggctctgttggaagaccatgctgcatttggagacactaagaattctgtcaaagtttcaagtgccgtggtcaaaattccatcaaaacagtcatcacaacagcatccaataacaggtctgggtcgatgaatcttcttttatagtatacccatattgtcttttaccatcattctcatctgaacttttgataatgttaacagttactcctgttgtaacgaagtgtacaccatcaccaccaccactgcttcctccactggctccggtggtgccagtaccatctgatgatcaaatgatatcccaggaaaaagacatgtctcaacaggctcaaaagcatccaggttcagcttacacatgttaatatattctagttatgtagaattccattttgtaattaaagttctttccctgtggcagacctttcatcatttccatccctatctcctactcaacaaaaacaatccacatcaaaattatgtcaaactattctgcccacaaatcatcaactgtcctcaagtaacattacgaaagagccactacaaatttctcctgctcccactccacctccattgcctactccatcaacttccagttctagtagttgtcattgtctccctccagattccatgctttccaccacaacagctttgttcagacctccagcaccgccgccaccaccacttcaatctccatccactcctagatgctctcctgttagaactcttgcattacctccacctcctcctgcccctacttcatcgcctgttagaatgtcagggcccttcttccccacctcctccacctgcaccaaactcgtgtcccagtagacctgcaccaccttcacctccaccttcaccacttgcttcaacttcatctcctccccgacctgccgcaccatcaccgtgtgaactacatacttcaacttcatctcctgcacgaccagttccaccacctccaccaacattatctacaattagatcttcagcgccaacaccacctctactgcctggagctacttctgcaccatccccaccaccaccaccacccccctgtagttcatcaaatcaactgtctgctccgccaccgcctcctccaagcttctcaaagaacaatggcagtattgcgcctccgccagcacctcctggtggtaatgctaaattgcctggtatgagggggcgtggacctgcacctccttcaggtccaatgtctaggagccttcaatctggtcaggctgcatccagaaggtccaacttgaagcccctacactgggttaaagtaacaagagcaatgcagggaagtctctgggaggagtcacagaaaactgacgaagcttcaaagtattgtaccaacacaaccacactcatagatggttatgtacattatgagttctatgttaatgcatcttttcgatgacttgtgcagacctccagtgtttgacatgtcagaactagaacatcttttctcagctgtcctgccaagttcagatgggaagcgttcagataagtcaggaagtcgtgcatctggatcaaaaccagaaaagattcaccttgtgagtttttccaaaagatatagcatatattgttgttcggcaattcttctgttaatctgctaaaatgctaacctgcattctttcaatgcatgtataaatatgatttcttgcgagttatgacattcagaacatggatattaattctcttgttggcacatattttcatcatgtacttattctctttattttttactttctggcttccatcgaggcaaacctttcatatctgtgcacaaaaggctttcagttgtaatcatactggttagtgtgcataaattttctagtgcattgccatgatagtttccagtatcactacaaaattgtaccaatcatgttctatatgaggtttcactagtaattgatagatctccttattatagctatagaaatatataatacaataccgctgttttttcatgttgtacttgatattttcatagacttctacgttaacatgatagacttgttaatgtcttaccattctatctcaaaacaagtaaacacaaacatagtctttgtgctttcttatgtctaaatctcctggacttgcattctcatctgtctaccatgcctaaataaacttcatttgattagtcatggttttatttttttgttacattttgctacaactcactagtaaggttaagacatgctcattctaataattctaatgattttttgtcctttgttcttaatcttaaaaccaaactgctaactgttctagtcagtagaatgaatgaaatgtatgcatagttctcagttcagtaatgcttatgttttagggaaggcctacagtctgtattgtaacagttgattaaacaacatgagggcacagccgtttatatcttatttagaacactgtaagaatggttactatccattttgagagttacttggattctgtaacatcctaattagtcaggttatcacaaagattgataaagggacataaaaagattattagcttacactgtttacaaaagccatctcatgctaatctgcatgtagcagcttaagctttaagttagtaacttgtgtaatatattgagcctgagatgctacctagtatttcaccatttcatcagttcctctcttgagaaatgattgtggcagatatatgctacagaagatttttgcttcattcatgatggtactgtaagttttgatgtgtgccttgttagcttgtttttctttgtcctccattgacctgtaaaatcttggtggttttgtatgtcgaacaatcgattgtaaacaatgttatatcgactatttatctcattctgatatgttactgcctatatacacagattgaccttcgccgagctaataattgcggaatcatgctaacaaaagtcaaaatgcccttgcctgacctaatggtaagctgatgaacaaaaaaatttagcatgttttgtgtaactattctgctattatctgaagctactgatatagttgttcatatgacaatttagaaacttgtgagaatcttctttacataaaggacgctgagaaagtgaaatagtgataataccattttttcttagagtcattggatgtgacaactgtgcgtcatacgctaaatgcttacctatgtgtagtagaaataatctaaagggaattatatcaacagtgttccttctggtcagatggctacttttgcatttggattgctgttaattatattgatcattattttcttttgaacgcagagcgcaattcttactttggatgatactatcctagatgctgatcaggtggaaaaccttattaagttcactccaactaaagaggaagcagaacttctgaaggtgatttgattactagggtctaatgtagttttcatttctaaaaacattctttcgattcatactatgctttctcgtaagaactaatgctcggttatgattaccagggttacaaaggagataagcaagtacttggagaatgtgagcaggtgacctatattctttcagtttgctttaaagctagtcagttccacatataaagtgaaaaatgtgatgtatatgctaccctctttagtgggaaggcattcccatagaactccgtattgcacgaaatccataattgacaatttacagaacacactccagaaaagttttttcgttaactgattccgagataccatattctgctttctgctgcagttcttcatggagcttatgaaattaccccgtgtggattctaagctgagagttttcttatttaagattcaattcccttctcaggtaagacaagtgatttacttattttgctactaagaactgtgatcttttggttggcccttttggtatttgaagttcatttttcccaaactacttttgtgcaggtttctgaccttaagaggagcctgaacattgtcaactcttccgcggaagaggtggggcaattattgttaattacaaatttcttattatataatagttaagattatgcatttcataacatttctatgatgttcacagataaggggttcagctaagctgaaaaggattatgcagacaattctttcactgggaaatgcgttaaaccaaggaactgctagaggtaatgaaaattgtagaagtattagttgtccaagagaatatttggtgagcaaccaagtgctattcttatttttttcataaagactatttgaaaatcttgttaattatcctttgtaatctggcatgttcgctcgttctgcatacctgctctgcattctttacaagaagtttgcctatactgcatctaagcatctacctagttaggaactgagcctagctcagttggtcgagggtgtggatgtacgcgcagaccacccaagttcatgtcctagttgaggcaaatttgggtgcctatttcttcttaattaaaaaaagccacctagttcctcgtaggttggtcgagtgttttttgttgctcttagtttctaaaatgaagtttctttttttttctgcaggttctgctgttgggttcaggttggatagcttactcaaactaagtgacactcgtgcacgtaacaataagatgactttaatgcattatttatccaaggtatccctctgtttataactttgcatatgtgtatatagtttaattctatttagtctctcagaaagcacatgatccattctccaatgtctatatgccgtatagataggatgacatacccaacagaaagatgaaatacttagtctaaacttaaattgttgtcattatctgattatgatgatgtgcggggagcccaaattcctgagctagatggtcctttgttgtatgaactctcaatcaattatattcttacctctctttcacaattttttaaaaaatattcttaccttagccttggatgccaagcatgtaaaattctttcttccgttatgaacctttgaagttatttttttctaataaaaccagtgtaaaagccacaaataataaccaatttatatgacatgtttttggaaacttggatgagtggaacttgtgtttctggtgagaaatctggagcatgttcacatatttaatttgctttcgtgattgtcccgttagctagttattgctgtagtttgttaatctaagttgcatatctagtttcttgtgccttgatgtactcatggtggattcttgataaaagaagactagacattatccagaaacccatttcactaagtactgttcaactttgcatcctttatatcctcaaatgtcctttagatttctttttgtttgtgtgtgactttaagatttaaatattagcttcttgagaaccctaacctataatgatcctgatttcaaagtggagctaagccccctccaagtagatcctttgtgtcattctgataaagacctttgtaacttggtaattatatttgtttcttttgattatgtgtgataaagtctgaattatagttgatatgcttgaactgtacagtgcttactttaagttatgacttacaggtgctttctgagaaacttccagaacttcttgattttcctaaagatctcgctagcttggagttggcagcaaaggtattagattcaagcagtgtttaatgttttgtttactttgtatgttgatcatcaatcattgattgattgagttcgaagtgaattgatttgatgcaggtacaattgaagtcattagcagaggaaatgcaggccataaacaaaggactcgaaaaagtcgagcaagaactaactacatcagaaaatgatggccctgtgtcagagatattccgcaaggtaactacaagtgttataattttctgagcattcttagtaactgacttcaactggttcactcctatattgggtacatctaggtaccatcgttctgtttaacatttaaatgagttccattaccaatatactaaactaactgccttgttttacagacactgaaggattttctaagtggtgctgaagctgaagttagatccttgacctcactatattctaatgtggtatgtgtctctttgattaactttcatgcctgaactgtagcgcccgttctatgtttggtagcctgttatccacactccaactactatgtttaactcatacaacaacattgtatgatcagaatttacaatatcgtgctacaaggggctagtgacgaattctagtccttgtctttacaggaggcaaatgatattctttttccatctggtcatctctttggatttttcttctctttatcattacatgtatcttatatatctgcagggaagaaatgctgatgcattagcactttattttggagaagacccagcacgttgtccatttgagcaaggtgaaacttgcattgtatttctattttctccagctgtatagaaactagtttcagttcagttatgactttgggagaacatactgacattagttttttttttttccaaattatatcttgttcacaaatgtttgccagtggtcattacactccaaaactttgtgagattgttcgtacgttcccatgatgagaactgcaaacaattggatctagaaaagaagaaagcactgaaggaagcagaagcagagaaaaccaagaaggagccagaaaacgcacagaaaactaaggaaccaggaaatgacaaagctaagcacaacaattcaatcaaagagttggatatctcactccaatcaccagcgcaaactgccagtgccaaatgatataacttctcttgacagatgagccaaacaacactagctttgccaataaaggaaacctgttcatggtgcctgctcctatcagtcaccctctctagctgatgtcagctggatatgttgcgctggatgatggattgaagtgaaccagctgtggcaagaaagtcgcaaagtgaatgggtaagcatcctaaagttatgcagttttttatacattttctcttgaataaataggacaaaacaaatcagtgttaagcaagttatatttgtgcttctctttgacttaaggcttcattttctggcagcccattcagcattctgtcctctgcagttattcatctaacagagcgattgatacttaagaaatgttcctggagacaagctgtacagttctaacaaaataatagaaatgatcagaagcacatttacaattttgtttatttgttccaatcatatgtaggtaatgttcgttctaacagaagaataaaatttatcagtagaatcgtgtttagggggactagcctgtaggttttgttgtaaaaggaaaaaacaaataatggctgattgtattgtatttcttgtctcatcgccgattctctgaaatgttgcttgccctagcagtacttggtaatgctgaaacccaacgctgtatggaaagatgatatggatgcagagatttcaaagagttaaagacctgaggctttgtttggtctagtaccataccaaaaggttgatagtgccaaaacctgggcatgttttagcattacctatttttttaagagtaaagtagtatttggtttgatgccaattagaagctaaaactttgattagaatatataaagcatcaaattggatattggcaataccaccatgtctactattcaagctacatttattggttggggacgtttcggcttcaatccaaaacatggagggttctggtagttgttttgttaggattgacctaatatgctagttgtatgattgtatgattatatattctactcctataaactgttacatgaacatttctaagaccattaagttttaactgtaaggttgatccacaaacacaaataagctttgtttgtttcattgcaactaattctagtatacgtacttttgaagggtgtgtatacgctggttagtttccttctttaccttttatacagtttgcagggcaatttgcagcctcctaacgcgcgttcaagtaatccttgattttactaaatttctattaaaataaaaagggacccgcttatataagaactatgggcaataagatttttaacataataaaatagggtaatacgtttacagtttcaccactatacagcttccacctttctatttatgatatcatagctattgtttctagcttattattattacacagaagtaggggtgggctaaaaatcctagagatcaaactgaaccgagcctggagggcatcgacagccatgcgcgaatgcggtggctgcacagggcccttgatttttggaggcccccacctccgagtgggcaacatgcctggcctgctatggtgctaccgagcgagcgaaagggcggcaccgctcatcgggcatgccacagcggtgcaaccgcagcggcgagcgacagtgaggcaagcctgccggctgggtgctggccgtggctggctctgcggcctcagcctcttcatcatctcttcgccgtcgactcctccatcttgtctggtaatatcttatcgtctttggcatggtcatctactcatagcattttcttttcatttcttttgtgaagccgtgtgttttctctggttgcagttgcatatagtacgtgcctgtcaatccattcgaccaagttgatatacgctcctttgcaattatttactgcgtactacttttctcacgttggtcatcgattgggctggatatatattcggtatatgataatttgaatcaaattcgcaattaccaatttaccatgattgtagttttcaaaattaaattacagtattttgaatgatagattagattgatcattgaacatgactgtcttttcttttgtttacaaaataggaagacatttatttcctcgaccctcagcatgtcttatagaaataagaagtataattcgggtgctgaaaatgatgtcttggacaatattaattatgaggatataatttaagatttcatccaataaaacgccagatgcttttcagtagaacatgatatcaatactaccttttctcttttagcactaatatttgacataaagtatgcttaattgtttacactagcattatttttttagaatttagggtccaatttgcatttcgttctagggctccaaattcttggagatgccctgccgagcaaattccggtttttggtttgtaaggctatatggtagatgttaggttggtttcttgaggatatttcaggctagtttgattggaaaatgttggttcacgggcgcccgacgcgcgtggctatccatcaggctgtggcgcagccgttggatgtcatccaacgcatcgtacggctttaatcgctcccacgcccgtgtcctgttgcaaccaccagccggaaatcacgggattcccgttataggggaggaggagatccgtttctttttttttttccagtggtttggacgtaatggagcttggcgaccccgtgagcgacgggtgagatccggcggcggtttttgggcgaggcggcgccagcaacagccctctcttctccggcgccggcgttgtttctccccccgtgctcgctttccatacattgccgccgttgacgggggagtagctatgcctagtttcgccggcgaaaactagggtttggaggagcgcgaggctacatcccctcctcatttctcaggtgagctcgtagctccggtgagcaacccgtcggccgtcgtccccttgctgtgaactactcatgtttgtttcatactactgtttctacatgtcccactgtgtttgttatgactgtttcagtattttcttccattatgttgcaccattttacttagactaacctcagcacaattaattttaatgttttagcacagtctttgtagatgtttcagttggctatccatgcttgtttcattatattaataaaacttgtttcaccacatttttgcatgtttgttgtgaactactcatgatttgtttcatactactgtttctacatgccccactgtgtttgttatgactgtttcagtatgttcattcattatgttgcaccattttacttagactaacctcagcataattaattttaatgtttcagcacggtctttgtagatgttccagttggctattcatgcttgtttcattatattaataaaacttgtttcaccaaataacaggctactagacccatccttgaagattgtaggcttccatgtttcacttaagtacttctgagctgcaatgaaaccaaggggagaaatgagcaatgaagtactggcttgttggatagaaatgtttaatgaagagtgtagagaagatagcaaaatgcaatcaaacataaaaaaatattttttatatgtcttctctccaatcatatcggtatttttttaatctagctcccttttttatcctttttttttgcaatttctccttttgctttttttaatcctaatttttccccctatgtattcgaatgttctttcaccccccggagtcagttgattgctgagacaaacaagtttcagcctaacacctgttcaaggaggcttcaagtgattaacaaggagaaacttgtgaaacaggacttgcgaaacaggagaagaaacaaggaggacaatgtttcagtgaatacatcatacttgtttcatctattacatatattttgtttcactaaattcaaataatatgttccacaaggtcaaaaaaagtctccaatcatacactgccagatgaaattgtttcagtatatactcattactagtttcagtgtttacattcatgttgtttcactaaacttaagacaatgcatgaaacaaaaccaaattggttagaacaagctattttcatcaaacctacaattggtacacatcatggggaggtaggggagctgacagtgctactcgactattcgccgaagaactcatcgccgtcggttcttcaatggaaattccttttttcttcggacggcacgattgcgcttcaatatctccgcatcaaatgtgacatttgttccagaagagcgtggttggtgcagagaagagtgtgccggctcctgtcgatgttgcagagcagcggggtagaagtgggcgtgcggcggcgccggtcggggcgttgcagtgtggcgggggagaagacggcttgcggcggcgccaattgtcattggagatctgaggcacggcggcgacgcccagcacggccgggaggagcatcttcgaaggagatcaacggtggcggtggtggctgctccggcggaactctcccctcacgtgcgccggcggtggctcgcgcctggacagcgccgtggaacaagccccgcgatttgttgcagtaggcgccgactgattgaaactcctgtttaatgcacgcagacggacgagattagggtgctggatcggacggctcggacgggcgcccgattttttttctcccagatcgggtgcccgattcgtagtggcttccagtttgatttgctattatattaaaatatttataatgtcaaaacctagacaatttttgacattgctaatattttgacgacattggtcgatatgtcagtgaagaatcatttcaaaagtactattcaaaaacatcaatgatttggtaacacaagttctggttttaaaccaaaacagcccttcggggctagaggcccaggccacggtgcccgtcgcgccacccattccaaggcctgacagcatgcatggtcacgttttagtggccagttcataattcaatttccacagttaaaacagatctgtttagggtgtattttcatctagatcgttgaagaaatctatgtctatcgaattttaaaaatgaaacaggtaagtttctttatatcttccccagagatagaattttagtgcacgtaaaacgagaaagctctttagcacatgattaattaaatattaataagtataaacttgaaaaattaatttatttgaattttttaaacaacttccatatagatttttttaaaaaaaattatttaatagtttgaaaagcgttaacggaaaatgaagaagttgaagtctggagttgaagaaaagaactgagccttaggttatgtttggtatagcttctactccatcttttctgaagctggaacccaaccaaacaatttcaacttcattttaaaataaatgagtgaaactgagtggagtagtctgacaaaataaattagcgatatagaattagggttaggctaactgtttcacaaccccacttcaaatccaacttctaagttaagtactccatataagttggagtctttattctacttcctccgtattatattttaagactttctagtattgcccgaattcatatatatgttaattaatctagatatacacatatggaggtagttttataatctgaaacggaggtagtcccttataagaatctcgggtttgggggcaatgtttcctctagacgaagagtggctaacaccccgtcactccaacctcatgcatggctggagtaacgtacgtaaccatgcatgaacgaacaccaaatcactcgaggttgaagacaactagctagccacctaagaaacgagaaacgagaaacgagaaacgagaaagatg

SEQ ID NO: 7105 - DNA, 29635 bp, Oryza sativa
  unsure (1)..(29635): unsure at all n locations
cttcttcctggcgagggtgtggatccgggcgctggacgtggtgggggtgtcgcacctgcccttcacccgccaggagaacaccctcatccagatcgccgtcgtctcctgctccaccatcgccttcagcggtattccctccatttcatataactacgagagtaattttgacttttttctatagtcgtttaagtaaatttatagaaaaatttagcaacgtatgtagcaccaaattaatttcattaaaatcaatatttaatatattttaataatatgtttattttatatttaaaatgttgttatattttcatacaaactagcatggtggcccgtgcagattgcgcggctagcatcattaaattttctctcatataatagcatatatgtttactcattatattactcaaatatattaaaatgacaacataattttaaattttgcaataactttacaaaactactaatgtgtaatatttatatcatattttatatacgagttagttattaattatttttaatatcaaattttagttatttgtaaattatatatattcctatatgaactctagactcgtcttttaatatttctttttttagttccgaattttctgtaaattgtatttctatatagactctaagctcttcttccaatattatttatttttatttctgaatttttattatttctaattatatttctatgtggactctaaacttatctttcaatattctttaatttttaatttcgaattttagttacttctaaattgtattcctatattgactttaaactcttcttcccatgttttcttaatttcgaattttagttatttgtaaattatatttttatacttttagtttttatacggactcaaaactctacttttaattttattatgtttattccaaattttagttagttttaaattcttatatggactctatactctacttctaatattccttttttttaattccgaatttattttttttttctaattgtatttctatatggactctatactccacttctaatattccttatttttaattccgaatttcagttatttcctgattgtatttctatatggactctatactccacttctaatatttcttatttttaattccgaatttcaattatttcctgattgtgtttctatatggactctatactccacttctaatatttcttatttttaattccgaatttcaattatttcctgattgtatttctatatggactctatactccacttctaatattccttattttaaattccgaatttcagttatttcctaattgtatttctatatggactctatactccacttctaatattccttatttttaattccgaatttcagttatttcctaattgtatttctatatggattctagcctcctcttctaatatttcttattttttaattccgaatttcagctatttctaaattgtatttctatatggactctgctttttctttttctctgattaatgtgagaatttctagaccatgagagcgaacgtagatgctcctttattccttatttttaattccgaatttcagtaatttcctgattgtatttctatatgtactctatactctacttctaatatttcttatttttaattccgaatttcaattatttcctgattgtatttctatatggactctatactccacttctaatattccttatttttaattctgaatttcagttatttcctgattgtatttctatatggactctatactctacttctaatatttcttatttttaattccgaatttcaattatttccttattgtatttctatatggactctatactctacttctaatattccttatttttaatttcggatttcagttatttcctaattgtatttctatatggactctatactccacttctaatattccttatttttaattccgaatttcagttatttcctaattgtatttctatatggattctagcctcctcttctaatattccttattttttaattccgaatttcagctatttctaaattgtatttctatatggactctgcattttctttttctccgattaatgtgagaatttctagaccatgagagcgaacgtggatgctcctttttctattcctttaataatataactagctgggtggcccgcgcaactgcgcggctagcaacaaaacaatattttttggtatgattttacttaaattttattaaatatctatttcattgtcttaagactttgaaaaaccaaacattatcatccacgtatttctaattatataatttttaaaagtcgcaccagctgctaccccttacttctatcatatccttctttatttgcttgctcgatctaccactatttttattcattctctttgaaacctttaaaaatttgatcttagtttttagaggttattgtctcgctgggtttcgtttttataatttctagaaatcccgtcaaaggctgccattatacttctctacggcccgtccactgtctttttctttattgtcattgggattttaaaaatcgaacataattatcattcgggttcattttttttactttctaaaagtcccaccaaaccgtcagcggctttgccattgtactcctttatggctcgcccgttgtctccattctttattgtcatttagattttaaaattgaacatgattattattaggttttttttttttactttttagaagttctgaaccttaattgaaccttatagtttttagagtttattgtcttgttgggtttcattttttgtaacttttagaagtcccgtcaaacgatgccagtatactcctctacggcccatatgccgcccactctttattgtcattgggattctaaaagtcgaacataactatagttggaattcatttttttattttctagaggtcccgccaaccatcgggagctctgcaactatactcttatacaccccgcccgctgcttctactttttattattattgagattttaaaaatcgaatatgattataaatggggtttattttttaactttctagaagtcccggcaatcgccttgctcgtttgcttcacggcctgcctgtcatccctccttttaatcatcattaggattctatttggtgttttattaacaatttttatatgtagtatcaaccgctaccactctactcctttataggcttgttacttaatttatctcgtcatgtattttaaatggccttttctttcaatagtctttattttttatcaccaattttagttatttataaattgtattcctaattaaaatcttttctctttttataatttcagaatttattttttaaaaatattttttattttaatattttaatttttgaatttcatgtgtttcaaaattgtattcctacttgaattctcttttaattttctaattttggatattatttatttttattctaaattttaattaatcttgtattgggttcttatatggattcttctttcaatattgcttatttttaattccgaattttagttaattttaaattatattcctacttgaactcttcttttctttttgctaatttcagattttatttttatttttattttgaatattaattaatctcgtatatggactcttctctcaatattccttatttttaattctgaatttcaattattttaaattgtattcctacttggactctccttttcttttctaatttcagattttattttatttttattctatattttgattaatctcgtattaggttcttatacggactcttctttccatattatttttttttaattccgaatttcagctatttttaaactgtatttctatttggactttcctttttttttctccgattaatgtgagaatttctagcccttacagcgaacgtggtgcctcctttcaaggctgttttaataatataatagatagatagatttgttcaaaccttgatcaaacataattaaatttgactagaaaaactcataatatgtggaacggagatggtatctccattaatttgctgcaattaagcctcatttgaattatactccctctgctattaattttatttatcgaaataggtttgtaaagtctaattattttatgatattattattatagcatttttcaagacaaatctacgcataccaaatttataaaaagaaaattaacataagatatttatgacgagagaaagtactaattaagcggttatatgcggttagtataagagattaatttgctaagcttcaaacatggaatcaatgaaaaatgatatgtgattacattttcatttaattgctccaactagacttcgaactgggaaaactagcaaaaacgtacacagacaaacttaataagataacaaaagaaatggagagaatttacttgctttgacaagtgtaaatagctagggtaccaaatgttttttatatatatcgttgacgtcttaccgcttggaatttacaatttattgttttttataattgtgcaaattttaggtggatttgggacgtacatacttgggatgagcggcaagtcggccaacgaggggcacatcggcagtcatgggaggaacgtggaggagcccaacatagggcgggtcatcgccttcctcttcctcgtcaacttctccgggctgtttatcatcgtgcccctcaggaagatgatgatcatccgccaccggctcacgttccccagcggcaccgccaccgctcacctcatcaacagcttccataccccacatggagccaagcaagcaaggtacctaaccaataataataataataataataataataataataataataataatcagccaagatgatcatggccaattaatagtgctttgatcatcatctctttcaagaaataatgctttctttgagaaataatgctttgatcatggcaaataatttgtcatggagaaattcatgagttgtgatttatttgattctgtgttgtctgcaggctgcaggtggtgacgctgttcaagtccctcggtgcaacagtgctgtggcctattttccagtggttcttcgccggagggaagaactgtggtttccagatcttccccacgtttggcatggcggcatatcgccgcgggtaagtgagaagtttgaagtttgaaacctcactattgtccagagatttacaaaatttcgttcagtccggccccaaaattgtttggcatatttcaaaatgtaaaactccttactgccatagtaaagcaaccaaaatagatcacatttccattattgttaccaacattttacaacaggttctacttcgacttctcgacgaccaacgtcggcatcggcatgatctgcccgccgatgatcactgcctcgatgctcgccggctccatcgtgtcgtggggcatcctgtggccgtacatcgagacgaaggccgggaggtggttcccggagaacctcgacgccaacgacctcggcggcatcatgggctaccgggtgttcgtcggcgtgtccatgatcctcgctgacggcctcttcaccatcctctccgcgctggtcaggactgcctgcgccatgcgcaagcgccgccgcggagcttccacggtgacggcggcggtgccgccgttccagtgcctcagcgccacggagcggaccatgcagagcttcgacgaccgccggcgggcgcaggtgttccttcgcgacagtttccccacctgggtcgccgtcgcgtcgtacgccgccctggccgcgctctccgtcgtcgccgtgccgctcctgtacccgcagctcgggcaccgccacgtcgcggcggcctacgtcgccgcgccggtgttcgcgttctgcaacgcgtacggcgtgggcgtcaccgacatgaacctctcggcgacgtacggcaagatcgccatgatggtgttcagctcctgggtcgggatggacggcggcggcgtcgtggcggggctcgccgcgtgcgggatcatcgtcagcgccgtctccggctcgtccgatttcatgcaggacttcaagacggggtacctgacgctcacctcccctcgcgccatgctcgtcggccaggtcgccggcacggcgctcggctgcgtcgtcaacccggccatcttctgggtcttctacaaggtgtacaacatgggcggcggcggcggtgacggcgccgacgtcgcaccgtacgcgagggcgtaccgcggcatagccgtgctcagcgtcggccggcacgggctgccggaccacagcgtcctcctctgcaagctcttcttcgcgatggcactcgccctgagcgcggcgagggaggtggcggagcggaggaggtggcgcgcgctgcggtacatcccgagcacgatcggcgtggccgtggcgttcttcgtgccaccgaggatacctgtgggcatggccgtggggtgcctggcgctgcacgtgtggaggaggcacgtcgacgccggcggcgcgcggctgctgttgccggcggtggcgtcggggctcatctgcggcgacgggctcgggtcgctagcgtcgtcgatgctgacgctgctcagggcgcggccgccgatctgcattaagttcgtgtctcgcttcgagaaccagaagctggatgctttcctcgcaacacggcatgcttaattagtcctagacttgtacttcctccgtattgacgccgttgacttttcgaccaatgtttaactatttgttttatttaaaattttttatgcaaatataaaaatatttatgtcatgtttaaagaacatttgatgacgaatcaagtcataataaaataaatgataattacgtaaattttttaaataagatgaatggtcaaacgttggacaaaaagtcaacggtgtcatacattaaaatatggaggtagtatatagttattttttctgcaaaagcatgtgtgtgtatatgtgtgtatatacatatacatatatatactctctccatcaaaacaacctaacctaatcgaggatgtgatacaatctaggataggataacgaatctgttcctatgttgtcttatcatcacatagctttagttttttctttacggtagtaggttgaggttatttggacggagtgagtattattcagtcatttttgcataatttttatataggaaatgtgatgcccacctagattgaaaacgccaccaaggaaaatgatttcatcgtgagaaagattcggtgggagcagagtgaaataaattcaacgaaaccaaaacttaaccaattttgaagggaataagttcacttttggtccctcacaatttatcgtcgagtccaaaatccattcctggactgcaaaaccagatacaacttatcccctaacttagaaaactagtgtaaataagatctcttgatagtattgtccccattttggctgatatgacgcctacgtggctctttagactaaatctttgtcccacgcgcattgacgtgacgcttacgtggcaatttgatccgaaaaaaataaaaggagaaaaattagaaaaaaatatgcggggccatatgtctaatgtctacaagaagataaaaaataatgggacacatatgtcaatgggtcccacgtagggatgcgaccacatgcagcgaggaacgtgggcgacgccgcagcctcgctccatcgccggcacacccccctgagacaaaagtagcttgcggcaggagctgcgctaaggcgctcatctcccctcacccctcgcagttgcgtttcttgctccaaccgctgccgccacacctctctactcctggggatgacgaggatggatatgagatagcagcgaggctgtgtcgcactagcgccgctctcctcctcgtcgtcggtggtcgtggggctaggagctcccacagggccctcgctgatggtgaccacgggcggggagatgttggcggcggcctctgcggttgtggcctcccatgcggccggctaggtttcttcgccgccggattcttctggggatggctcctcggatgactcgaagaaagggcttatcgcctcctccgcctctgcgtcggggcgccctttggggcctccttctcctctggctttttcctctcttctcacccttccgcctctctctctaccactgaacctagctgctctagccgccggcggccggcgacgttgacggtggggtcgtaccggtcgacagggaggagggacaccttcgcggcgtcaggtccaccaccacgcgtgatcgcggaggaggatgggatggagatgaggagcacaccagtcgcggagggcggcgtgagtatggacataaggagcaaaaccatcaccatgcagagccctccgtgccgccgtggaggagttcgcccccggtggcgggatccatcccgcgccagcgccaacggaggagacggtgagattcgggaggagcaggagaggagagggaaagataggggtgatgatgtgggtcccaatgtaatattttttttacttttatccgaacactcactaacatgtgggtcccacagtttttacgagtcttaagtgccacatcaacaccacgtaggtgccacaatcagtcaaaactgctgtccaaaccaccttgatacctaatttgcaatagttttgagagttcagagacgtgtcatatctggtattgtggttcagggacaaattttgaactcggtgacaatgagggacctaaagaaaacttattctattttgaagggaagtagaggtgcagatgggcctgataatggtttaaagcccacttcaaccccagcccaaccaaatataatacatagcccaaatcatctcagtccacagacatctcaaaccaaactaaacaagcccaaatccctcctacggcccaattccccacctacccttgctggacgacgccgatcctatccattcagccattcgtctcgtctctccgcctcaagccctcgaccacctgtcgccgcgctaccttccctcctctcgcccgtgacctcgcgctagcataggcacgcccattgtgggcttcgtaccctttaccagtgcctccgaggtgcttgcactgtgggatgagtgtctttggactaactttttgggctaggggtacgggccccatagcttgcactgtgagaggccttaggcctctcacagtgctcctagctggactgtggcttagtagcgccacgtctgttttttgcctgcgtgtcgctcggccccgcgcctctgcttgggcgctcgtgaccaaactcggatgcgcaaaacctggcctggaaaaggggccgcacggaggaatcgaggggaggcgcgtgcactgtgggtgtcgttccctcgccacccggtgctctcgcatgggattcggccggcgaaatcccctattcaccctcgaaaagccacccgattcccctcctcccgccactgatttcgtagctcccgcgccggattggagtgcctcttgcctcagcgccgctgttcttccacctcgacctcgccgccctgaagtctcaattcaggacggcctcgccatcgcctccgacggcgccggaggtgccactgccgcgctccgctctaggatcttcagtcatcgtcgaggtctccatcgccatcgtgagaggtagcggtcagcaaaccctctccccaactcatagtttgaccgatttgccaagccttggttcgctgattcgatctctccatgtgatgcaaaccctagttgcagatggatccgcggctagccgatgcttttgcccgtttcctccaagatccggcatcagcggcggcgatattgcagtccctaagccagccgtcgtcggtccctctataggatcaaggcggccgactagaggggggtgaataggcggtttttaaaacttttggctaaaaccaagttttgtatgcggaagcgtaaatcaaaatggttttgcacaattcaaaacctaaatcaactagtctcaagtaagtgcacaaagaagctagcctatgttgaggtttgcaagcctagggtaataatagcacaaataaactctagtatgtaaacttgctcaaagtaaatttgcacaaactaaaggagacaagaaataaggaatttttcaccgaggttcggaaacttgccagtttcctaatccccgttgaggcgagcccaactccaccgctcaaccacgaagccaccgcacgcccccttcgtcaaggggtgggcaaggcgggagtcggcccacggagaggactaccaaagcctcgatcactagggtagttcttccttcactccgaaggtggtgaaccccaaaccactcacaaccggcgccgggcctcctccacaatctcctcggagaggtcaccgagcaacacttccacaagctgtctaggaggcagcaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaagggttcaagataatcaggggtgaaaacggagcggatattatccgatccgatccgatccgaatccgtccgatgtgaggatatggtaagggttgttagatatccggccggatgcggatgcggatgcggattttgtcatgcggatgcggatgcggatgtggtatcaatgatatccgacagattcggattatccgattttttaatcagattatccgatatagtgtttggcggataatccgcaactttcaggcccatctagcattcttgcccaataacccatctattctaaccctaatccttcctctcctccccctatcccccagatcggcagatccctctctctctctctctgactctctctctttctcccgtcagctctcagtcgtaggggagtgggcgagtggcggcgcgacagcgagtcgacccagcgcgacggcgacccagcgccggccggccgctcctccttggctgctagcgccgccgccgctcctcctcggctgcagtacaggctggtggcgccgctgccattcgtcctcgcctcctcggctcctcggcgccgccaccactccgtccactgtcgcccatcagcacgtctccagcgccgggccgccagcgcaccgtcgcatccccgtcaccagcccagccgccatccctgttggctgtcgccagcagccatccccgtcgcggcgtcgccactcgccagccaccactgtcgtcagccgtgccgtgtcgtcgtcgtgctgtaactgctcgaggcctagagctgcagctgctgttccagtccaacgacaagtcgacgatagattaggtattgttttcttgtacacttgcagtccaatttgaagtatcaaatttgggatttactgatttagaaatgtagagatgagctttgcttacggaaattacgtcaatagcaagttataatttgattaattgttcatcattcattaggatcgtaaaaaatggcacctagaaaaagaggggcaaaagcagcagctgctgctactgctactgaaagtagcattgctgcctcgtcgccagctccagctgaaggggaagaagggccatcaactgtgggcagtggcaatgaaagtcccaacactattgttgttgttgatgtggataacattggtgcagagggggatggagaccatgaaaccaatgatgaacctgcagcaaagaaagcaaagaagagatagtggaagtgatgcaagtgacttggataaatataaggctgaaccatccctgttggttcctaatggagataaatttgatgttttgtcatggtggaaagctcacaaagatgtatatccagtgctatctcttcttgcccgcgatgtcttgtccattcaagcttccactgttgcttcagaatcagcttttagtgctgggggacgtgttcttgatccatttcgtactaaacttgaacctgaaatggtagaagcactagtctgtaccaaggattggattgctggatatagaagaggtgatcacttgtgtcatttttcatttatatttttgtaaaaggtattcttgttagttgattttttattaatagtctaatatagctttcttccaaatttttcagattctaataaaagggttggatctattcttaatgatctcgaggttgcggagaccttggttgctaatatgacacttgacgagattgatgatatggtatgacattttattgcataaattttgttgcaatacattttgtagtcctatcgtcaaaataaatgtatattgtttgctcatacttataggaaaagcaacagagcagtgatgatgaagaataagtgatgaagtgaggtgtgaaggcttgaagggcatgttggtgtgtggttgtgtgtgcctgtctgcctgtgtgcatgtgcatcgttcactgctatatctgccgtatgcttgtatgcctattgaacaactgtgttgtgtgctgtgctgtatgagatgtatgctctgtgctgtattgctggctcatatgctgcatgcagcatgcatgtcgtactgaactactgatgagtgatgacttataagttatattgttaaattttaagcaatgcagtgaccagtgactaatgagtgatggatgtatcttggattattttgttggatgtgttctattaagcaaaattatattattgatgtgttttggttggtttttcctagagagctgagatcatgtttagatgttattttgccatcgtattgcggctaattgtattggcgtccacttgttgtatggattgaatacaaacttgacatccgacaactttttgtccgtttccgaaccgactccgcaccgaatccgacgtccgaaataatccgctccgcatccgcatccgcacgtcatccgcacccgctccgcatccgtttaaaaaaaatggtttaggatatggtatagctattatccgtccgaatccgatccgttttcacccctaaagataatgcaatggggtgccaaaactttacccttgctgctggggagtgggtatatatacccccaaccaccaaaactagccgttggagtcgaaatccccaactcggtcagaccgccgtcggctcggtctgaccggttgcggctctggcggctttgtatcaccacaaaaaactagaccaatgcaacagactagtggggccggtcggactggccttaccacgccagtcagaccggctaacaggcccggtcagaccggcctaaggccaacggtcagaccgcaggtcacttttcagctcaaccgaccgttagtaaaacgacgatatctcttgactcgggtctcggaatttggcgttcttggactatatggaaagcttattcaaagggccatccaacccatgaaaaaaccatccaagaaacacaacttaagtcaaggataaagggctcacattccaaaggatatccaccggacatacccacaagatgtcactcactcctattggacatgcccacttctctctttgtttaggacttgagaaaactcatcacacatggctagacaagcccaccaaatgcacctatatgcatatgaactaatatggcacaaggtcatccacatgctcgcttcatagacccctcttgatagtacgacgcctatctagcaaatccggtctacaccaaacaccaagaccggaaaaagactaagaaaacattcttagttctattatacctttgccttgcgccatccaacttggggtcaatgcttgagccaagatcaacactcgtgaccatttgcttgaaccatgtttatcccgaggtcttgagcatcctttgtcaagactttcttctcatcacaatcttgacttcactattgtcaacatggcgatgtccttgtcttggtgaccatcaacccatgttgtcatccattagcctcattacggtggaacctattccttttcacatctcaaaggagaacattagtctcaacaaatcggttgtaatccttcacttgatgaccaaccggttgcatatgaaagatatggatatgtttgttgagtattcatttacacctcaagtgtcatatacccgtatgcaagctcaagtgcaaagatccgatataaataataggtaaacaacatggatctagaacatgcacaataaatgtataggatttgctccccctaagtatatgcatacaaagaaatatacaagagagacaagtgtatgcataagtaaagaagaatcaacgggggtttatcctatacacatagagaatgcatatgtagtaatgatgtagaccaatataaaacatataccttcatgatctccatgttcttaatgtaaattagactaaataagatatgactcgagtaaacattagtctcacacttatataacaataacatgaaaatcatacatataaacctatcaaaaaggagataagaagtggtacatatcgttttatctccatgcatttcatccttgtcatgattaaggtccatcaccaaagaatgcatatctaccacatctcatcatcgggaaataacctagttaacaacttatgaaaaagagaggttaatcccataaacatcgatttatcatctatcaccaaagcaacaattacacaaattgtttaatccaagatctttcaatcttttctctcttttgtgatagacaataacccgatataaacaatacaaagagatgagatgaaagataatttcaaatcaaggtagagatcttataatgaacaaaatatagaataagctccccctcaagatgtgcatacatatggatatgaaggaatgcatatgcacataatcaatcaagatcaatgagggagctcacactatattttggatccacaagagagaccaaattagaatatgtgaagtttaatacatacctctcatcatttttactttcatatccaaataagactagtcaaagaaaggctcataaaaacgttagtctcatataattagatttgtcattaatcactgaaaccaaattaaggcacttgaacttacaccctcctcttccgtcgttcccataccctcctccaccattccctctcttctgcacgcagccgccaacagcagcgccgccgccaccttcggccccaacggcaagcactgaacctttggcggcccaggcaactctatgttcggcaccggatgtaggctttgcagcgacatgcaagccttcatcgacctcaagacctggacgctgacactgtgtgacaacagagcctgcccctatccctgcctctacccctgcccctgcccctgtccgtgccgatgagtctattggcaaggccggcaggatgttgtacagtcatgaagaagacattaggctggtaagaatttacttgttgattttagtaaaaaatcgatgctagcagtgtggatgattaatctatgcaaataatagaggtacagaggtctgtgtagctgtgctagagcattttagttaggcaaaatgcgaagaaacaacatctgaattttgtagaggacatacttgtgtactacactgaacatgcaattacataaataagcatcatgtcagtatttgattagtgttaagctagaactacaaccagtgtaagagtaattaaggttcgcaattagaagtgccaataggttgcttttttggtttgctgttcataattctgtttgctataagaagcagaatgctcttcatcttttgtgctgccatgtatttgtactatgctcttcatcttttggtttgttgcatgtatacattactgcaaatatagattcattgacctagttatttccggcaggatgtttccatttggtttgagggtctcaattatttttgttgtttatcatgtatgacattgcagctacctaggtaggtaccattaatttaggagtaggttatcatgctgcctttttgtaatggttgtaggcaagtgcttggctcaaatgttcaacagatcctataggagtgaataggaagggtgagacctattgggtacatgtggccgagacttacaatgagacaactctggatggaaggaagagggatcccacctgtctcaaagggcattggcacaagattacaccgaaggtcactttattcaatgggtgttgcgtgcaactgaggaatacacctatcagtgggaggaatgacgagaagctcatggatgatgccttggcgctctacatcaagcgttcaaagaagcacaagcccttcctctaccaatccagaagtgtaccgccgtgatgcgcatgttggcctatggggtgtgtgcggatcaaaccgatgagtatgttcgcattggtggaaccactgcgtatgaatccctcgaaaggttctgtggaggtgttattgcggtgtttggtccacagtatttgaggaaacctaccttggatgatgtacaacgtctcctatatatgcatgaagaacgtgggtttcctgggatgttggggagcatcgactgtatgcattggagatggatgaactgccctaatggttggaaagggatgtacacacggggtgattatggtatagcaacaataatcctcgaggcagttgcatcacgtgacaaatagatctggaattcattttttggtgtgacggggtctaacaatgatattaacgtgctgaatcaaagcaatgtcttcacggatgtcattatgggtagatctcccattgtgtgatacatggttaacgtgaatcagtacgacttggggtactatcttgctgacgggatatacctggaatgggcaacgctcatgaagtcaattcgtcatccccaattgccgaaagataaattgttcgcacaacgtcaagaatccgcaagaaaggatgttgagtgtgcttttgggattttgaaggcatgcttcagagtggtggaaactcccacgcatttgtggctgatagctgacattagcgatataatgacggcttgtgtaatcatgcgcaacatgatcgtcgaggacgaaggacacgtttgggatactgaagacttggagtttgagggtgactacgagatcgaacctccagaacacacttttgggacaccacaacatattgctagattacttgagcgtgacagccaagttcaaagtcgaacaatgcacaaccgtctaaaaaatgatttggtggagcacatatgggcaaggtagatcctacacgttcatgaacattgatgttttaggaaataaggttatctcggaggaggattggtagttgttcggaaataaggatgatttctcaaatcatccaagttatctaggtgtaggtgtagttttaagaaagaaggaagatttctcaaatcatccaaattatacaggagtaggggtagttttaggaagtaaggatgatttctcaaatcatcaaagttatctaggagtagaggtagttttaacaaaggatgatttctcaaatgtaggcatttacaaatatgaatgaccattgtaaataaataaaggtgctgtatccccaatttgtgcatgccatgtatataaataaatgaattgcaatcggtgccatataaagtgcacaggacaaaacaattaggagataatcagcaacggaccgactaagttcagcaagccaacacaaaataggtcaggtacatacaccatcaactaaccgaaacccacagacatattgctttgacacatgccatcatccaccttacagacaccatacataacccatatcacaacattacacagttcacagtcctagctaaatatataagcatgttatatatctgttgcttccatactatccatgttgtcacgccatgaacctaaccctgcagggaaaaaatacagcatgtcaaaaatggttgtgaattttaaatagagggggacattatatgcagccgtatagttaggctcaagcattggcatcaatacttagttacaaacataactcatgcttcaactacagtgacctaatcatgcagattaggcacattgcaactcataatagcacagatttgagatcccagagcaatcgcggctttcaattttgctagttagaattcacatgttacttcttgcacatatctggcattacaacatctacttcagtcaaccagttctgaagtacaaacactctgtccatcgcccaatgatcatctctacgggaagtatcaagaaccatgcactaaactaatcatacagccaataactaaactttatgaatttgagcaaacatggcacatccaacctgtccataaatttttaacaaaggagcagagccctccattccaatatctcaaatgacaacaaaatcatcccacatctcaaattacaataaaatcatgaaacagctcaaatgacaaacaaatttgaaatgacattcgagtgagatccnnnnnnnnnnnnnnnnnnnnnnnnnnnnnnnnnnnnnnnnnnnnnnnnnnnnnntggagccagcgccgcattcaccttctcaaaacctggtggcacctgcgggaagcctaaacctccctgcgccgcatctgcctccccctccacagcgatgaccccgagatagatcgacgagccgacgctttccggcctcaccggcgccggcgtagatcacaggcgcgaagtacctgcccctaccgccgttcccctattcttcttcccgccatccctagccactgtggacggggtatagcccggcgggagcagcacaaggccactacggagctcaatctgcgtgaacttggggcggtcgtccatggtttcgggcggatcagaggagcggcggagtgggaggatgagacgacgaccgacgggagtgaagcgcggcgagaggcgggcgaggcggacagactagagagaggggatggaatggtcgaatggttacagtcggtggcgagggaagggcaacggcgtgtgtggcggagtgggaggaggcggtagcgagaggagggaaggaggcatggcgacaggtggtcgagggctcgaggcggagagacgagaggaatggccgaatggataggatcggcatcgtccagccagggtaggtggggaaaaatttttgggggcggcccatgacctcgcgctagcataggcatgcccattgtgggcttcgtaccctttaccagtgcctccattgaattaagctacacaactagaggtgcttgcactgtgggataagtgtctatggaccaactttttgggctaggggtacgggccccatagcttgcactgtgagaggccttattctactatggccaggccactgtacattgggctaagacatgcctctacatggtgagaatgcattgctctacatggggtttgaggcttatgccctgggatgtcgcaacctgagtccgccatgctcgtgtgtttgatttccgaacatgcactattttagcctcatcgattggcttattttgattatcaatgataaaaaaaaattattggtaaaacttttacatatgtgtttttagagatttaaaagtcacggtaaaatataaactacaacgagaaaacctttaaagcaactttaaaattaagcaaactttgctacaggagtgtaacttcgtgattttagctatagaacatcgcacaaaataacttttgaatcgtgaaaattagctcttggataccacacttattagaatattcaattttgattcaataggagagagaaaccgtgtgaaagttttaaaatacccctgggcccatatgtaaggtctcccatctctctctcatgcacacaaggcatgcatataaagccttaaagttctgaaatgtcgtcgcacaccctagccttcgcatctttgacgacaccagccttctctagctgccctgtcacgccagcagctccacatcacttccgtgtgggtttgccctcaactttcccatccattactttgccatggatggccaccctttctcctagattccacctctgctccacatctgtcaccaaagttccaggaaaaaacctcctcatctggcaacacgttttgacgcgctcagtcggtcacgttcaccactggagcttgccactgacgtctctctctcctctgggaccatgtgtttattgttcgtgttcctgaatctttaatcctcctcattgctggttgccgccacctacggaagagtcacagcataggatgtgctcgcctggtcacattcaccactagggctttccaccggcgtttctctctactctgggaccgtgtgtttgttgttcacattactatatcttaaatcctcctcgttgctagctgccaccacctagggaagagtcatggcatgggacgcgctcagccaccgccatcacgttcattccctcgcggaagtcctaatgccctcacacattctccattgcttgttctgtaattgacatgagaaagaagatgaaaagtgccaagtgtactgtttagactgaactagtgaaatagtaaccaaaccataatgatgggtaggggtggagatatttagaccgaaccgaagaaccgaaccgaagaacctaaccgaaaagaccgagaccgagaaattcggttatcttttcggtcctagccctcaaaagaccgaatttatttcggtcatttcggttattgggctcggttaaccggggtaaccgaaattttagcccaatagacctaggaagcccaataaaaccactaaaacaaaccctatcaccactgccgcatagtgcactgccacaagccacagcgctgactcctnctncagccncaccgcgccgccgnncgcacttgcggctnncgcaccactgcgccgtcacctactccagcctccccctgcgccgtggcccggcttcggccttcaccgcgccacagacaacgcctccgtcctccaccggcggcgcctctatcaaattttttcgttccaaacattctcctcaaaaatttcagtcagaacaagaccgagaccgaaaagactaagaccgaatttgccggtcctgagttttttttatgaaatttggttctgagtttacaaagaccgaactgaccgaaaaactgaagaccgagaccgaatttttcggtctgaccgaacgcccacccctaatgatgggagataggacaagtgatcttagaggtatttttgaagtttcacgtgatttctctctcctgattaactagaaacgaatattgtaactgacgtgatgtatatgacgtgatgtatatgaactaatttccacgtttatatagtgtattctccgtaagtcattgcatggtgtcgcataactaaaaccgcaaagtcacgtttgccatgtaccaaaatttatgttaaaatggtcaatgagcttttttttttccacatgaaacatgaccaacgagcttgagccgtccgatctgcgcagccagctcccatcggacgttccccacccgccctcgacaacggtgaaacgtcgtctccacgcctcacgcatgcacccacccatacagataccgaattgatgtgcacacgaggcaggcaagacaggggagaggcagcccgtgggccgtggcggaggcgaggtggccattggacgcagtcacatgaccaaagtggaatgcaacccacacacgcacggaaacaaatgcaatccaccaccatcgtcgtcttctctctccttaccaaccaaacgcagtggcagtactagtagcgtccaagatccccatcaaccagagcagcagcagcggagcggcagaggatcggaggcaggcagggagctcacccacctccaccgccaaaagctttcccttcctccatccatcaggattcaggcatcagcccccaccacctcaaaaaacaacctcagattcgtttgttcacttcactcacccagttaactttgcgaggagagagagagaggcagtttgagtgcaacgcaagccaagccggtgtcaggctcagaccccgcccaggaggagcagcagctgacacagctttcttcttccttcctgcttcctcctccagtctccagagcagtggtgtcgtggtgggagcgcacccgcacccgcacccgcatcacaaggcggcaaacgcaagcgaccaacaaattaaggagaatgcagcagcagaccacgggtggggtcgccaccaggaggcggctgtcggtgccgaggggtgccggtgcggcggcggcggcggcatcggcggcgtcggtgtgggagacgaggatgaagatggacgaggtgaagggaggggtcaaggtgttcagcgccggcggggacgacgccgacgaggaagggctcagggtctaccgccgcctcaggcgcaaccagagcgacggcggcggtggcgcgtcggggtcgacgaatgcggcggccgcggctaagaagaggcggaactggaaggcgtccgagcccgtcaccgccatcggggacctgcgcaagtcgcgctccgacgtcgccgttgccgccgcggcgccggcggtcgggatcgtcaccaccgccaagcgctccgtcaccagggtcaccacgccggagaagaaagtggccgcctccgccgctgccgccgaggtcaaggaggtggttgtggtggaagtgccggaaaccaacaatttggatgaggaaacagaggaggaggaggacgaggaggaattggaagaagagctcgaagcagaggatgaggaggaggaggaggagaagaaggtgctcgaccaagatcacatggccattgacgacgacgaagctgcaaaatcaacagctccgcatcaaggcaagtatcaactcctccagtgttgccatcaccaggatttcttgatgaatttggtattgattctttttttcccccacaatttctcagtggatgaccaagatcttgagccaccgacaaaaagtgagacgccaattcagccaaatttgcaaattccattctcattttctgtttgttttttgcatggcgctctaattgtgcgatcatttgggtgaaaattaaattaggaggggttaagattgtcccaacttcagtggaggatgagagagcggcaaatccggagccagtcaagcctccaggtagaactcggcctagttcttggccactttaattttacctttatttgtcttttttttttcttttgtttcatcgtgccaagaattttccggtgatccagtaaagaagcttgccgcaacaattgatctccgggcggtgaacccagagccagtgaccattccaccaggtgaattcctcctccgtggatgcaaaacctgtaccaattttaggtgaatttcgttctgtttcaccattcatctcgaatatttccaaaatgcagtggagaagaaggctatgccagtgataattcaccggatgacgaacgcagagccagctaaaccttctccaggtaaccttgacgaaatcatttgtcttcttttggagaacttttggggggaaagaagagatcaactcgaaagcaatcttgtcatctcctgcgtcatgtgactccaatttttgtggtttctcggtttcttcagagaaaaaagcgtcgccactgaacggccgccggattcccaagcaagatccaatcagtgctcctcctggttagtgccatttgtttctgctattccttgaattgctttctcctaccgttttggtatattctgaatatggaagttgatttcttcccctgaagtcgaagaagagtacgaggagattcagggcaggccatcagtacccagcagaagcaatggaagaatgcagaatattggtcagttatttttccttttgtaggaaagatgcttctagttaatgaaattggaattgatggttttctttcttcttcttgtttcgcgttgtttttttagtggatttggtcatgtggagagatgtctccaagtctacacttgtctttggattagggacttttttactgatctcctcctcctatgccaaagacctaaactataagtaagccactgttcagtatttattactgcactgtcactttgttaagtctgaattctcaaagctgtttaactgtcaaaatttgttgacctttcccttcaaatttataaatcttgcagcacaatcacagcagcttcatatcttggcctagtctaccttggtctaaggttccttagcaagtccatacttaacaggtagtaatgattgttatccagattatctgaataataatcacataattaaccagcttgttgaaagtgagctaatcttttatttgatcatcaattcaggggagagaatgtggactgtgatgatgctgagaggagtggtgaaaggtacctggtgggggaggaggaggccatctggctgctcaggcttgttctgccttacatcaatgaggtgctcctgaatctaaggtccctcttctctggtgagcctgcaacaaccatgaaggtaaaaaaggggccattgtctgcttctgtaaatgctacagagtttggcaaaatcactggagtagtagatgcatgcatatggacacatctctagctagatttgtactgacagagggactctacatgtgctctgcagctggcactcctgctgtttgcaatggcccggtgtggcaactttgtcaccctctggacactggcaaaactgggtaagtaccaatggaacaatgcacacatgcaaagtgttttatgtctgtagcctgtacatatcctcctgtctctacagcctcatctctttcttcgtttcaacaacctcatggtgctttaaatcacagccaaactaatgttcatatgaacaattttgaggaaataggtgtgatgaaatagtatcttctgcacaatcttagcttaaaaaaccttgtatgatgctaggaccacaggcatcaagaagtgctgttgcttgtacagataaaggttaaagatctatagcaatactggtcacactgacatttttgtacctttgatctggccttgtttgcagtgttctttggggtcttcatcattccgaaggtgtgctcatcttactccacccagcttgcaagatatggtaagtccaagcgctctcttgttttaaccgcaatttctttgtattcttctgcatcaccaaagtaccatgcacagaaagacaacatacaagaataacctaactcagtcaccgacaaagcggccccactgaattctaccattagtggggccctattgccagtgactcatcactttcacaccttctgttcactttcaacatgcaagaataccattttttattttttatttttagagttgaggttgttggatctggtaacattggtcactgcttttactggtcccccgaggcacttgggcatgtgcacgggtaggactagctagagagactgtaaattactgagctaggtaaattatggagaagggtagaagaattttgttgagctaaggacaatggtatttgggagagtacattgagacatatatgtactataagtagcagtactccactgtaccagtacatcagggttgtgaatcaacccttctctgaagattagtccttttctgcatcttctgggttatgatctgcaatagagccaaataagattgttccaaaactagtccatcaggctgtcaccatgcttgattaactgtttctcacatgccatctaaattcatgttgattggaaacaaactgcaaatacttgaattgacctttacttgctctttaccacttccaaggagaaccaagactaatttgtattactactatttaacctacatttaggtaatagtaaactaagaaatcactcggggggcgaaaactaagaatgggaatgtggttagtcctagggctttgttactgatggtaaaaaggtaaaccggtgacttctgttttggaacaaagtattagtactaataatacattagctaataaacaaagctacaattggacctaggttttgtgactgatggtagaaagtgagagtaagccggtaacttgtagctttgaaggaaaggtaaattaggcagaggtgacttttgcattggagggagagcatgcacggttattcctcctaccttttgcacgtgcgagctgtcgcgtggtcaacatgggcttgattgtcattgagatgctttggctgtcaaaggatatttacaacactgattgatgctgtctcaagtgaaccacgcctcctttgttccctttttcttttcaagggcaaagttaagaagaatctttaccaacggctaaggattgtcttacaatgctatcatgaggtaatagttcattgttaaaattttcactagtactaacaatacattagcaaacataaagcttatttcgaaatatctaatatgttgcattttacctttatttcattatctatatgatcaccatagcgtgcctttaatatatctgaaaagataaagaaattccaaaaatattgtctggggagaaaggcatattagcatgaaaagcaaaagcaagtgattgtggattagtgggccactattctggccaccaactctgtcatagtagctgatgttatagagttttactgtttcgttagtgtcctaaaattatactacggagtagaacgtatgcactgtcaccttgtgatatatgacaaggtgatatatgcactgtcaccttgtgaacgtatgcactgtcaccttgtgaacgtatgcactgtcaccttgtgatatatgacaacaaaattaatttgaaccagagctccagctttaactactcttgacctttctgcttggaccatagatttgtctctttgttgaccaaattaaacataaactgatggtagtacgtgctagagtagacatcaagcctagcttgcccactgtcaagtgcctttaatcaccatttaattagtcacattttttttctagtagtcacatcactagggtagctggttaagagtatcaatttctccattacagccagaaaatgacaggtatagtcctgtgaggacctctactcttcttttactcatggaacttataaaatggttacatagctcagtaccttcaaatatactcattttaattttccccttccatatgatacttgagaaccttgtagttaaccatgagaaccatcctagcagaggacgcttcatggtcatcatgtgtaccagtaaccctggcaggatgaaattgcactgttacacaaaaaaatgttggtgtctgcttgcattgggattctttgatctaggcatgtacccgtcagtactgaagcttcctagctttgctcttttgcatgtgaagtgttgggcatttggtcactccccctccacaagcaccacatacatgactgttttgtggggtcctaatatttgtttgtttaccaacccaccaccaacccatgccagatgcagctctgaaaattaatcagggacgctctaaacaaaatgatgatgttctgctgccatatctgacacttgtttaatttgattagaacttgaggtgattttctggtacctgtaccaattaaaaaccataatgaggtgggggaacaacatttcatgatgttgattgtgatcaaaaggtgcaccacatataataaatttactatatataccaaatccatgaatttctcacgactgtatagtgactagtgaagccggtagatagcttgtcactctccaaaggttaatgtccacgtctttttttcccatttctaaaggttcctcatttcatttgatagcacaaaatttcctgttgataacggaaatcagacatatatgacaaaatggaagaaatacatctctctcataggttaggctacggagtatggagcaacagcggcaccaatccattttgctttccaaaggaaaagaaagctcaaaaggagggataaaaagcatggctatctttatcctcggttatatctccatcttttgtttttcaggacattgattaggtcacttaattaaacccaactttacttacccttaatcataatgtctagtccgttctgatgaataaagcgatactcaaaaaaaggtaagatgtcaggaatccgacaaacagggcagtaagcaaactgcaattagttgaacatgatactaccccctaggctgaaggactggattaccataatgcaaaaagaacttgagcttaactaatatttcttttctcttttttgtgtgtgattttcttattgtacaaattgaaatgtgtttattggaacgaaattaaagtgtcttttcctgtccatggcagggaggttttggctggagaggttcagggatggatgggagtcctgctcccacaagaaggcggtcgtggcagccgtcttcacccttgtctggaacgtctcatccacggttgctcgtgtctgggctggtaactaccttctccctgtaaaagcatccacgatccatcctgcactcacaacagtttccacagtctcagtgctccacctcacctagtatgaatagaattaaatgagtttgtttccagattcgtagtaacctaaaatcatttatactttaggacggatttgagtaagagagagtgatgtgacaaatgagttcacaaagagttgcagatagtatctcccgtaagacactaataattgagaaatctaatagaaatgtgagagtgagaaataatggtcttacaatttgtactagaaactataagatagttgattgttggcaccaatctgtaactcccaaactctagaaaaaactttctacactgtgtggtattttggagtgctgatcaccatcaacctctgctgtgtatgtgcagtgttcatgctggtggtggccatgaagtgctaccagcagcggatgatggagtacggctggagcagcacggtggaggactcacaggaggccaccgccgccgccaccggcgacgatgagtcaccgcaagaagaaactcctgctagatcaagcccggccaaggcgcacgaccacgagccggcacagggatttggggcggcggcgccggcgcggcatcgccggacgccagtctccggcgagtttgcaagggagaggctgagagtgaggggtggcatccagcctaggtgacaggacaaatctgtggatgccgtatgttttttttttctttcattttttttacattgtggtaggtttgggttgtgaggacgtaatgtcacgaaatggttcacggaaataatgagtatgatccacacataggagttccatataatagaatggctatagaaattaatatatttctccacacatctcacttcctccatttcagaaattttaatttctgctacaaatctacagcctacactagccatgcataacacaaaacgtacatgcaaaaattgatgttttttttttcaaacagctaatcagattgactggtgttatattaatggggcaatttcgtttccacccctactttgatgtctaatattgattttatctctactttttagggttttcgtttttatcctcatttttttaaccaaacgcttgttttgcctgtactttggatggtaaagttaacggcgttaagtaattgataaaatgacatttataccctctcatgtatgttcattaattgtgtttttgcccccattttatacatatagctttggaactttatttttgggagtatatttaaaactagatgacgcacattgactagtataacaatttggccaaattctgaatttgatggaattttgacaaaatttcagcattttgatagaacttaaacaaaattttgacaacattttgtaaaatgtaattatctcttccctttagatattagtcaatgtgttttatttaattttaaatatactcacaaaataaagtgctaaagctacatgtataaaataggggcaaagatataattaatgaacaggtatatatgagagggc

SEQ ID NO: 7106 - DNA, 6072 bp, Oryza sativa
tgtcattttgccaattacttaacaccgttaactttaccatccaaagtaggggcaaaacgatagttcggttaaaaaaagtgggggtaaaaacgaaaaccctaaaagtaggggtaaaattaatattagacaacaaagcagggttagaaacgaaattgtcccatattaatagagggaagttgagttacacagctaaaggctcaaagaaagtaaaaactgcacacgcctgattgcaaacatgtttgcacgttatgcaaaaaaaatgatgtgaagacctcatctttgagatccattagggcttccaaaatattccgactacaaactgactcatgtggactgaaaccgtacggatcacaatgtgaataaaaagatattggtagttaagacattgtagtgaagcccaagtctctttcaaatgctcaattcagtccaattaagactatgtatttccaaattatgccaaggacaaaacaattttggcatatcatgcatggaacatttaaagaaaattctcaggcattcatttttctacgctccacctttaaaaaactttgcaaatacaaaaaaataaaacaagggtgcaaacaacattagcactcttcaaaacctattgttgaaacggattgtttgccccatgctaaaaaaaaacattttagaaacaactttctccaactacttgttgtagctacttgttaagtttatttcttaaaatgtttaagctatgtttataatataaatagacaatctacacaataatccgttcaataagctaaactaaatgggaccttaccgtagactgctaccacaacatgcacatagattatagatagcaggcatgtcataaagctaaagagaagaggagactcgaacaatcaccaatggaacaaatcatggacatcccaaaaaaatctagcattttcattcgtccatcaaatttggccatgtatatgtaaactgatcagcttgggatttggtttggtcataggcccaggccgacccatggaatcttggaccaagatcacatatacttcgtgaaaaattgttggatctattgggctttgtttcctacgcttctgtgtctacccatgtgatgagtgtatcatctcttactataataaaacctaaagcttaacatacaaagatgacacgtcatcattcactaacaattattacatttaaacatcatacaagcatgttatattattaataattttatagtttattatattttatagcttttcaaatataagcatgttaaatcatcatatcacataattcacataatatttcaatatgtttcttcatctttttttataatatcatatatacctatattgtccatcctaactcctaacttagttaatgtgctctctctctcttctctcattaagccatatcacatcaattgttttgtccttagatgattatctattgttcaaattatctccctccttttcttctcttaagaagtcatatcacctcaatcgtttttagcctttagatgactaatctatgatccaaactatctccctccttttcttctctcataaagccacatcagattagttttacatttgaatcatcattgtgtatactatttaaatttaaactaacataaaccacataaacatacaaatcacatcaacttaaataagtttatattgtctggctatcttatacattaattttaattagtgctatcataataaattcttgcagcaatgcacggggtttcacctagtatttaaaatagtaaatgcactgcatttagattagctaggttcttttgtctaagactcagcctttggcaccagcctaaatattgccatacttgcttgttacttgctggcaaaatttgctataggacataaaaaatatgtaattagctaggggacaccacaagaacatgtatctgctatatggcaccgcaaaaaactggtaattagttgctggacacccacgatattattttataggcaaattttgctataggacacttcgacttcgtggttttagccataggacaccgcccgaactcacttttgggggaaaacactccataaatgtggtaatttgccaatagacaccgtgccaattagaataataatttctggttgaaaaggagagagaaatcacgtgaaatgtcaaaaatgcccttgggcccacatgtcagctctcctatctctcttctcttctctctctatcttctcctaggcgatgctggtcaccgccgcgccactgccgcgtggtaccttcttgaaccgcacccacatctgcttcaggtcgctcgtcgacagcacgtcctcccgcccatagctcgcccgccacttgctctcctccggcaagatcgggtacagcagcaacgggagccgcaacagtagccgcaccccgtcctgcgccgtcccgagcaccgcaccgtcctagatgcgcggtggatccccatcacgacctgtcccacctctccgatctctcttgatctcctccggccggccgtcaccaccgtccgtcttcgcaccatcatcgtcgtcatcgtcgccatcgccactgccgcactcgccgtcgccatgccgacgcggctgccatggccgacggcggccatcacctgcacatagcgccaccgccgtcgtcaaagccgccgcagctgtcgccgccgtgcgccacgatcttgatctcgaggccatccgccgccgcctcctcgtcgtggtcctcaccctcgccaccgccgccccacgcggcaaaggcgtagtcaccaccgcgccgcagttgccacagccgccatcgccgtgcgtcgtcgttggcgtcgccgctgccacaaccgggacagctgccgccgcacgactgtcggtgctcctggcgctcaactccgtagacgacggcgctcccggttgaagaaagatggaagatatgacatgtgggcccaaggacattttagaactttcacgcgatttctccttcctcttcaaccggaaattattattttaattggtgcagtgtccattggcaaattaccacgtttatggagtgttttcccctaaaagtgagttcagttggtgtcctatggctaaaaccatgaagtcgaagtgccctgtaacaaaatttccctattttataatatccaaaaggaaatagagagagaaacagttgccaaaataagattttgcttatggagaagtttctatatgctgcttggaatatttggaagcaaatgaatggtttcatttttgataaaaaaaaattccatctttgtcttcttggaggcaactcttgaagagtgatctccttcttttgttgtttaggactaatgcgagatatcacgatgtaattataagctggatcaatctgttgtaatttgtaccctttctttttaataaaaatttcttaacagcaggggcctcccctgctgtgttctcttccaaaaaacgattttgcccctgcctaccaagtctagctcgcatacagctccgacgctgccaccgctgtcgctgccgttgttggcaaggcagctctctgggtgttcaagagggcccacgcgcctgggcctgtggctccgcatcattcccacgctcgtcgttgctgcaacatgaggaccacgccggtgctgaacatgtggccaccgcgatgtcggagctatatgcgagccgcaaaatcgtacattcatggctatttttctctctatttactctagatataataaaataatactacgggtgtccaacagctaattaccagttttttttggtgttccacagctgatatgcatttttgcagtgtctcctagctaattacactttttttttatatcttgtagcaaattttgccattaaatggcttaactgtagctataaggcttagcctgagatttgaagcattgggtagctcccttcgtgtcagcaacgggcgcgcatattggctcaactgggagctcctaatgaataacaaccccttgcaacctgcccacctagggggtacagaggacatgaagctttgatcaagctatggtacgaagttcgaagaacacgcgcgacttgaggttggcggcgagctagagtgacttattgggggtcgagttgccagcgagggcctgccgacctgcgcgacggctacgacgtgaagcgcatgtgttgtgttggccgtcagatagcctcgccttccgtgcagaggtccatccccatggacgatgccggtaggaccagccgctgcggcaacaacacatattggtgcaagcagttaaattattataggttttataaggaatttggccgactcgtcatgtccatcttggcctccgtctcatctgatcatctccctctccaacaccacatagaattcgagttttactcttccctgcgattcaaaattttggcatctgcgtacgacgcgatgtcgtcatatatccggtgataggactctaccttcactggatgtccgacacgacggtggcggcactccttccgaccacaacaatagttttgtcatcgtgccaccagaggaaacctcaatagacgtagaatttgcccctctggttctacttgtacaaaagactaggggtggaaaaaaagctctgtctcgcgagcttagctcgggcttggctcgagctcacttagctcggctcgtctcgattgctaaacgagccaatctcaagccttctttttagctcgttcttgaaatgagctaagaccaagctggctcgcgagccgcttgtttggctcgtgagcctaggccatcatgtacttatatgtatgattttattttctagtgaagttattatttgtcaatatgcaatttatcatctagattttgatgaattgaataatataaaattattttaattttgcatgtcgatgatttgttattgttttccttaatgattacaaattatatataaagaggtgcttcaatgggaaggctcgcaagccagctcgatcttgctcgaacctggaaatgagccgagccgagctcatgttttagctcgtttccccaaccaaaccgagccaagccaagcctaacttgttgtgagccgttgcaagccgagtcaaactcgacctggctcatttccacccctacaaaagaccacccaaggatataaatacaacacaccaagaggagaggggacatggaatacaaaccaatacgacaagacaactccaatcttgctgagttcatattcgagagagtagactatgctagtcgtcgaccacatgtgagagcttcatgtcgctagacgcacagagagtagattaggtcatcccaaatattgtactcgtgagatattgatatataaagacaacatcagcttcggccagtaggagtagggctattactcgttgacaagggggcatgaacctctataaaaaatccttctctctcgtctcttttaactcaatctctcgcataccctgacgccaacgattctcttactctacaaataccgtaggcgggtataaccctagtgtcaaatgggctctccggccgtgcggagatctgtccccacagatggcacgtattggtagggaacaatcatagggaattacccaactcgtcgtttctatctcggtctcaccatctctatctctatctctgtctgatcgtctccctctcgaacactacacatggaatcctgagttagccaatacctgaacaaataccgtaggagggtatagcccgtcgacaatacaattgtaccctcattctcaacaagcaaattgttaatgaccaaatttggtaatttcagcatcagaggtggagataaaactcaaccggaattcatgatggaaatcgttccggaaacagagcaaggatcggctaaagtcctgtcacaccctaaaaatcccaaatatataaattgttgtctaaattggaattattagaatttattttaaaagcctagaagagaagatctagttttaattaataaattccaatataaaatggggccagataaaattttattaaatactttgcttaattctataattcctaaatttttctaggatttatttgagctaaggaagtatttttaataaatggaattgcatttaatggataatttaaaatgaaaaaggttttaaaaatcct

SEQ ID NO: 7107 - DNA, 6055 bp, Oryza sativa
cgtggggctgtgtcttgtgggtacagtggtacacctctggccagagtaaaactattcgaatagccgtgcccgcggtcatgggtgggtctaacaatgtctttcgtgattagttttacacttctcaccataataaaagatgctataactggtaataatttgattaactcctggtttggaatggtatattcctggtttggagatagaactgtgcagccaggatggttgatcagaatggttgggcctatgcaatagtgtatgttgtatagcgttggattaatattgtttaattattacttaactgttttattaaattctgaaatgtttattaaatgctgtttatgcaaatgaaaccctactatgccatcctttgttatcctgtgcacttgcatatttgctgcgtggcttgctgagtatgtcatatactcaccttgcaatcattcataagaggaggagttctacagtgatgctgatggtgtggaggattaggtgtagccctggtcaagctgcctgtggagtggagtcgtctgcgccgtttatcttattttttttccgctgcttagatctttattgattgagaggaactacctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctctctttcttttataattaaaccaaactaatggcacatgcagtttataattcctttaattgttctcatttaaaaatttatttattattcctgtgttattagtaccgtacatctattactatactaatggctcatttaccagcaaaagttttacaacattggtttatttaatcttgctgcaatgaaataaatttagcatgttgattttataactttgttttattttatttctttgaaacctgttgttcaaaagtgcaaaatttgtgatcttgtttccaactgtttcaacttatcttgcaagcttggtttgctttatttacttaccttttactttgattttctaactctattcaaattaatccaaaaacttgtactattaattggataaatgtcttaactccctcctttcacttgtctttagatgccgcgctgcaagcctgagtacttgtttggtgttgagggatttgtcaaggagttgcgtacgatgtcctttgccataggatttgggactgcccctttgtatgcccagattcctcgtgatcgtgatgaagagaagtgccgagtcaaagtcaccttgaacagtaatagtgaagatatactatccgtgatgttcgaagctggaggaggaaactacattcatgcatgtcaggaggtggcaaggatcgccataggagagctccgcgatcgctacagtgatcagttggccgacactgagtatcgctaccatcctcgccaaccccagggaagtgaccgtggcagctaccttgagactgaggggattgagaatgatgctaccacaaggcatctggtcgagatgctgtgggctatggataagacccgcgcggagattgtgttagcagctcaagatcgtgaagaccggaatcgtggaaagatttgcaaactagaagacaaggtggatcgtttggagaaggaactagccgcattgaagggagaagcaccaccgcagaaggccagggttcgtcttaccgccaggaagagagctttattcgtccctcgctaccaattggcgccaaaggttcgtgtggtagaaaaagaagctaccccaaccctagcggatcctccgatcgtcaacgtaagtgatgatgaaggagaggaatcaaagcgcacccactcaaaggttgaatggggagctactcaagatgatggagacgagccgaacgagccttcaatcaactccgatgcccggaagacctagaatgccttgtcaagccgttgtcctagatcgttgtgttagtttgcttgttttaagtgtggttgtgtgtgtgggtcttgcatgtggtttacatcagtggtgggatgtaagcgcatgcgtttgtttgctttcgagtgtttggtagttggtgagtttagtggtgtgagagtcttcagttttgtaataatgaaactcagttaagatcaataaaagttaagttagtagaaaaattaattctctgtcctaagtagtttttccccggtttctcttcttgtgctcctgcccatgccagatggtgctcactcgcagtaacgggaatggccccaacatcaacaataacaacaacaacaatggagagaatcccacacttgcccaagtcctggctcaataggcacagcttatgaacatgatgatgcagcaacttcagaaccagtagaaccagggaaataaccatgcacctccccagaacaagttagcagaatttcttcgtgcgaggccgcccactttctctagcaccactaatcctgttgaagctggtgattggctgcatgccatagagaagaagttggatttgcttcagtgcactgatcaggagaaggtctcatttgcatcacaccagctgcatggccttgcctctgagtggtgggatcacttccgccttaacagaactaccgctgaacctatctcttggcttgaattcaccgctgctttctagaagacgcatataccatcgggagtggtgtctctcaagaagaaggaattcaggtcgctcacccagggatctcgcacggtcaccgagtatctgcacgagttcaatcgtctggctcgttatgctccggaagatgtgcgcactgatgaagagcgccaggagaggttcttggaaggacttaatgatgagctttcttacccactcatgactggggattatcatgattttcagaagttagtggataaggctattcgccaggaggacaagtacaaccgcatggagcagaagaaatgccggattgctcacttcaaggcacaacaggggaatagtcagaggccgcgtcttactttaggaccacagtccatgccacggggaggttcttcgtctgttgttcgtccgcagcgtcagttcttcaacaacaatgctggcaacaacatccgcaatcaagctccacaccctgttgcagctccaacacagcaacagcctgccaagagggagcaaggcatcaagcccggggtgtgcttcaactgtggtgaaccaggccattactctgacaagtgtccgaagcctcgacgcgtgaaggttgtccctgcccagagcaactctaccgcaccagcatcaaaggctcgtgtcaatcatgttgctgctgcagaagctcaaggtgctccagatgtgattttgggtacgttccttgttaactcagttcctgcaacagtgcttttcgattctggtgctacacattcatttttatctatgagttttgcgggaaatcatgggatggaagtagaagatcttagacgtcctttgatggttagtaccccgagtaatcaagcactctctttgcaacgtagcccctctgtcagaatagaaattcaaggagtaccatttctggccaatcttatcctgttagaatccaaagaccttgatgtcatcctagggatggactggttagccagatataaaggtgtgatagactgtgccaacagaaaagtaactctcaccaacaatgatggtcgagttgtaactgttcatgcattgtcttcggagtctttaaggtcaagtctgaaccaaatagctttggaagagattcgcatagtacaggaatacccggacgtgttcccggacgatttacctggtatgccgcctaaaagagatattgaattcagaatagatctggtaccaggaacaactccgatccataagagaccctatagaatggcagtcaatgaattagcagaagtcaagaggcaagtagatgatttgcttcagaaaggatacatcagaccaagttcgtctctatggggagctccagttatttttgtggaaaagaaagatcatacccagaggatgtgtgtggactatcgtgcactaaatgatgtgactatcaagaataagtacccgctgcccagaattgatgatttgtttgatcagcttaaaggtgccaccgttttctccaagatagatcttcgatcagggtatcaccagttgagaatcaaagaagaagatatacctaagacggcttttaccactaggtatggattgttcgaatgtactgttatgtcttttggacttaccaatgcccccactttcttcatgaacttgatgaataaggtgtttatggaatacctagacaagttcgtggtggtctttattgatgacattcttatctactctcgaacaaaagaagagcatgaagaacatcttcgtcttgcactagagaagctacgagaacatcaattgtatgtcaagtttagcaagtgtgaattttggttgtctgaagtgaagttccttggtcacgtcatctcagccggaggagttactgttgatcctagtaacgtggaatccgtaaccaactggaaacaaccaaagacagtttcagagattcacagtttcctaggtctcgcaggatattatcggaggtttatagagaatttttccaagattgctaagcccataacacgattacttcaaaaggatgtaaagtacaagtggtcagaagaatgtgagcagagttttcaagagttgaagaatcgcttaatatcagctcctattttgattttacctgatccaaagaagggtttccaagtgtattgcgatgcatccaaacttgggttaggttgtgttctgatgcaagatggcaaggtgattgcctatgcatctcgtcagttacgtccacatgagaagaactaccctactcatgatcttgagttagctgcagtggttcatgcattgaagatttggcgtcattatcttttcggtactcgtacagaggtgtacactaatcacaagagtttaaagtatatttttactcagccagatctgaatatgagtcaacggagatggttgtaattaattaaggattatgacatgggaattcattatcacctgggaaaggttaatgttgtagcagatgcccttagcaggaaaggctattgcaatgctacggaaggacgacagttgccattggagttatgcaaggaatttgaaagattaaatttgggaattgtcagtagagatttcgttgcagccttacaagcaaagcccactctaattgatcaaattagagaagctcaaattaacgacccggatattcaagaaattaagaagaatatgagaagaggaaaagctatcggtttcttggaagatgagcaaggaactgtatggttggacaagagaatctgtgtccccgacaacaaagatttaaaagtcgcaattctaaaggaagcccatgatactttatactccattcaccctagtagtaccaagatgtaccaggatctcaaggaatgattttggtgggcaagtatgaagcgtgaaatcgcataatacgtagcagtatgtgatgtttgtcagcgagtcaaggcagaacatcagaaacccaccgggttgttgcagcctttgaggataccagaatggaagtgggaggaaatcggtatggatttcatcactggtctacccagaacggcatcaggccatgactctatttgggtgatagtcgacagacttaccaaagtagctcatttcatcctagtaaagacaacatattccggaagtcggttggcggaattgtatatggcaaggattgtgtgtttgcatggcgtccctaagaaaatagtgtctgatcgaggtagtcagtttacttcaaagttttggaagaagcttcaggaagagatgggttctaagctgaactttagtactgcttatcatccgcagacagacggacaaaccgaaagggtaaatcagattttggaagacatgttgagagcttgtgctttagacttcggtggaagttgggataagaatt

SEQ ID NO: 7108 - DNA, 4768 bp, Oryza sativa
  unsure (1)..(4768): unsure at all n locations
cggttggcggaattgtatatggcaaggattgtgtgtttgcatggcgtccctaagaaaatagtgtctgatcgaggtagtcagtttacttcaaagttttggaagaagcttcaggaagagatgggttctaagctgaactttagtactgcttatcatccgcagacagacggacaaaccgaaagggtaaatcagattttggaagacatgttgagagcttgtgctttagacttcggtggaagttgggataagaatttgccttacgccgaattctcgtacaacaacagttatcaagctagtctccaaatggctccttatgaagcactgtatggtcggaagtgccgcactccgcttttgtgggatcaaatgggagaacgtcaggttttcgggacggatatcctgagggaagcagaagaaaaggtgaaaatcattcaagaaagattgcgtgtggcccagtctcgtcataagagttatgccgacaatcgtcgtagagatataagtttgaagaaggagatcatgtgtaccttcgtgtcacgcctcttcgaggagttcatcgtttccacaccaaaggaaaattggcaccgcgtttcgtgggaccttacaagattgtcagtagaagaggagaggtcgcttgtcagttggagttacctcaatctttggcaggagtccataatgtgttctatgtatcgcaattgaaaaagtgtttaagggtacctaccgaagaagctaatcttgaacagatagaagtccaagaggatctgacctatgttgagaaaccaatccgtatcttggaaatagatgagagaagaaccagaaatcgagttatccgtttttgcaaagtccaatggagtaatcactcggaagaagaatcaacttgggaacgagaagatgaattaaagtcagctcatccgcatctgttcgccagttcttccgaatctcgaggacgagattctgtttaaggggggtaggtttgtcataccctaaaaatcccaaatatataaattgttgtctaaattggaaatattataatttattttaaaagcctagaagagaagatctagttttaattaataaattccaatataaaatggggccagataaaatttcattaaatactttgcttaattctataatacctaaatttttctgggatttatttgagctaaggaagtatttttaataaatggaattgcatttaatggataatttaaattgaaaaaggtttttaaaatcctcttttggctttgggccgaaagtcggcccaaaaccttctctcttctccccggcacaagccggcccagtccgccgcagcagccgcgtgcgagcgccctcggacgctgacaggtggggcccgcctgtcaggccgtcgtctacctccggccgcgcgccgcccgagccctagcgccgcgccgccgccgtctccttccaaattcggccgcccctttccttttccggtgaaatcaatagaggggaaatgatcttcgggatctcctctaccttttctcttttggaatcgtcggctaaaatcgtttggaaatctgtggattcgagtttgattcggatcgatctctctcctccaaaccctagactttccttcacatcgccggtcgccgtgggccttcgccgccacctccttgcccctataaaaggacccccggtgtctccgctacccgccgccaccctcgcctttaccagccgccgccgtctgtagcgccctagcaccatgcagccgtgcgccgccgtcgccgccgctccagctgtgcgccaccgtcgctccggtcatcgtcgctgctcggggaggtcaccgtcgtggtaaccaagccatcgccgatctcgtccgcccctccgccgtcgctgtcgaccgccggaacaccgtcgccgtcgtcaagccgaaggtcgcccccgcttcttcctcgacgccgtcaccgtccgttgatcttccgccgttgttttggtcaccggtgagttcgccgcgttgccctctacgtgttggttccctccgttcgcgctgtcgtgtcgtcgttcgccggagagcatgcactcccgagccgccgccggtggtgacgccaccgctgacgtcatcgtcatcgttccccgtggcccggtcatggaccgatggatcttggccgtccgttttggatgaatcgatctcggccgttcgtttccgtgagccgccgccgtgctcccggttcaccgcgaaccctagctactgacgcaataattcccttttccttttcaaaaataattcattattgcgtcataattcaattaaaatccatataagtgttttaatccgatttaatctttaaaaattcataactaattcatcttagctcggatttagttggttcaagtctctaaaattttctaaaattgagatctacatgttaaaaatatccacatatactgttcatgcttgtttatgtgctgtttggtgattttgcccctttctgtttagattccgacgttttcagagagtctgttttcgcaggagaagaatttgaagagttccaaggccagcaaggcaagtcacacagatcccaaacaaccctttgagcatgttgatcccgtttaaagctattgtttctattcaactattgcatttattttcaaatgtcattgggtggaattaacctattgtttgttatagcccttttgttcttgattattttattccttgataccttgggttattataacttcactagttgggctttatatattggttcagctagatattagatataattgcttagccatgcttagaaacattagcacactattgggataacttatgactcactattatttaatgatggtttaattatagctcacgatggctaatcatgattggttaattaattaatttgccaactaaaacttgataatggtgggttgtgagcacatggttttgattgtcgtgctcatgacgattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaatggtgcgctgtggtggattgtgttgtgcaaggggtactgtcacagctcctttctgaggtaccatggtggtattgaggcgcatggtgacatgtcgtggggctgtgtcttatgggtacagtggtacacctctggccagagtaaaactattcaaatagccgtgcccgtggtcatgggtgggtctaacaatgtctttcgtgattagttttacacttctcaccataataaaagatgctataactggtaataatttgattagctcctggtttggaatggtatattcctggtttggagatagaactgtgcagccgggatggttgttcagaatggctgggcctatgcaaaagggtatgttgtatagcgttggattaatattgtttaattattacttaactgttttattaaattctgaaatgtttattaaatgttgtttatgcaaatgaaaccctactatgccatcctttgttatcctgtgcacttgcatatttgctgcgtggcttgctgagtatgtcatatactcaacttgcaatcattcatcagaggaggagttctacggtgatgctgatggtgtggaggattaggtgtagccctggtcaagctgcctgtggagtggagtcgtctgcgccgtttatcttattttttttccgctgcttagatctttattgattgagaggaactacctacctctgtaatgacattttattcgcttattaattagagtaataattgtactctattatcaatttgttattgtgtgcctcggctgattcctggacgagggttcacacacatgtaagcgtttggaattttggatagaaattctgggcgtgacaagtccgaatcaactgtgaccgggatcggcagaatccgagttggacaaggttagccaattgagccgagtccaacaatgcgacgcagtacacgttgtcgagttgagttaatgtgcttcatgaggattgtcatgcatggattgagtcctgagaaggcaattgtatctattaattaggatattttatgtaatttccttagagatatgtttgggcaaaattctgccgcaaagacttatggtatcttagagtttgttaaagataagagtcgtgtccgacatggacatattttgtaatctcgggtataaatagacctcgagccccatgtaatacaacaacacacgttcaatacaatctcggcgcatcgccacccttttactttcgttttgtttcgacgagctcttgctttcgggttgagctgcatcggtttcaatcttcaactagaggtaaaacttcttatggcggcttgcgttctcgggattagtgctttcatctttatgatactctaatcttgtttatgtaatttgtcgagttatcatatattctatataatctttggcaatattgttatctaacctccagtcggctaacatctgttgctagaaggcagccgattaggttaaataccaacgttgacttagattatataggatatctaccaccctatgaaacaatcagcggcttgattgtctagatattgtccttcttttcatacttatagctgcatcagttgagtttgatcttataaatcatgcttagaatctcaatnnnnnnnnnnnnnnnnnnnnnnnnnnnnnnnnnnnnnnnnnnnnnnnnnnnnnnn

SEQ ID NO: 7109 - DNA, 8467 bp, Oryza sativa
  unsure (1)..(8467): unsure at all n locations
tgttcatcagaggttgggcctagtgaacgaagatcgtgatcaagaagacgatgaggacagaaaaactcaatggtgtccttatggtatttttacaaagaatcagaagagaagggtcaaaaggttgaggaatagagaatgttttcgtggggtagagccaagagatcaaccatcggctgaagaaagcaaagcccaggcaagaatggcgtgttaaaaggcaggatccaacagccgatgaggctaaagccaatgaagcaaagaggctggccaaaggaaagagtgtcgtgactgcatcggttaacatggtttttacactgcctgcggaatttggagctaaacaagccgatgttgatgaagttgaggaagcttcggctaaattggttttgtcaccagagcaagcagtttttgaaaagccagaagggacagagaatcggcatctcaaaccattgtacattaacggttatgtcaatgggaagccgatgtctaaaatgatggttgatggtggggccgctgtgaatttgatgccatatactacgttcaggaagttgggcagaagtgctgaagatctcatcaagacaaatatggttctcaaagactttggtggcaatccatcggaaacaaaaggagttttgaatgtggaactaacaatcggcagcaaaaccgtccctacaacattctttgtcatcgatgggaagggttcctatagcttgttgcttggaagggattggattcatgccaattgttgtattccttcgaccatgcatcaatgcttgattcaatggcaaggcgacaagattgaaatcgtgccagccgacaggtcagttaacaatgctaatgtcgatttagctctttgggagatggacggtattgattgcttgtctggaaaggtttgggatggagattttctaaaagtgtccgattgtgatatacatccaattgaagacggagagcccaaattattgttttgagggcgtcgtggagggttcaagcgtctacaccaaggatacagtagatgatctcgatgacaagcaaggacaaggtttcatgtcggctgacgatctgaaagaaattgatataggtcctggtgatcgacctaggccgacatttatcagtaagaatttatctcctagattcagaaccaagttgatagagcttttaaaagaatatagagattgcttcgcttgggagtattatgagatgccaggactaagccgatcgattgttgaacatcggcttcctataaaaccgggggctagaccttaccagcagccaccgaggagaagcaaagccaatatgctcgaaccagtcaaagctgaggttaaacatttatatgatgctggtgttattcgtccatgccgatatgctgagtgggtttcaaacatagttccagttatcaagaaaaatggcaaagctagggtgtgcattgattttcgagatctaaacaaagctaccccaaaggacgagtacccaatgccgattgctggtcaattggttgatgccacctcagggcataagatattgagttttatggatggtaatgctggttacaatcagatctttatggcagaagaagacatttataagacagcttttagatgtcctggtgcaatcggcttgtttgagtgggttgtaatgactttcggcttgaagagtgctggggctacatattaaagagccatgaattatatattccatgatctgatcggctggttggttgaagtttacattgatgatgtggtggtcaagtcaaaagaaatagaaaaccatatagccgatttgaggaaggttttcgagagaaccaggaaatatggcctgaagatgaatccgacaaagtgtgctttcagcgtatcggctggtcagtttttgggatttcttgttcatgaaagggggattgagataactcagaggagtgttaatgcaattaagaagattcaacctccggaggacaagacagagttgcaggagttgatcggcaagataaattttgttagaaggtatatatctaatttgtctggaagattagaacctgttacacctctgttgatattgaaagccgatcaagaatttacttggggggcagagcagcagaagactttggataatattaagaaatatcttagctctcctccagttttgatccctccacaaaaggggataccttttagattatatctgtcagctggtgagaagtcaatcggctcggtcttgattcaggagcttgaaagggaaagagagagttgtgttttatttgagccgtcgggttttggatgcagagacaaggtattctcctatggaaaagttgtgtttgtgcttatatttctcttgcacaaggttaaggcattatctattgtccaatgaatgcactgtgatatgtaaagccgatgtggttaagtatatgttaccggccccaattctaaaaggaagggttggaaagtggatatttgctttgatagaatttgatcttcggtattaatcaccgaaggcgattaaggggcaagctatagccgattttattgttgatcatcgtgatgactcaatcggctcggttgaaattgtgccatggactttgttctttgatggatcagtatgcactcatggctgtggtatcggcttggttataatttctcctcggggggcaagtttcgagtttgcctatactattaatgtaacatacccgaaattttaggacttaaaatttcttgtcaaaatagttagaggttaacttctccaaatttcgagagccaaaaatttccgttttaatttaggtgatgaccaacttaaaccattgcatgattaaaatttgagaacaaaataaaatcttttcattcccaacattagactagaaatgtcatcaagcatacatgtacataatgcatgcctaggctcgagttctttgtgcatttggagttttggtcttgcattccataataggtcccatgagcataatctaaaagaattatttcactaaacaaacctatagttaatcttgggtgataacatgtggacttaatattaaactcaaatatcatcttctcagtccaaaagaagtttaatgtaatccctataataatattagatgaaattatgaagtgggaacacatatacaaacaaaggtcatcctaattctctaaaatattttgtgcaagataaaatcatggaaaaatttatgtggacagtgattagcacaaacttatcctctgtaattttggtaacatgttaacactcaagttgaaatctcaaattaatcggtcgaagcagacaactaaaagaaatcaaattaaatttaatcggctaaaaccatatttcatccaaaagaacatttaactgcacataagtgaacatgggaaataatttattcaaatactagattagttatcatgaataaatataatttttctagaattttccttctctgtttaatcctcctaaaaattcaatccagctttctaatagcccatctttgtttaatttctgtgagcagtccacccattatttttgagtgcaaccaaagaaaatggaatctaggtgtaatcatttacctccagtaaaatcaacactaattaatttggtccacacattgaattatgtagttacaaagttagaggagaaaataattccgaaaattaatctaaaaatcaagtttacccagaatcttacccaaccctctcaccctagcctagtttgccacgacctggacccacctgacagcctcttaagcttgccttgactctgtccatcacttcctccactgttccagccgagagaggaagagattgagcgagccgacgcgtggccgcaacgtgtcgtcgatctcggtttcccttttctcgctctctactcctcccagacgcgccgccattctccattcatcactctggagctgaagaagcctagggaggaggttctctgcctctccatcgccccaaaccttgccgccggtcgtagtgacgacgaccttcgccatctccgtttgagtcaaggtcacctccatctctttcgcgttcccatctctccacacaatgccgagcatttcctcttttgacctaaacccctctcgtgcagtgcatcgccgggaacgcgaccacgccgacgacgccctggagcacgcaccggagcgtcgccgcttcaaccatcatcgtcgtccggccattctcatccacctcagagaaagccgctgcgccattgtcatcgcctcaacctcctcttcaaaacgcctcaagaaccccagccggaaacatcaagaacacggagaacacatccttttcttcaccggcgccaatctaggatcgcctccgccgtcatcgtcgattaccgctgcctcggtgagccattgttcgattcctggcacatacaccatctccttgacctcacaaccctcgtgcatgcttgctgaagcagctcattgtcccgttcgagccgtcgtcgttcacccgagaagaagccccgtcgtcgagccgtttccacaagtcaccgctgccgccaaagacctcgacaaccatagctcgacccacggtgagcatcctgaagtctagaagaccacatgcatgcatccttttcgttcgtaatcgacttccatgcgcacatgcactttcaccccaaaaccaccgccgctcacactcgccatcggcgctactccgatgtcctctaaccaagaaaactagaggaatggaaacgcgagagcttgctcttcattttatcttttgacctcaacctcaaacgagccaccgtttgccgccggcgagctccagatcgagctcagccatggctagctctgctatgtctagagcagagggatgacttccgtgaattagattaagtgcagggatccgtttacaattgtagaaacacactgacatatgggcctaggactgtgggttgattcctagaaacctcaagggcctttgtgcatattggtccctcacagccatgtggaccccatcctctaaaatctgaagaaaaattaggaaaatgcccaaacaattatatgtttagcagaaaaatgcacaaagttgtaaaatctatataaaatcaaatatagctcattttgaagtgattccagtttctgtagattcttgaagttatgaactttattccaggaatataaaacttgacactcactgtacaaataatgtctctaagatttatctaagataagtcatgcataaaacatgtacaaacttataaaatacatagaaaattcatttcaactcattttgaaacaaaatcaaattctacagattcatcattcatcatcatacagtctctgattaagtgaaataaaagtaattacttactttgcatcaaaagcctctaaaactattatctttaaaatgactagttttagataagctaaactttagaaattcatgtagaacccaatttagcttcaatttgaataaacttaagttatgtaggatcactaacatatgtatttccaagttatgaaataatattatatacttactgtgtagtaaaagtctctaaatattcatataaggatttactaacatagagcagcctttaatttgtaaaacttgtagaaaatttatttttagtccaaatgaaatgaacaaagtttctatagaaccagcaaatagttatcttcaacatagtaaaataaaatttgtcaccttttgtagagaacattgatcaaaaccttaacttagtgaaataagaatttaaacacatagtgttgtttaagtaatacataaacatgtataagtatatatatacactttaggtctaattaaacctaaataaaaacttgattgaccagtgaagccatagttccatttccatccactaaaattagaagaacttagctcatataacaatttctaggttaatataatatattgctagtttagattaaagcatctctactttataaaatatgaaccatactagtaaagatcataaacatgtgaactaaaaatgttttagttaaccaaattattccttttattcaacttaaacaggaagtagcatgttctgaacctatcactcaaaagtcatgcacatataaaacactatatgcctaaaacacgttgtaacttgtaaaatctataagaaaatcattataactccaaaaaaattgtgaaaccaaatgtgttagtcttagaaaacacatctccacacccctgtgaagtctaatctaataaaaatcactttacaaaagtacttcataacactacctaagactatactactataaaccgataaaacttctaaaaattcataactccctaatggaataagataaaataaaaattctttcacctaaattcattttagatcagtaccaacccactgtgcataaatcatgcattttagagcattttggattttcagctctttcggtgtttaattgcatatcgtgtcctttatctagataattgcataatcggtgaagaagtggattaggtgctaacaattctctgatcaaggcaagttttctcctcccatcctttgaacacattgaatcccatgatttgaggaatgaaaatatttgtttgcaaagttgcatgtgaacttagactatatcggtatttgaaattgggttaaggtagttatgacctatttgctgcatattccaccttgaataattgatcctcttgctgtttgaacccctagaaatggttagagtacactctttgtgctcaaatgggtttatatatgctctatgtgcaattacttgcttagccatgcttagaaatacgcaaatgctcattccatctataattaaaatgtggttttgatacttgaacctttgctggaataaaatgaatatgatgggtatttgcgaattaaaatgtgtaaaatgtgattttatacttgggcggcaagtggtgtgcatatggtgttagttgcataccgataggggaagtgtttgcccaagtccataaggaccgaacttgtgtcacccatttaaagttatccgtacatccacatgtgctagtatgggatggcctaagctgattaatctatttaggactagccttgcattctggtaggccggtgtgtatgagttagtcgataattctgaggaattagtcgatgattcagaggaacttcctatttgccccgacgtggtagtttaggtgactaagtctgtccaatacaacggtattgtgccacgtgggtgggttcccgttgtgtccgccaccacggcgttaagtttaaggcgtgggcccgccacttaacggttctagacatatttccaagtatgcctaggatggaggaacacgtatcgtgctggtgcaaggctagattctaagtagtgtaaaggcttcgttatgacctctagatcacattcaacatgaagagtgtgatggagtcttgcaaactcaaaacaaactagagagttcatatcatgtgggtaaagctgtacaaactctgcagagttctttaaactaatcgattagccgtgctcacggtcatgagcgctttggtgatgtgtcatgagtatagactatgttttaaaaatgtgatcatgtgatattggtttgaaattaataaatgtgttgagttgtgtgtgtgaggtgatatattatgtcttgttgtcaaaggatgacaacaggagattgattataatggaattatgatgaattaaatattgaaacttaaaatttgttttgttaattgaagcatcaactcttttacaaaagaattgcgaaacaaaacttgctttatgctgaaaatgaactacatattgccttcctttgaatatatgccttacatgtagtatggtaggattgatttgtgcttgccagtacattaacttgtttaatgtactgactcttgctgtttgatataaccttttgtttgcaggtttagtcttagtctttgagtgatgcgggttctgattgcttcttctaggatgagaacttaatgaggtaaacccctagtcggtgtgcttgtgattgggtagtcaagcttccgttgttctctaataagtctatttggccggtcggcctatgtaattattaagttgttgtaagtcttaagtttctttcatcttagttgtgtttgctatgtataatcatgcttaagatgaaagtgtgaatctagtgcacatcctgggaactagattcacatgagtatgagttaggaatatttgagaggttgtagatctttagccatttttgtcaagtctcctgaatgtgtaacacatctggtcgccgccttcgagtggtttgacgggcacatctcaggctgaagttgactggcaggctaagggcccagcaatgtctccaatattcctctctcgaggtgtcggatgtttcattatgcttgtttgatgacttgaattattcacttcatctctcaaatataatggaaggtccggagagcctacgacaattaagccctatgcaaccaataatcaggttgagtacgaagcggttctcaaagggtnnnnnnnnnnnnnnnnnnnnnnnnnnnnnnnnnnnnnnnnnnnnnnnnnnnnnnn

SEQ ID NO: 7110 - DNA, 1492 bp, Oryza sativa
gacttggaaacttgacttctgcagcggggcaactccattccacaggcaatccttgacagcaacgacgaaaccaacttcgacaagacagctcccactaggaagatcttcagctctggtgtgggggaaagagagcaagactgagtactacccactatactcagcaagtcataccggaagaggaggtatgatgcaggatatatccaaaggaggctaaaggctcatttgcataaagctagcatttaaaaccagtagttgaaagcagtaaaatagctgtagtgatttatcaatattaaccaaccactgtccaacgctacaccacgttgcaacaggcccaaaccacctcctgaactaaccagttccattagctaactaggggtgagactaatcacggtgaatctggtcgaccgcccataaccgcgggcacggctattcaaatagttttactctgatcagaggtgtacaactgtacccacaggacacagccccacgacacgttcctgtgcgccgacatgccaccatgacataccggaaagaggccgtgacagaacccttcgcataaccccctctaactaatcgcaccacaccttagggttcgcccccgtccccagcaggcaacgggcagccccccttttgtgccgtggtgaatccggaagccgaacaaccggacaccccggccgacccaactccatcacgcccaccctcgcctgggtacgtcggctagaggaaagctacactacaagcccagccgttgcccatgctggcttgtggtaagtacggtaagttcttccagggcatcccgcgaaccggtccttaatcgccatgggaacgactagcaaaaccatgtacccacagcccaccatgtagtgtattttaattaaccaacaccattgcggtggcactaatccaaagctatgccaataatcaaagtctatgctttaatgtaatccccctttgtgcactagttgaactaagcatagctaagcaatccctaatccaacatctaatcatcttaagacccaagttatcaatggcataaggtaaacaagatatggctgagtagtaggacccatcccacatgatattgtaaaacaatgcaatatttaataaaaatgcgggacatttgtaaattgggtacaatatgatcaatcgtaatgcatgacttacctttctctcgcactgatggaaccacagcaacgtcttcgagaaaccgcggatcgacgaaacggccgaaatctacgcaataaacaaagcacacaagcaaaacaggctataagactactgaaacaggaaacaaaaccatttttaatggattctatgtatttttatgaatttagtgagacttgaatggacttaatcagagctcggatgaattagatatgatttttagaagattatctgtgtttttactaataaagaaaaggccttaaataattactgcgcaataaatccccagggctgacgtcatcaagggagggggcgctgacatgcgggc

SEQ ID NO: 7111 - DNA, 2110 bp, Oryza sativa
agaagattatctgtgtttttactaataaagaaaaggccttaaataattactgcgcaataaatccccagggctgacgtcatcaagggagggggcgctgacatgcgggcctcactcggcagcggctcaaggggccggtccaccgtggaccgggaccacgcgggtggtccaccgccggtccacgggaccgacggcccggatcggcccggggccgatcggacggtgcgggcggcggcctggcacggctcggctcagcacaaagccggccgaccggccatgggggtgcggcggcggcgcacgcgaccaccggcgacggcaagcggcggcgcgagcggcggcggcggatggcgcacaggccgacggcggcggccgaaggtgatggcgagcgcgcggagagcggcggcgcgcggtgaaaagtgagaaggagggaggagaggggctcctcaccggagggcggcgaccagagcggggataaaggtggcggcgacgacccggcgacgaggagggcggacgggcggcggcggcacctaaggagggagtggagaggggttaggggtttggaggaaacccgcggcgacaaaaatggccggccggagttgaagggaatggaggggctcaccgacgtgcgaggaaaccggagctcccgaggggttcgggcgatgtgaggcggtgaccgaggtgctccaagcggcggtgaagctaacggcggcggcggcttggcgcggtggcggctctagcggcggcggcgcgcagttggaggcggcggcgagctgcggcgcgggcggcgagcggcgcgagctcggtaggagtcacgggagggagcggcgagagcggaaaggggaagaggagggcacggggaacgttttataggcggaggagaaggcgaacgtggccggaaggacctccgatttcgccggcgacgcggggaggagagagaggaaatggggggattcaaaatgtgaatcccgcccctttcgagcgcacgtgcgggccgggacacgcggggagagggcggcgacgtggggaggacgcgtgggcgacgcggcgtgggcgcgggaggagcggcggaggtgggcgcggcggttgccgacgtggggcgggcggccggaggaaggggacgaccccgacaggtgggacccacctgtcggcgtcccgaggagagagggagggagggaggactttggggaggggaggagaagcgggccggcgcggaaggaatgggccgacggcccaagaaaaggaaaaaggaggaaaaagaaaagagaaaagggaaaaaggattttcccagggatttaatattgcactttgcttattttaattggttaaaattatttccaaggctctgaaaattccactaaaaattctgttagcatattttgacatgtagaacccaagaaaaattccacatgtccgttccgattattatttgcatttattaattaaggattcaactctaggttaattcaacaatttctttaggcgatttatttaacaaattttaaagctaaaaaggggaacttcagggcgtgacaaagattggctagcttttgcttttcatgatctaattcggcattgcattcttcaagttgagctataagatcaatcttgtgggcttcaagccgatctatgttcgactgaatcgccccaacagagagttgatcaagcttggctttctcctcatgcacaagttgccgattggcttggatagtggcttcaatatcttttcgcacctgctgatcggcaatccgttgcttagccttctccagcttgaattgatgttgctcgagtgacacagctggagtaatggtatttgccagatcatccgggattaaggcttggatttcagcaaaccgtgcccggatggaaccgcagtcggccaccaagttgtctaatgatgactctagccgaagggatatatcttcgagtgttttcttgacattttcatccagaggggctagagccttgcttgtggattcttcttctacttctttatcaaagtaatctttgatgtcaaaggagaatagatcggctaaggtctggaaaagagaaatttaaagatagttaaatatcaaacagtgtcagccgatctaagatttatgtaatgaaagacttt

SEQ ID NO: 7112 - DNA, 1031 bp, Oryza sativa
  unsure (1)..(1031): unsure at all n locations
nnnnnnnnnnnnnnnnnnnnnnnnnnnnnnnnnnnnnnnnnnnnnnnnnnnnnnnattcggtcgcccctttccttttccggtgaaatcaatagaggggaaatgatcttcgggatctcctctaccttttctcttttggaatcgtcggctaaaatcgtttggaaatccgtggattcgagtttgattcggatcgatctctctcctccgaaccctagactttccttcgcgtcgccggtcgccgtgggccttcgccgccgcctccttgcccctataaaaggacccccggtgtctccgctacccgccgccaccctcgcctttgcccgccgccgtctgtagcgccctagcaccgtgcagccgtgcgccgccgtcgccgctgcagctctagccgtgcgccgccgtcgctccggtcgtcgtcgctactcggggaggtcaccgtcgtggtcaccaagccgtcgccgatcccgtcgctgtcgaccgccggaacaccgtcgccgtcgtcaagccgaaggtcgccgccgcttcttcctcgacgccgtcaccgtccgttgatcttccgccgttgttttggtcaccggtgagttcgtcgcgttgccctctacgtgttggttccctccgttcgcgctgtcgtgtcgtcgttcgccggagagcatgcactcccgagccgccgccggtggtgacgccaccgctgacgtcatcgtcatcgttccccgtggcccggtcatggaccgatggatcttggccgtccgttttggatgaatcgatctcggccgttcgtttccgtgagccgccgccgtgcacccggttcaccgcgaaccctagccgctgacgcaataatccccttttcctttataaaaataattcattattgcgtcataattcaattaaaatccatataagtgttttaatctgatttaatctttaaaaattcataactaattcatcttagctcggatttagttggttcaagtctctaaatttnnnnnnnnnnnnnnnnnnnnnnnnnnnnnnnnnnnnnnnnnnnnnnnnnnnnnnn

SEQ ID NO: 7113 - DNA, 576 bp, Oryza sativa
  unsure (1)..(576): unsure at all n locations
nnnnnnnnnnnnnnnnnnnnnnnnnnnnnnnnnnnnnnnnnnnnnnnnnnnnnnnnnnggaaaacactccataaacatggtaatttaccaatggacaccgcgtcgataaaataataatttccggttaaagaggagagagaaatcgcgtgaaagttctaaaatacccgtgggcccacttgtcatatcttccatctctcttcaacggaaagcgtcgtcgtccgtggagtggagcgccaggagcatcggcagtcttgtgtgtgcatgatcagctgttttaacatagctgatcatgaacacacaaactatacttgttaaatcacattcgtttgttgaaaatggggtacaattgtattgtcgacgggctatacctgtctacggtatttgttcaggtattggctaactctggattccaagtgtagtttgtgagagggagacgatcatacagagatagagatagagacggcgagaccgaaatagaagcgatgagttgggtaaatccctatgaatgttccatacaaatacgtgtcatccggggggacatacctncgcacggacagagaggccattcgacaccag

SEQ ID NO: 7114 - DNA, 435 bp, Oryza sativa
tacgtcacttgcttgctccaattccttctagggctagctcttccactcaggcttgacggacgactccgacaacacgtcttttctgcaagataaaaaaaatgtattaggataaatgcgaagtaacatatatatatatatatatatatatatatatacatgtatatatatatatatattgcatttcacgttaacgttcgtcctcgttcgttcgctcgttcacgttccctagctcgttcacgttcgttcgatcgttctcgttctcgttcacgttgtcgcggcaacgtacgttgacgtgttcgttctcgctctcgttcgttcgatcgttctcgttctcgttcgttaacggcggtgtggcggcatcggggcgacggttggcgcggcggcgtggcgaccgcggcggcggcgtggcgttgtggggccgtggcggcggcggcg

SEQ ID NO: 7115 - DNA, 965 bp, Oryza sativa
ccttcatgtacctcgcctattgcaaccttggcttgatcggcactcaaacatttaagcaacactccatcaatcgtccgataatgcaactcatcatccaacaaggtgtacttcaaagccttacagcgcaatttctgagaagccgattgagatggattctgcaaataatgatacacatcatacctccaatcatcggctgttatcgtggcaacttctattttgacatccttcatcatcgggttgtaacccaatgccccttgagccaagtcattagctttgatattttgttcttgaaatacatgcttcaaagtcaccagctgaaatcctttcattaactctcggcacttctcattgtagacgatcaatgtatcattcttgcactcatattcccctgccaattggctaatcacctacaaggaatcgcccataatcttgatagcatcggcttcaacttccttaagtaattgcaaccctttgagaaccgcttcgtactcaacctgattattggttgcatagggcttaattgtcgtaggctctccggaccttccattatatttgagagatgaagtgaataattcaagtcatcaaacaagcataatgaaacatccgacacctcgagagaggaatattggagacattgctgggcccttagcctgccagtcaacttcagcctgagatgtgcccgtcaaaccactcgaaggcggcgaccagatgtgttacacattcaggagacttgacaaaaatggctaaagatctacaacctctcaaatattcctaactcatactcatgtgaatctagttcccaggatgtgcactagattcacactttcatcttaagcatgattatacatagcaaacacaactaagatgaaagaaacttaagacttacaacaacttaataattacataggccgaccggccaaatagacttattagagaacaacggaagcttgactacccaatcacaa

SEQ ID NO: 7116 - DNA, 2949 bp, Oryza sativa
  unsure (1)..(2949): unsure at all n locations
nnnnnnnnnnnnnnnnnnnnnnnnnnnnnnnnnnnnnnttaagcactgtaggaaggttgtatacatgggtcatcgccgattccttgcagcaaaccacccggtacggaagaatggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatatctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcacccaatcggggtacctgaatcacgccatgaagggagactacggggaaaggaaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacatttcagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggactaaagatcttt

SEQ ID NO: 7117 - DNA, 5090 bp, Oryza sativa
  unsure (1)..(5090): unsure at all n locations
ttggagcaagcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcgagaaagagatgctgtggaccacaatgctcgagacattcacccttcctgcgggtacagaggacaaagtgaaaaggtggactctgaagaaaatggcagaacaatttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcacgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttgaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctcttccggcaccttcaaagtcaagggcccccctagctccaccgcttgcccacacaagggcaacaaagaaggcgaaagttgacgccgccaagatcaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgactggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttataagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctaacagcgagtactactacgtcgaaatcgtagctagctaggacatataatggattgtaattaatacatgactacatatgttctatatgcatgtgtacacattttctataatgtaaatatattttgttcatatatatatctatatacatatgcatttgcataacatatatatgtataaatacatatatatatgtatgcatatatatgtattgaaacatatatatgaaacatatatatatataataatatatatatatatatatatatatatatataaccatgcagcaacaggggcatgcaaaaaaaaaaaaaggtcagctctatctttagtcccgggtggtaacaccaaccgggactaaagatcgatctttactcccggttatttcacccgggactaaagatagcgatctttagtaccggattggtactcccggtttggaaaccgggactaaaggggggttacgaaccgggactacaaagggtttctccaccagtgtcattttggacttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7118 - DNA, 466 bp, Oryza sativa
  unsure (1)..(466): unsure at all n locations
nnnnnnnnnnnnnnnnnnnnnnnnnnnnnnnnnnnnnnnnnnnnnnnnnnnnnnnnnnnnnnnnnnnnnnnntccaattataataacccaaagtatcaaggaatagaataatcaatgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaacccaaatgaacaatacataaaaagtaaacaaacatgtagatcatatttttagatgaattatgagacttgaacggcctcattctgagggtaccgagct

SEQ ID NO: 7119 - DNA, 1096 bp, Oryza sativa
cttccctggcgtcctgcaacatctgaccaagatcatccgcaacgtcgttaccatcagcagctatttcctcctcgcccgtttgatttcctttaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccggcggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgtttaacttctttaatttttattttaggttggtttctattatttaatattaactttcactagagttttccttctcaactattatataaaccttgtttagcacatgaactaaatttctatatattctttcttccccacacacattttctctctcatcaacttacaactaaattttggagacaaaaaaagtgtgcaaaacataggtgcatatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggtagctggaggaggaagaagacatatatataggggtgggactttagtcccggttggtagcaccaaccggggctaaagatcaccgggatcattagtcccggttggtattaccaaccgggactaaagttaagatctttagtctcggttggtagcaccaaccggggctaaagatcaccgggatctttagccccggatggtg

SEQ ID NO: 7120 - DNA, 7237 bp, Oryza sativa
ttttattctatgcatgttaagcaggtgtttgcctaatattcagtctcagctttaaaaagaatttgcaggggaaaactggctcccatgacttttcactaagaagaaacctcagccaaagccagccgagaaaggccacgaaccctggccccttgacacgtggatccacaccccatggttcaggccttaacaaatgctttgaggcccctgccccatacacgagggcccacccaccataggtcgtttcttaacaagtgtttaaaccaaggggccagcgtgtgatgtttcttaaaccaactctgaaaattcgctcccgagtagagtcgaacccagacactggttggtgctagtagagtgctgcaaccactaggctatagacccgttcgttatccattcttagtttcacatttgcacatatgtatttcattgtggttcagacttagaagaccttttacctttattgtttgtataaagttggtagtatgtctgtatgtgagaaaatcatatttttaattcccatggtataggaggaggttattaaagtggtccaacattggtcatgaagtggctgggattagtttttagcataagtgggtgataactgagaaggcccaatagcagaatgggagattccttggatgtcgtcagttttcataaacaagcactcgtctttcgtcaaagggtggtagcgttaatgcctagtgttgatttcatatgtatcagcatgacatgctaaaatttgataaattttgttcctatatgttcagagtgactatctgaggaggctttctctcagaatgctcaagttggagactgagcctattcaactagggcatcagcaggcagttgatcaatcttccgagtccaaagttggtcagtacccaacctcaatgcttcaacaacagaccagttgtgatcagcagagtctatgcattcaggtagataccaagctccaggagatgccaccgaacggtaagttacatttgaatttctagtttatagggaccatttgatccataagaaatagaagtaatatctaacctaaagaaactaacgatcccaagataagcacattgatgtgttggaaggaaactcaccaaacatgaatagtacttgtggtagataataccgtgctgcgtgcacataacacaaggttgttgttctgtttatattgtctgattgcataaagaaacataaatctggctaaggttaataattgatcatttggagtcctttatatttattgttattgaagccacaaccatctaataactggctggtatggttgtagtattatcgctggaatgtatatttacatagggaatcacatatacccagataacaggttaagacctaatattggcataacatctaattgctttagtcttttatcctgaaaattgaacacttgttcttactgaaaacagaactttgatggatgtctttattgcagaacacttgctcgaccaagttcctccacgaagccagaagaagctctgcatggatgacaggctaagtgaccttcctgatacaattctacaccatattatgtctctcttatcagcacaggaggttgcacgtacgtgtatcctgtccaagagatggaaggagctttcggcctcagcaccatgccttgatatctgtgtagataagtttggaatggacagggtgcggttcagtgagtttgtagcacatttgctgctatcccgggctcctaattcactgcatacatttcgtcttcactcttttgcaatcgaccatgccagctcttggatcaatcgtgcaattgagctcaaggcacaagtgcttgaattcaccgaatatataagatgggaatctttttacttggatccacagcttatggcttttgcatctcaatacctgaaatgtttgaagctcaccaatgttactctagactccaatgcgtttgaaccgctaaaccatgcatgcccagctttggaaaaccttcagttgtcacagtgcttccttgaggtgcctgagatttgttcagcttcattgaagaagttggatattatggagtgttctcttttgatgaatcttcaaattcagacccctcgcttggtctctttacgcttcaggtgtcttcaatacaaatgttcttcatgcagtaggtatcctgtaattacagcagcagtgactctatgtgatcttccgaatgccgagaacatagacttgtcatgttctgggagacaggtatgattgtgatggtgttttcaccctctttacattcttttcgcctgaattatatccgtgaaaactgcatttatctgttgtatattttttgtatgtttgcaaggttacatttggcagagaaattcaaaagttcccgatgtatggcaaattaacaagcatctctcttggtgaatggtgtctttctgacaagttctctcgattattttgcctccttcgacactcacctgaacttaaggagcttactcttaagcttgaggtgaacaatatcatagatgtatagttctggctataagatacttttctcttagcacattacgcaaagtcttggtgaaatgtttttaagtagcacttttccgaacttcaggtggaacgtcaagaccacaatggagaggatgagattcgcttgatggtgggaagatcattttcagccgaaaatcttaagaaggtaacaatctgttgcgcggaaggtgatgcaagggccgccatgttgggaaatatgttccgtgcgaatgcaacatctctcaaggaaatgcatatcaaacactattagatgctgaacaacgcttgccttgtatctgttggatttgatttgccagtggagacctaaaaatttagggacaattactcatttgatcctgttttgaagtctaactaccaatgacactactttaggtttgctcatttgaatatcaaaattgaccttatattgtgaaaaccaaatgatagtgttaactaaggggcgaattgtccttttttttgccccacctcatttgatcatgttatatcaacacttttttttattaagagcattttgaaatgtttgtaatgaatttggcatagctttgataattttgaataagtttaacggaattgtcttcaatttgacaagtttgattcaatttaacatattttttttttacaaaatttgaccacatattatccaacagcaaattcaagtctaaacggatgcccaacagcatgtgacaacaccgataaatccaacagaagagagctctgtccagcggtagtgatggtgcacacagagcagcaaccatcgccgcttctcctttctccatgtgccgcagccatcgccatcccacccttctcgctcgctggcgccgtcgatcctccgcgcgcagcaaccgccggtccggcgctgtcccctccgagcgtcgacgctcctctgtgcgctggccagccgcgttgccgcaggcccgcagccattgccgtccctcccttcgcgcgtcgatcggcgccgccgctcctccgtacgtagcagccgcgcgtatccccttcaagcgtcgctgctgccaccgctcctccacgcggagcagctggcaccgtcccttccaagcgccaccgctcctctctgcgcggcgcggccgcgtcgccgatttatatgtttggatagggttcgtataaccataggtattttggtcagttcacgctagcaatttggtcagacggcggtttcaattttgaaaaacgtggttaaatgagaaaacaaaaaaaaaaggtaaattaattattagatctcaaaacagagtcaaataagtaattgccaccaaaatttatcctcatacttatacagtatcgtgctgctttgctgctttgcatccacgcactttttgcgactaagctgaggaacaaaaaggattctctaccaatgatgaacaaaaatgtaacaagatctgcatatctaccatgcaagagttgtccagaaagatcgctaggagacagagttggggaatgctctcacgcttcaacaagaaggataccgcagtctcgacgatcaccatgcctcaagaggtaaaaccagaggtaagtggttttgtctcgatcttgaacgaaaaattgctcatacgatagatgcatccgtcaacgctggtgtagccaataaatttgatgcttttagcaagcattttgaacatatgatggagaggccacaaagtgagacaaaacctacattacatgatccctatgcatccatcacatctctatttcaaaacctttttttttaaaaaaaatcaacgcgctaaaaaaatccaccctaaaaccctaaattgtatattcctatagaatttatttagaggagaaaattttcggattgaaatttataatcaattatatatatttgatggtaaaagaacaaatgattggagtatatatctaccactttaaaaacacagtcattctccttccatccttttatcaccatcaccaccgtgtgctaacaactgtaggatcctactttcttcttagtctacacaactaattcctagtaatatgggcttagcccgtgatctatggacacattgtgggtgcaggcaatggcgtatttggttgcctgcacgcccatccgatctaggtccagcttgtgcaaatcacacctcgaagccaggcttggaggaaacacggaaattggcttaggctagagtatgttaagtcatgcatgtgaacaactagttgattgtctaacaaaggggttacatcctagtgaaattcagtcaatatgtaataaaatggacatgattgatatcttttgcccatcttgagagggagtgttgatgtaaatatgtgatgtgtctaggacctatttgtaaaatgttcagagaatagaatagagaagaagggggtgtgcaggagaagcaacccaccctgaaaaatcccccaatcgagcaagaccaatgatgcaactatttttctgaatccactctggcaggaagtaagagtgataatatatctggcctaaagaaattttctgaatatagcaatttacccaatccgatcgatgtactggctttgatatgttagaaattctaagtaattttccttgcaaacaaaagccactaccttgcaaatatttgggacttcctttgagatgttaattgacataataggagaaaagactagcagactgggaagaaaactaactttgtttgatcaggtcttgcgaactgctatctgaagctggctgctcaattctgtgccatataagcgttgccaacataatgtaggaacgctaaataactggaattaattggaatggtcactgtgctagaacatggtttgttgtccaaaagatctaggcgatctggacattgccaatccgaagttttcagtagagccttgcaacttagatggtagtggtttgaattttcagaacccagaagacaccatgggtggggtcccggtgcccatgtgatgcaatttgatagttccttgtaacaagttacttgttctctgcaagcactagcatcacaaattcataattcgaaatggtgaacatgcatatgcttttggacagacagatggattcaagaatgtcaatcaccaaatgaactagaaccaaacttgtctcttctttcatgtaggaagaagcgaactgttagagaggcaatttacaaggaacaaatggataaggagatcatatagaagtaacaaatgtttggtgatttcctggcaatcttccattgtggacaaaattgcaaaacataagtttcatgggtcatttggcatcatctgggatttatatgctagtctgtttcgcaaacatgcctatctactgtctgcaagctaaaaacagagcaaatatgcaagttctttgtggctattattgcaggagaaaatattaacagccgatgaactacaagctagaggatggctgaatggtgatatttattctgtgatcaagtacaggaaactacataaatatttgcttcttcaattcaatgactattctctccaaacaagtatagctcaagatatatgattcaagtggtaataacctgacatcctgatggaatgaatcaacggtatgcaaaaatagaagcaatagagacatttgttgaggttttttggaacggaaaagcggcacaagatagtgccttttcattgaataaaacaggagaaaatacaacccctaagggtaaaaaagaaaagctgttacacgtaatatgtacactatacaagatgtggggcgaactctcgtagacgcttggcccctgccagaacccataggccaacctcatctttgatttttgttagcagggagctcgttgccatctctttatggtcaaagatcctctgattcctctctttccaaatctcccagacaactaacaggataagggatctgagtcccttacatttgttgaggttttaactcttagctatataggtcttctttcattttgtttctacttgtaataaactttcttccagctatatggaattatggattgcatagccatctttagaatggttggtttaaactttaaaatcgactgaaaatagtagaaaaatgtgctgccatatgcatagatagttccataaaatagacgtgacatgtacctttactatacctgcatgtcttccccgcttaatgatatctaatttgtcatctaggagttaagaaaacaagaatcacagtaaattaaagtagttatttctctcacttattttttataaattcagaaaagatcattaaattattactgcagattgaaatactaacatacttcatatcgttgtacgtgtgatcaactgaccatgcaatgtgtctggccttttcactactgaaaaaaatgacagtttatccggccccttttttcaaaatatatcaaaaaaaagttacttcatttgttttaaaatatataatgttgttaacttttaaaactgacttttatcattcattttataaaaaaaataactatatgtaagtattccttccatcctaaaatatttagctatccttctagttcaaatttgattattcgtcttataaatgtagctatattttgagttggagggaatatcatttatctgtgtttctacaatagttgaaagtggtaaatttaccttaatctatctaagtttttgcatgaacagagtttgtctgttcgtacccatctcagccgtcagtctttttttcttttttcttctgatgattcgggcccattatatttcgacgaggacgacgacgagcctgtgtcgcttcatagcttcaccattcccaggcacgcat

SEQ ID NO: 7121 - DNA, 6986 bp, Oryza sativa
  unsure (1)..(6986): unsure at all n locations
nnnnnnnnnnnnnnnnnnnnnnnnnnnnnnnnnnnnnnnnnnnnnnnnnnnnnnnnnatttcgacgaggacgacgacgagcctgtgtcgctccatagcttcaccatccccaggcacgcatcctcttctaacatattccgcggcgccgccgacacctcgtgcattggcgccaccacgcccacgggccgcctccgccgacgacgaggacgacgacgtcgacgcccttactacatgctcctccttgccgttgctcttctccttcttcgggttggccggcggcgctttgccttggtattcttcctcctcctcctcctcgttgtcgttgtcgttgtcgccgcggccgcggctcccgttctcgtggtgcagcacgatgaagccgatggggccgtcggggtggtcggactgctcggcgcctctggccagcctccgcgaccggaacgccagcagcttgacgacgacgtcccgtgtccatctctggctgtcggagatggccatgccgttggtctcgacgaacttgccccacccctcgatgaaccggtagccgccattggactcgaggtacctgcaggtcatcccgtactcgttgccgccctggtcgaacaccgtcaccttcagccccagcttctccctgatctgcttctcttcctcctttttaatctccttcttcttctcatcctttttgatcttcttcttcttcttcttctccactgcgatctcgtccttcttgtggacgatttgcgtctccttgtcggtgaagagatgggtgatcgggcattggtcgaggtcctccttgcgcttgcaggagaagagcagccggttctggttgcggtggacgtcgctcatacgcagcgtcttctcgcagacgaactccggctccgtcgcgtcgagctccgagaggcgcctgcgtagttgcgcgctgcaggtgcctaggttgcggaaccggtcgtcccgccgcgtcttcttcctctccggcggtgctgccgcggtgaccatgtagctgatgatcctcctcgtcgncggtgatctgggtggtggtncgncgncgncgncggcacgaatcccgtcgtgcatgagcttctttcgcggcggttcggtggtcgccgttgatgcttcaccggagactttctgcttcccaagcttgatgttgcaccgacgtaattccctttccagggtaggcccgtcaagacgtggtggttgcggtggtgctgccgtattactactacctgctgcggccggagctccgccgccgtcttccattggagtttctgagacgggaacggcactgttggtttggtcggaagcgccgccgccgccatgtcggagatccggcggaggcagagtatctcgggacgacatcatcgtgtctcgtacctgccaaaattttgaatcgtcaggattccatgtgtagagagggagacgatgagacagagacagagtagaaaaggcgagacagagatagagaaggcgaattaggtaaatcctgtaaaagtggattaaagcgatgccctttgcctcgggtcgccctgcgtgttatataggacaggaacagcccctaccgtggcttgttacaacagaatccaaagattacaaggataggattagatcagaacaaataaactacatcgcaacaaccttatcaggtcacatgcgataacaaccaaaacaaccaaaaccaattctatctttaacaccccacctcaatcacaacttacccaagttgagattgttcttaaacatctcaagccgtcgaacaggaagagcctttgtgaagccgtcggcgacttgatcatcagttgaaataaaccgaatgtctagcaacttttgtgcaacctgttctctcacaaagtgaaaatctatctctatatgtttagtccttgcatgaaagactggattagcagacagataggtggcaccaagattatcacaccataatcttgcggcatttggttgttttattccaatttcatctaacaattttcttatccatattacctcagccgtggcatttgcaagtgccttgtactcagcctctgtgctagacctagacaccgtcgcttgttttctggcgctccaggaaaccaagttagaccctaaaaacactgcaaagcctccggtggatctcctgtcatcaacacaccctgcccagtctgcgtcgaaaaaagcactgatcaaagtacttgctgatctgttgatctttagtccaagacttaccgttccttgtatataccggagtatcctctttacagcactccagtgatccaccgtaggttgctgtaaatattggcatactttattgacagaaaaggaaatgtcaggccgggttagtgttaaatattgtaaagcacccacaatactccgatattgtgtggcatcattctgtcccagaacagctccttgagttgatgacaacttttctgaggttgataaaggagtgttggttggcttgcacttggccatgccaactcgcttcagaacttctgtagcatatctctcttgggacaacactagcccttgggagtttttcttaacttcaatccccaagaagtaatggagatcacccaaatccttgagagcaaaatccttctcaagatccttaagtaaagctttagtagcctgaggagatgagcttgcaacaataatatcatcaacataaactagtacaaacattgtataggtaccacggctatagaaaaatagtgatgtgttagctttggaaggtacaaagcctaaatcctgtaatttcttactcaggcgagaataccaagctcgcggagcttgttttaaaccatataatgccttgtccaatttacagagataatgtgggtgtaccttatcttcttatcctgggggttgcctcatgtagacttcttcttccaaataaccatgcaaaaaggcattctgtacatctaattgtctgagactccaaccattagaaacagcaatagatagaataagtctgacagtagcagctttaactaccggactaaatgtgtcctcatagtcaatcccataacgttgcttaaatccttttgcaactagtcttgccttatatctatctattgacccatcagattttcttttaatcttgtatacccacttacaatcaatcatatttttttcttgtactggtggaactagatgccaggttttattatgcatgagagctgtaaattctttatccatagcaaccttccaatttctattactaacaacttcttgcaaattgacaggttcacctgtttctatcaaaaaaccatacctgacagttccattagtgtactccttgcgtttccggatccctctctgtgcacgagttactggcccaactggtgcagtgacagcagtctcttcaggtactgcaaacgcctcagtgctagtctctgggtcctgtgtactatctccagaattggttgccgcagacgatccaggggctggctctccggtcggcgtgccagagccatgtgacgaagacagctcgggctccaattcctgcatctgcccttcaccaaccggagaggctgcttcatgaaggtcagcgcctgctgcacctgctgttggctgacgtgcatctgctgcctgctgacatgacggagactgctgatgtgatggatccatgctgccttgtgcgctagaagctggctgtgcatcctgcatgaaatattgcccgtttgaccttgtttctgcacctttgaagctgaaattttgtgctgcatttgcatcaccatctcccgagttgattacagctgcactaatctcatcattttggttagtgtcagggttaggattattaaccagtggttcaaccaacaattcgcccccggaaccaaaggatgaggagggttgcaagtgagatggaagcagaaggatttcagctctaagtttggcgccagcattagtgtgaagagaagcaaacggataaacctgttcatcgaaagtaacatcacgcgagatatatactcgtcctgaagatggatcgagacacttaaaccctttgtggagagtactgtaaccaaggaagacacatcgttttgatcgaaaggagagtttatgggtgttgtagggtctgaggttgggccagcaggcacaaccaaacacgcgcaaagcagcatagttgggtttgacatgaaggagacgctcaagaggtgtagtatagtcgataactttgctgggtgttcgatttatgagataggttgcagttacaaacgcctcatcccagaatttaagaggcatggaagcctgggctaataaggagagacctacctctactatgtggcggtgttttctctcggcggctccgttctgttgatgggtgtgtgggcaggaaacatggtgctctatgccaatgcgctgaaagaaggtgttaagccgctggtactcacccccccaatcggtctgaacaaccttgatcttgcgttcaagcagccgttctaccaggttctgaaagtcacgaaatttttcaaaaacttcagatttgtatttgaggagatatagccatacatgcttactataatcgtcaatgaagctcacatagtaacttttattaccaactgaattgggtgctgggccccaaacatctgaataaactaaatctaagggaccagcagaaacactggtcgacttctgaaaagggagctgatgacactttccctgttgacacgcatcacaaaccgatgcttgactagaatcaggaattacagggagattattctgactaatgactctattaacgacagcaaaagaagggtggccaaggcggtgatgccacctcgccgttgaaggcttgacgacactgtgagcttgcttattcatggaggtagagtggctggatggaagtggataaaggcctcctctacatcggccttgaagaaggagcttcctcgttgccagatccttgataaagaagacatggggataagtttccataaaggcatgattatctctaaggaaatgatgaacataaactaggttcttctgcgcagttggtatatgtaagatatttcgaaggagaagatttctgtttgaggagcgaattgtagtatgacccacacagttaatatccatacctgtgccattcgcagtgtgcacttgatcattgccgttgtacttctccttcaccgagagcttctcgagctccccggtgatgtgatctgtggcgcctgtgtccaggtaccagttggtgtcgactccgtaggaggtagctgcgccggccaccttctcttctccagtgaaagaggtatcaaacctcttccagcacttgatgacggtgtggccgatcttgccacacagctgacaggttgggcggtttccattgttcttgttgtcgttgccgcggccaaaaccgccacggcctccattgccacctccgcgtccgcgaccgcgtccatcacgccctccgccgccgccgcgccctccacgcaacatggagttagctgaggactatgtgtcgccttgaaggagttccatgcgctgctcaaagctcaggagcaacgcatagagttcagccaccatcagaggttccactcgtgttgccacagaggaaacaagtgggttgtagtcgtagtcgaggccggcaaggatgtaggagaccagatcttcttcatcaagaggttttcctgtagtagctatttcatcagcaagagatttcattttacttacatactcggcaacactcttgttgcccttcttggtggtggagagcgccatgcgggtgttcaggacccgcgccctggactgcgacgagaagattgcatctatggcttcccacacctcagaagccttggtgagagttgcgacttgaacgagtatgtcgcgcgagagcgacgacaacaggtaactgaggacctgttgctcttgtgcaacccaggttgcatacgctggattggccaccttctcggtgacttccttcccgtccttgtccttgcttgccaccaccagagttgtcgccggagcgacggcagtgccatcaagaaatcccgccatctgagctcctctcagtgtggcgagaacctgtgctttccacagcacatgattggacttggagagtttctccgatactgactgcccatggagagagggagcaggaacggaggacgacgaggccatagattgaaactgggtggagggagaatggctctgataccatgtaaaagtggattaaagcgatgccctttgcctcgggtcgccctgcgtgttatataggacaggaacagcccctgccgtggcttgttacaacagaatccaaagattacaaggataggattagatcagaacaaataaactacatcgcaacaaccttatcaggtcacatgcgataacaaccaaaacaaccaaaaccaattctatctttaacaaatccctgttccgtacgtatcatccgcggggacgaacctccgcacggccgaagaggcaatccgacaccagggttgtgggattcaattgcagagaaatcttgggcctcatctaaatggacgcgaagagacggcgcggtggcgcatcgacgtcgacggcgacggcgacctcttcccatcctacgtccgcgctctccgctgccttctcgccgttaacacatcgttttcttcctttctctctccggcgctagggtttgcatcggcgctaggctagggttcttcgtgaaggagctccgggagcggagggggaggggaagaagaagaaggagcaggcgctggcgccgctcgccgccgcgctcgaggcggcgctcgcgctgctccggctcggccgcgaggggagccgaacattaggtttctttttttttttgcggggaaacattaggtttcttgatttcttgattaggtgaatttctgatggttgacagcgggtgtcctaggtgaactcggttcttgatttctagggatttttctctcttaccaatttcgtaacttaaaacttataatacgattgaacaccctgagtttatgggnnnnnnnnnnnnnnnnnnnnnnnnnnnnnnnnnnnnnnnnnnnnnnnnnn

SEQ ID NO: 7122 - DNA, 891 bp, Oryza sativa
gggtttcttgatttcttgattaggtgaatttctgatggttgacagcgggtgtcctaggtgaactcggttcttgatttctagggatttttctctcttaccaatttcgtaacttaaaacttataatacgattgaacaccctgagtttatggggtctgctggaccatacttgtttgttggtcgccaccgccgccgccgcaagcagcaccgccaccactagcaacggcagcatccggtggcacatcatctctaatggcagatcgatcgatctgagctctaagctgagctgagctccttgtcttgaagatgaaggggacctcacctcacctcaccctgctctgtcactctggttgtctctgctctgtgtttgtctgcaatgataggagctgtatgtatatatactccatatctcttgagatctcatctcagctaaagcctcagcatcagtaaaaggcagtaacttcactgtcaaaggttggatggccagctgccgctggtagatttacagctttgttgttgaaaattttgtacacatatgcaaacagccatactttgtctgaagaatagaatgagacaaattcactgcctatttttattcgggggtaattaacttcagtttggtgatgatgtacagtgagacaaatgcactggttttttatcaggggggtaaattatcttcagtttcatgatgctgctactcatttgtaactgtattagttatcaattatcatagcttgcatcaaagaattgctttaatcacaaaaagttgctctgctaatgcatttctgaaactaggctgactcacatggagagatgccctctatcagtttattttcatattatcatgcttcaataataagtactacctccgttttttaatagatgacgccattg

SEQ ID NO: 7123 - DNA, 681 bp, Oryza sativa
aggttaaactcctcctgtttgtcctcgtcccacacggggacaccttccttcttccacaactgtttaagatcttctaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtcttaacatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcattcggacatgcgtgaatcttatgaacttccagtcctaacgggcggactatcttcttagcctcgtacgttgtctcgggcaat

SEQ ID NO: 7124 - DNA, 684 bp, Oryza sativa
  unsure (1)..(684): unsure at all n locations
ccatgtgtgtagatgtgaaaacacgaggcctggaagatctgcttaacttcagtgcaggtccaaaaatcttgcctttaggttcgtgagcgtgcagttgatttgatcctccaatcaccaagaaataaagccaaagaacccgcggttaaatccataaacgatagccgatcggctagttgccgatgatatatcatttatctccaagccgatgtcatatgtgaattgatcggcaatcatgaataaaatgaaaaagaactaaatctactctatcggctgtagatattaacaatatgtagtccttatgtcgatatatacttaaatcaaatgattgggatatatcggtcgccacgccgagacagtataaatcactcagatcgaaatatatactaacaatgagactatatatgttcatagcatagccgatcagatagatccagtatgtatcggctaatactccgataccactctatattaagatattaaagcaagtaaaatatatcaaacagaagcgtaatatatctagatgtaacaagatcataacataaagggcagatctagcatatcaattaagtacatgaaatataaggctaaatcagataagatcgcctgaaactctgatactactatannnnnnnnnnnnnnnnnnnnnnnnnnnnnnnnnnnnnnnnnnnnnnnnnnnnnnnnnnn

SEQ ID NO: 7125 - DNA, 579 bp, Oryza sativa
ggcggcaacgagtacgggatgacctgcaggtacctcgagtccaatggcggctaccggttcatcgaggggtggggcaagttcgtcgagaccaacggcatggccatctccgacagccagagatggacacgggacgtcgtcgtcaagctgctggcgttccggtcgcggaggctggccaaaagcgccgagcagtccgaccaccccgacggccccatcggcttcatcgtgctgcaccacgagaacgggagccggggccgcggcgacaacgacaacgacaacgaggaggaggaggaggaagaataccaaggcaaagcgccgccggccaacccgaagaaggagaagagcaacggcaaggaggagcatgtagtaagggcgtcgacgtcgtcgtcctcgtcgtcggcggaggcgcccgtgggcgtggtggcgccaatgcacgaggtgtcggcggcgccgcggaatatgttagaagaggatgcgtgcctggggatggtgaagctatggagcgacacaggctcgtcgtcgtcctcgtcgaaatataatgggcccgaatcatcagaagaaaaaagaaaaaaagactgacgg

SEQ ID NO: 7126 - DNA, 1052 bp, Oryza sativa
ctcgggtttgggggcaatgtttcctctagacgaagagtggctaacaccccgtcactccaacctcatgcatggctggagtaacgtacgtaaccatgcatgaacgaacaccaaatcactcgaggttgaagacaactagctagccacctaagaaacgagaaacgagaaacgagaaacgagaaagatgaccttagcggcaaccgcacaacggctcaaaccaacccagcaaccaatcctcctctccaaaaccccccacttccttcctctcctcctcacggcctcacagcaagcagccaagcacacgaccgatcgcgatcccaccaccaccggctgccggcgggaagaaagctagctagcaaaccaaaccaaactaaagccatatatatggcggaggaggcccgcggcggtcagcgcgtcgtcgtggacgacgatcgcgaggacgcgtcgtcggtggcgtcgtcgacggagcgggcgttcgagggggagccgctgccgtcgctgggggagacggtgacggcgcggtcggcggcggtgagcggggtgctcggggcggtggtgagcgtggtggcgataaggctgaacctcacgtcgggcctccttccgtcgctgggcgtccccgcggggctcctgggcttcttcctggcgagggtgtggatccgggcgctggacgtggtgggggtgtcgcacctgcccttcacccgccaggagaacaccctcatccagatcgccgtcgtctcctgctccaccatcgccttcagcggtattccctccatttcatataactacgagagtaattttgacttttttctatagtcgtttaagtaaatttatagaaaaatttagcaacgtatgtagcaccaaattaatttcattaaaatcaatatttaatatattttaataatatgtttattttatatttaaaatgttgttatattttcatacaaactagcatggtggcccgtgcagattgcgcggctagcatcattaaattttctctcatataatagcatatatgtttactcattatattactcaaatatattaaaatgacaaca

SEQ ID NO: 7127 - DNA, 660 bp, Oryza sativa
  unsure (1)..(660): unsure at all n locations
nnnnnnnnnnnnnnnnnnnnnnnnnnnnnnnnnnnnnnnnnnnnnnnnnnnnnnnnnnttgagctataagatcaatcttgtgggcttcaagccgatctatgttcgactgaatcgccccaacagagagttgatcaagcttggctttctcctcatgcacaagttgccgattggcttggatagtggcttcaatatcttttcgcacctgctgatcggcaatccgttgcttagccttctccagcttgaattgatgttgctcgagtgacacagctggagtaatggtatttgccagatcatccgggattaaggcttggatttcagcaaaccgtgcccggatggaaccgcagtcggccaccaagttgtctaatgatgactctagccgaagggatatatcttcgagtgttttcttgacattttcatccagaggggctagagccttgcttgggattcttcttctacttctttatcaaagtaatctttgatgtcaaaggagaatagatcggctaaggtctggaaaagagaaatttaaagatagttaaatatcaaacagtgtcagccgatctaagatcttatgtcaatgaaagactttctaggatggcaggagccgctgtttgtcctcttcttcaacatgatgacttcctgtagccgatgggtacggtcaat

SEQ ID NO: 7128 - DNA, 801 bp, Oryza sativa
  unsure (1)..(801): unsure at all n locations
nnnnnnnnnnnnnnnnnnnnnnnnnnnnnnnnnnnnnnaaaactagggtttggaggagcgcgaggctacatcccctcctcatttctcaggtgagctcgtagctccggtgagcaacccgtcggccgtcgtccccttgctgtgaactactcatgtttgtttcatactactgtttctacatgtcccactgtgtttgttatgactgtttcagtattttcttccattatgttgcaccattttacttagactaacctcagcacaattaattttaatgttttagcacagtctttgtagatgtttcagttggctatccatgcttgtttcattatattaataaaacttgtttcaccacatttttgcatgtttgttgtgaactactcatgatttggttcatactactgtttctacatgccccactgtgtttgttatgactggttcagtatgttcattcattatgttgcaccattttacttagactaacctcagcataattaattttaatgtttcagcacggtctttgtagatgttccagttggctattcatgcttggttcattatattaataaaacttggttcaccaaataacaggctactagacccatccttggagatgtaggcttccatgtttcacttaagtacttctgagctgccatgaaccaaggngagaaatgagccatgaagtacttgcttggttgatagaaatgttnaatggagagtgtagagaagatagcacaatgcaatcaaacataaaaaaatattttttatatgtcttctctccaatcatatcggaatttttttaatcta

SEQ ID NO: 7129 - DNA, 710 bp, Oryza sativa
  unsure (1)..(710): unsure at all n locations
cttcaacgatctagatgaaaatacaccctaaacagatctgttttaactggggaaattgaattatgaactggccactaaaacgtgaccatgcatgctgtcaggccttggaatgggtggcgcgacgggcaccgtggcctgggcctctagccccgaagggctgttttggtttaaaaccagaacttgtgttaccaaatcattgatgtttttgaatagtacttttgaaatgattcttcactgacatatcgaccaatgtcgtcaaaatattagcaatgtcaaaaattgtctaggttttgacattataaatattttaatataatagcaaatcaaactggaagccactacgaatcgggcacccgatctgggagaaaaaaaatcgggcgcccgtccgagccgtccgatccagcaccctaatctcgtccgtctgcgtgcattaaacaggagtttcaatcagtcggcgcctactgcaacaaatcgcggggcttgttccacggcgctgtccaggcgcgagccaccgccggcgcacgtgaggggagagttccgccggagcagccaccaccgccaccgctgatctcctccgaagatgctcctcccggccgtgctgggcgtcgccgccgtgcctcagatctccaatgacaattggcgccgccgcaagccgnnnnnnnnnnnnnnnnnnnnnnnnnnnnnnnnnnnnnnnnnnnnnnnnnnnnnnn

SEQ ID NO: 7130 - DNA, 457 bp, Oryza sativa
  unsure (1)..(457): unsure at all n locations
nnnnnnnnnnnnnnnnnnnnnnnnnnnnnnnnnnnnnnnnnnnnnnnnnnnnnnnntgagagttgcgacttgaacgagtatgtcgcgcgagagcgacgacaacaggtaactgaggacctgttgctcttgtgcaacccaggttgcatacgctggattggccaccttctcggtgacttccttcccgtccttgtccttgcttgccaccaccagagttgtcgccggagcgacggcagtgccatcaagaaatcccgccatctgagctcctctcagtgtggcgagaacctgtgctttccacagcacatgattggacttggagagtttctccgatactgactgcccatggagagagggagcaggaacggaggacgtcgaggccatagattgaaactgggtggagggagaatggctctgataccatgtaaaagtggattaaagcgatgccctttgcctcgggtcg

SEQ ID NO: 7131 - DNA, 19252 bp, Oryza sativa
  unsure (1)..(19252): unsure at all n locations
nnnnnnnnnnnnnnnnnnnnnnnnnnnnnnnnnnnnnnnnnnnnnnnnnnnnnnnnnataagatataaatcacacttaaagtactataagtgataaaacaactcataaaaaaataaattataattacgtaaattttttgaataagacgaatggtcaaacatgtgagaaaaagtcaacgacgtcatctattaaaaaacggagggagtaattattttctgaaactaggctgacccttacatttttcttttgctattctgttcatacatttgtcaactagggggcctcacatgtacagatgccatctgtccagttcttctcatatctgcactttgatactaataagcaattatttgaaattatacttgtctggcacatgaattttttgcctttaggtaacattgttgcaaacttagtaccttgcatcaaagtattgcttgtttctactcctatgcctgaataaatgaatgcttacttactacatattcagagaccgaatacttcagaaaagttacaaatggtgccaaacaggaaggaatcaattaggccccgtttagttcgctaattttttttttccaaaaacatcacatcgaatctttgaacacatacatgaagcattagatgtaaataaatgaaaaaactaattacacagttagggaggaaatcgcgagacgaatcttttgagtctaattagtccatgattagctataagtgctacagtaactcacatgtgctaatgacgggttaattaggctcaaaagattcgtctcgcggtttccaggcgagttatgaaattagttttttcattcgtgtccaaaaacccctcccgacatctggtcaaacgtccgatgtgacacacaaaaattttcatttcctcaactaaacacacccttaggccttagctaggaattgaatcatctatacggattattttagttgtactatattttctaaaaaaaatattttagttgactattggaagactataattcttgacctatatatgctagatactggcctcatgcatgcatatgctaacattcctaggcaggtctgtatttccctctaggtcattataatgtgattaggtcaaaataaagtgacatcgtgtctatttttctttgctaaaggggtatttcataggtttgtcttagtatcgtgtttatactgtcgtattgaatgatccgagtcgattgctttcggtgcatataatgcacacagctctagttttctggttgggttggctcgatggctttatacgaattagcggtttttgatccctctaatcctgttctggatccaatgtggagacaaggtatgtttgtcattccttttatgactcgtttaggaataaccaattcgtggggtggttggagtgtttcagaaggaactgcaacgaatccaggtatttagagttatgaaggtgtggcaggggcgcatattgtgttttctggcttgggtttcttggtagctatctggcattgggtatattgggacctcaaaatattttgtgatgagcggacgggaaagccttctttggatttgcccaagatctttggaattcatttatttcttgcaggggtggcttgctttggctttggcgcatttcatgtaacgggtttgtatggtcttgggatacgggtttgataattttttttcccaactgatggttgtcttccaatgtgatcacattggtgtgtttttactgaaatagcaccactacctacatattgatatcccaaattttactgactggtgcaggaaagcgacgataactggaacatcagaagctattcaggcagcagagtctatgataacgcagaggatggagattgtcaagttaggagaaaagaagtctgatgccaaattaagagaggatggagattgtcttttctagttttagcactatccgcaaaaaaaagcttgagagaaaatttaagatatctattgttccttattgagtctgattgtgttagtaactggagtagtcagtcaatcagctgttctatttattccttatttttgttgggaataggattatatttcatattttttgatgactgaaatattaatgtttgatcaacaatagcagcaggaaattttatgatattattgttatgatacatgatgaacaaattgagtcaatatgtgactactaggaggcgttgctgctgctgttgttgaactgctgttgctgctcctggtaggattcaatcctggccgctgttgttgaactgctgttgctgctcctggtaggatgcaatcctggccggatcaatccacaggtggtttgattagtgactccacctggatccattcaatcctggcctggatcaattcctagcctggatcagtgcctaccctgccgaacaaggcctaaatcaaagaccgctcggaagctgcctgcgctggtcgtgacgtgctcgtgcggcattgcggcaggagggactgaatcaaggtgctagaggcattgaccgaacggtcaagctatatcagcagccggtacagaagagttctgtcagattcatatattgattagtactatcgcatttttcattgatttttatagatttgtacaagatggtgtacgcgcagtaagtagggaattattttcaatgctacaagtggtaatttcatgtataaatgccaacggttcacatcttttgccatatggcttacatgcaagctgctgcaaaaaaatgaattttagcactaaattctgaagctgatttgattttttttgtcaaagtttatttttcagcacttaaatattatatcggtaagaatatataaaagttgtatctataactttttattgttaacgagcttgacttattttcagcattaggccaaccaatgaggccttagggcatcctcaatgtttgtggtgtagtataaaattatttttccattctatgaatagtgagccattgttaaagccatatccataatgctatggttagaatttagccacaagatgggctcacatagaatggaaaaataattgtttcatctcttgttcatgaagtgaatgagagagaaaaaatattttctttttgcttgtggtagaccttaaacataaggtgcaccctaagctaatgctactttccacaatgtatatggctcactttacaagtgcaatcattgccttaaggtcatctttttttacaagtgcaatcattgccttaaggtcatctttttcatacattgtggttgcccttaaaggctcgggtggattttaatctggatgatttcatcgtgataaggaaaacaccaaaataaaccatccattttagccaaaagttttgtgtaagttattttcacaagcaacccaagtttagtcctccgttcaccactatccacatgtacacttttggtccacacgcatattggttatgagcaaaaataagtgaaaacctgtgcgcgtaggattcgaatgtggttttccttgacaatgagcaaaaattgaaatgtttttgcccgtattttggtacgttatatatgtttgagtcagtttttaagttcgtccgcttttgaaaatacaaatccgtatgtgagttggattttaagtttgtttgcttttggaaatacaagaggagtcatataagaaatatctttaaaaaaattcgtatgctaactgagatgaaatacgaactcctgattgcagtccatgattttctttaaaagaatattcatgtgaattcccataatgaattttaccctaactaaaccatataacaataataaaattaaaatagtatttacccgttgcaatgcacgggtattttttctagtccattaacaggttcataatagtggtggacacaggattttggtgacgggggtacagagtttgtgaagcataatccaatgacaaaataaatgaagtgctaatatgtgttattagtgtgaataaaaatcatcactatacaaaattgtacaatggctaagaaaaaatgaaaatacccttgaaaagggatgattttgtgcttaagagcagctgttttttctttgtccgatggcgcaggcccgctgcaatttttttttgtggggaagagcagctgttttaacatagctgatcgtgcacacacaaactatacatgttaaatcacatttgtttgttgaaaatggggaacaattgtattgtcgactggctgtacccgcctacggtatttgtagagtaagagaatcgttggcgttaggtatatgagagattgagtaaaaagggacaagagacaaaggatttttatagaggttcatgcccccttgttaacgggtaatagcccactcatattagccgaagccgatgttgcctttatatatcaatatctcacgagtacaatatttggaatgacctaatctactctctgcccatctagcgatatgaatctctaacatgtggtcgacggctagcgtagtctactttttcgaatatgaactcggcaagattggagttggcttgatctgtattggtttgtattccatgtcccctctcctcttggagtgctgtatttgtgtccttaggtggtcttttgtctaagtagaaccagagaggcaaattctacgtccatcgaggtttcctctggtggcacgatgacaaaactattgttgtggtcggaaggagtgccgccaccgtcatgttggagatccaacaaaggtagagtcgtatcaccggatatatgacgacatcgcatcgtacgcagatgccaaaattttgaatcatagggaagagtaaaactcgaattatatgtgtggtgttggagagggagacaatcagatgagacggaggccgagatggacatgacgagtcggccaaattccttataaaacctatatataatataactgtttgcaccaatacgtgttgttgccgcagcggctggtcctactggcatcgtccatggtgatggacctccacatggaaggcgaggccatccgatggccaacacaacacatgcgcttcacgtcatagccgtcgcgcaggtcggcaggtcctcgctggcaactcggccccaataagtcactttagctcgccgccaacctcaagtggcgcgtgtccttcgaacttcataccatagcttgatcaaagattcatttcctctgtacccctaggtgggcaggttggaaggggtcgttattcattaggagctcccagccgagccaatatgcgcgcccgttgctgacatgaagggagctacccaatgcttcaaatctcaggctaagccttatagttacagttaagccatttaatggcaaaatttactacaagatatccacaaaaagtgtaattagctagaaaacaatgcaagaatgcatatctattgtggaacacaaaaaaactgataattaactgttggacactcacggtattattttattatatctagagcaaatagagagaaaaatagccgcggaagtacgattttgcggctcgcatatagctccgacatcgcggtggccacaacatttccggcaccggtgtggtcctcatgttgcagcaacgacaagcatgggaacgatgcggagccacaggcccaggtgcgtgggccctcttgaacccctagagagctgcctcgccaaacaacggcagcggcagcggtggcggcgtcggagctgtatgcgagctggacttggtaggcaggggcaaaattgtatttttgcgactgtttctctctccatttgcttttggatattatgaaatagggaaattttgctacaggacacttcgactgcgtggttttagccataggacaccgcccgaactcacttttgggggaaaacactccataaacatggtaatttaccaatggacaccgcgtcgataaaataataatttccggttaaagaggagagagaaatcgcgtgaaagttctaaaatacccgtgggcccacttgtcatatcttccatctctcttcaacggaaagcgtcgtcgtccgtggagtggagcgccaggagcatcggcagtcttgtgtgtgcatgatcagctgttttaacatagctgatcatgaacacacaaactatacttgttaaatcacattcgtttgttgaaaatggggtacaattgtattgtcgacgggctatacctgtctacggtatttgttcaggtattggctaactctggattccaagtgtagtttgtgagagggagacgatcatacagagatagagatagagacggcgagaccgaaatagaagcgatgagttgggtaaatccctatgaatgttccatacaaatacgtgtcatccgtggggacatacctccgcacggccagagaggccatccgacaccagggttctgggattcaattgcatagaaatcttgggcctcatctaaatggacaaaatttggaaattccgaagatcgaatgcagtccttttctttcaaaatcaggaaacaatgggtaaaatcatcagaggatctcatataaatatcaacacacacaatccattaacaggttccatacagtggtggacgcatgattttggtgtcggggatacatagttagtgaagcataatccaatgagaaaaaaatgaagtgctaatatctgttattagtgtgaataaaaatcatcactacacaaattgtaaaatggttatgaaagaaaatgaaaatacacttgaaaagggatgatttacttaagagcagctgttttgacatagctgatcgtgcacacacaaactatacatgttaaatcacatttgtttgttgaaaatgggggacaattgtactgtcgacgggctatacccgcctattggctaactcaggatttcatgtgtagtgtttgagagggagacgatcagacaaagatagagatagagatgtcgagaccgagatagaaacgacgagttgggtaaatgatgaggacatcccagctacacttgacgtaaacaagggtgatggtttacgtcataagtcacatgaagaaaatgaagatgacgtaaaccaagttgatggattacgtctcagcaagaacgatccagcatatcatggtcaattacgtgcaaccgtgctaggaagatataacaagaggtgaactcgctctttgctcaacttaacccaaattttaataagaattttataccacctaaatgctctacctttgtattgctagttttacgcccgaggacatcatcactatgccaagaaggatgggttacgttgaggacgacaagggttacgtcaaggaggaatcagcccatgcccaacgagcagccgtctacgccaacaagaagatgatttacactgcaaaggctcaatttccaaggcttgtgcgacccatccagtcatgggatggctgcatggcatacatggttggaaagagggacaagtttagattccaacgcatcaaaccctacctaaatattattttccaagaagaagttatggcacttttactgaaccttgcgcaggagctaaagggctgtgcgcgaacccaagaaaactgtttgcattctcatttatgttaggcttgaccaccaaaacgtggcttcttatgttcacacctcatctagaagggatgttcctattataaatagccccctactgcattcattagacaatttttgttcaattgaaaacctcatgtatgagaaattgctgaagattgtataagtgtcttacctctttattcttgtgagttcttttggacttgtgagaaggcaactttggtgccccctagttcgtgctctatggcttccagttcggctgcaccgtattgtgtggattattctcggattatggttctgtgattgctcggtttgacaggtcagagtccaggaggcttcggatcgttatgaatttggaaattccaaagattgaacttagtcctttttttttcaaaatctggaaacaattggtaaaatcattagaggatttcatacaaatatcaacacacacaatccattaacaggttcataacagtggtggatgcaggattttggtgacaggggtatagagttagtgaagcataatccaatgagaaaataaataaagtgctaatatgtgttattagtgtgaataaaaaccatcactacacaaaattgtaaaatggctaagaaaaaaatgaaaatagtcttgaaaagggataatttgcttaagagcagctgttttaacatagctgatcgtgcacacacaaactatgcatgttaaatcaaattagtttgttcaaaatgggggtacaattgtattgtcgacgggctatacccgcctacggtatttgttcaggtattgtcacgcccataaattcactagtaatttccggacttatttgtgcataaaatcctgatccaggaatcagccgaggtacacaaactgacaatttaatatacaaattcatcaaattaactaaaacgataaatacttacttaagaggcacttagtcctcaccatgaagaaaactgcagcagaaaataaaatctagcgaagctccggctccactcccataggcagctcaactggggtataagccaaacgtcttctccttcgcaatttgtcttcaactgaagtttgattgattattgcaaggtgagcatatgacatactcatcaagccacacagcaaatatgcaagtgcataaggataccaaaggatggcataatatagggctcacttgcaaaagcagcatttagcaaacaattgagaattgtaaaacagtagagtaattaatcatcagtattaatcaacactgaacagcacacccatgctgcccaggcccaaccattctgaacaaccatacctggctgcacagatctatctccaaaccaggaatataccattctaaaccaggagctaatcaaattattaccagttatagcatcatttattatggtaagaagtgtgagactaatcacgaaagacattgttagacctgcccatgaccgcgggcacggctattcaaatagttttactctggccagaggtgtaccactgtacccacaagacacaacccaccagcatgttaccgtgtccgcgcagacacgtcaccatgttgagtgattgtgacaagacccctcgcataactcaactcaaagcagtgcaccattcctggatcataatcacccccttataaacaaggcatggactccccagcgacccccgtgggcttatctccgccacttctcagtctagtgctccgtaatgagccttgttatacaaagtgtccagccgttgcccattctggcttgtggttggcacggttaatgtttcacaaccgaaaatcgtgaaccggtccttaattgtcatgagcactaccatcaaaaccatgtgctcacaacccaccattatcaagttttagttggcacattaattaattaaccaatcacgattgaccatcgtgagctatcattaaatatccatcattaagtaatagtgaaacattagttatcccaatcgtgtgctaatgtttctaagcatggctaagcaattatgtctaacatctagctgaaccaatatataaagctcaactagtcaaattataataacccaaggtatcaaggaatagagtaatcaatgcaaacaggccataacaaaggaacaggttcacaccacccagtgacattcaaaaataaatgcacagttgaaataaatagagaatttaaatataggatcaacatgctcaaaggaactgtgtttgggatctgtgtgacttgccttgcaatattcggtcttcaattaatcttcttgaatacttccaacgcactcgcggaccttcgaaacgacggaaacaacaagctaaaacgcaaaacgaggaaaacgactaagaaactccaaataaacaatacatataaagtaaacaaacatgtagatcataattttagatgaattatgagacttgaacggcctcactctgacttcatatgaatttattacgaattttacaagatttaacttaattaaagcccatttaaaaaggattaaataaatttaattcaatttatggataattttaatatgtagatctttattttatacaactttagagacttgaaccaactaaatccgagctaagatgaattaattatgaattttcaaagattaaataggattaaaacatttatatggattttaattgaattatgacgcaataaagaattatttttgaaaaggaaaagaggattattacgtcagcgggctcggctcacggtggaccgggtgcacagcggcggtctacggaacggacggccgagatctaccctatccaaaacgaacggccgagatcaacttgatctaccgcggttcacgggacatgggcaacgatgacgtcagcgatgacgtcatcatcgacggcggctcggcctcgcgtgctcgctggcgaatgatagcgcggcggcgcgaacgaaggacacctacgggttgcgggcaacgcggcgaactcaccggtgaccaaaacagcggcagaaggtcaacggacggcgacggcgacgaggaagaagcggcggcgaccttctgtttgacgacgacggcggggctccggcgatctacagcgacgaaggaggggcagacaaggtcggcgactgtcacgcccggaaatttactagtaatttccgaacttatttgtgcataaaatcctcgtccaggaatcagccgaggtacacaaactgacaatttaatatacagattcatcaataactaaagcaaataaatacttacttaagaggcacttagtcctcaacatgaagaaaactgcagcggaaaaataaaatctagcgaagctccagctccactcccacaggcagctcaactggggtataagccaaacgtcttctccttctggattctttttcttcaactgaggttgattgattattgcagggtgagcatatgacatactcagcaagccacacagcaatatgcaagtgcacaaggataccaaaggatggcattatatcggctaattgcaaaagcagcatttagcaaaacatttaagagaagtaaacagtgagtattaaatcagaatttttaacaacactgacagcacacccatgctgcacaggcccaaccattctgaacaaccatacccggctgaacagatctaactccaaaccaggagctaagcaaattattacccagtataacatccatagctattgtgagaggtgtgggactaatcacgaaaaacattgctcaactcgcccataaccgcgggcacggctattcgaatagttttactctgatcagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcacccccttataaaacaaggcatggactccccagcgacccccgtgggcttatctccgccacttctcagtctggtgccccgcaatgaaccatgctatacaaaagataaaaccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaaatgtgtgctaatgtttctaagcatggctaagcaattatatctaatatctagttgaaccaatatatataaagctcaactagtccaattataataacccaaagtatcaaggaatagaataatcaatgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaattaattatgaattttacaagattaaatctatttaaagcccatttaaaaagaattaaataaatttaattcaatttatggacaattttaatatgtagatctttattttacacaacttttgcaacttgaaccacattaaactgagttaagatgaattagatatgaatttttaaagattaaatcggattaaaacctttaaactgattttaattgaattatgacgcaataatgaattatttttgaaaaggaaaagaaggattattgcgtcagcggctagggtttggtggaccgggcgcacgggcggcggttcacgcgaacggacggccgagatttaaccgatccaagatggacggccgagatcgatcgggtccacggcggcttacggcggacgaccccgatgacgtcagcggtgacgtcaccgacagcggcggcggctcggcggagaagacggctcgaacggcgcacgctcgccggcgaacggcggcactaggacgcaaacggagggcaccaagacgtagaggacaacacggcgaactcaccggtgaccaaaggaacggcggaagaccaacggacggcggcggcgacgaggaggaagcggcgaagctcttcgggtcgacgacggcgacggcgctccggcggtcttcggcggcggcgaagcggcggacggggacggcggcgacttggcgatcccgacggtggccttcccgagtgacgacgacgaccgtagcgacggcggcgcacggctggacgaacggcggcgacggcggcgcaaaagctcccgaggctagggcgctacacacgacggcgggcgaaggcgaggaggcgacgggtagaggagagcttgggggtccttataaaggggctagcgagcggcgacggaggcccacggcgaccggcggcgagaaggaaactttagggtttgggagagagaggaatccgattcgatctcgattccatcgagtttccaaaccgaattgaccagagattccaaaagagaaaaggaagaggagatcgagaagatcatttcccctctaaagatttcaccggagaaggaaagaatcgagcggatttggaaggagaaggcggcggcggcgcgctagggtttgcgggcggcggcggccgaaggaggacgaagaacctgacaagcggggcccacctgtcagcggcggagagagagagaggagagcggcggctcggcagactgggccggctgggccgagggaaagagagagagagagagggttttgggccggctttcggcccaaagccaaaagaagacttttaaaacctttttcaatttaaattatttcttaaatgcaattccatttactaaaaatacttccttagctcaaataaatcccagaaaaatctaggaattatagatttaagcaaagtatttaacaaaattttatctagcccaattttatgttgagatttaacaaattaaacttagatcttctcttataagcttttaaaatcatttctaataattccttttaaacaacaatttataatttaaggatttttaaacaagaaaagctcttaacaattatacttagatcattaatgatcaaataattactgaactgttctttgtattatttaagaatttagctctgaaaaatccgagaaaatttcagagagttgatttaaacatggagaatttaataaaaattaaatccatccatgccttatatttaggaaattttatttcccacattttacttcacttgtaaattaaagaacatttaatataaattctattaataatttattaaataatttataaatcctgaaacaaaaatcaggatgtgacagcgacgtcttgacgatcacgacaatggctttcccgagcgacgacgacgaccggagcgacggcggtgcatggctggacgaacggcgtcgacggcggcgcaagagctcacggggctagggcgctacagacggcggcgggcgaaggcgagagtggctgtgggtagaggggagctcgggggtccttttatagtggctagggggcggcggcgaaggcccacggtgaccggcagcgcgaaggaaagtctagggttcggggagagagacgaatccgattcgagatcgaatccacggatttccaaacgattttagccgacgattccaaaatagaaaaggtagagtggatctcggggatcattttccctctatcaatttcaccggatcgggaaagggatgaacgaatttggaagggcggcggcggcgcgactcggctagggttcggccgggcgatggctggaggttgacgacggccctgacaggtgggccccacttgtcagcgggcggacgcgcgcgcgcgagcggcgctcggctgcaggctgaccgggccggggagagagagagagagctttttgggccgactttcagcccaaagccaaaagagaactttttaaacctttttcaatttaaattattcatgaaatgcaattccatttattaaaaatacttccttatctcaaataaatcccagaaaaatctaggaactatagatttaagcaaagtatttagtaaaattttatctggccccattttatattgaaatttattatttaaaattagatcttctcttttaggattttaagatcatttctaataattccttttagacaacaatttataatttaaggatttttaaacaagaaaagcacttaacataattataattagatcattaattgattaactaattactgaattgttctttgtatcaattaggaattgagctctgaaaaaatccgagaaaatttaagagagtatacttaatcatagagaatttaataaaaattaaattcatccatcctttatatttaggaaattttatttcccacatttaacttcacttgtaaattaatgaacatttaatataaattctattaataatttattagataatttataaatcctgaaacaaaaatcagactgtgacaggtattggctaactcaggattccaagtgtagtgtttgagagggagacgatcagacagagatagagatagagacggcgagaccgagatagaaacgacgagttgggtaaatccctatgaccgttctgtaccaatacgtgtcatccatggggacagacctccgcacgtcggagaggccatccgacaatagggttttgggattcaattgcagagaaatcttgggcctcatctaaatggatgaaatttggaaattccgaagatcgaacttagtcctttttttttttcaaaatcaggaaacaatgggtaaaatcatcagaggatctcatacaaatatcgacacacataatccattaacaggttcataacagtggtggacgcaggattttggtgacggggtacaaagttagtgaatcataatccaatgagaaaataaatgaagtgctaatatgtgttattagtgtgaataaaaatcatcactacacaaaattgtaaaatggctaagaaaaaaaaggaaaatactcttgaaaagggatgatttgcttaagagcaactgttttaacattgctgatcgtgcacacacaaactatacatgttaaatcacatttgtgtagatgtgaaaacacgaggcctggaagatctgcttaacttcagtgcaggtccaaaaaatcttgcctttaggttcgtgagcgtgccagttgatttgatcctacaatcaacaagaaataaagacaaagaaaccgcggttaaatccataaacgatagccgatcggctagttgccgatgatatatcatttatctccaagccgatgtcatatgtgaattgatcggcaatcatgaataaaatgaaaaagaactaaatctactctatcggctgtagatattaacaatatgtagtccttatgtcgatatatacttaaatcaaatgattgggatatatcggtcgccacgccgagacagtataaatcactcagatcgaaatatatactaacaatgagactatatatgttcatagcatagccgatcagatagatccagtatgtatcggctaatactccgataccactctatattaagatattaaagcaagtaaaatatatcaaacagaagcgtaatatatctagatgtaacaagatcataacataaagggcagatctagcatatcaattaagtacatgaaatataaggctaaatcagataagatcgcctgaaactctgatactactataaccggcaaccaaaagcaggctagagattgagattctaagtacgacttataagatcaaactcaactgatgcagctataagtatgaaaagaaggacaatatctagaccatcaagccgctgattgtttcatagggtggtagatatcctatataatctaagtcaacgttggtatttaacctaatcggctgccttctagcaacagatgttagccgactggaggttagataacaatattgccaaagattatatagaatatacgataactcgacaaattacataaacaagattagagtatcataaagatggaagcactaatcccaggaacgcaagccgccataagaagttttacctctagttgaagatcgaaaccgatgcagctcaacccgaaagcaagagctcgtcgaaacaaaacgaaagtaaaagggtggcgatgcgccgagattgtattgaacgtgtgttgttgtattacatggggctcggggtctatttatacccgagattacaaaatatgtccatgtcggacacggcttttatctttaacaaactctaagatacctttgcgatagacttttgcccaaacatatctctatggaaattacataaaatatcctaattaatagatacaattgccttctcaggactcaatccgtgcatgacaatcctcatgaagcaaattaactcaacctgacaacgtgtactgcgtcacattgtcggactcggctcaatcggctaaccttgtccaactcggattttaccgatcccggtcacaactgattcggactttagccgatccttgctctgtttttggaacgatttccatgttgaattccgtttcagttttatctccacctccgatgttgaaattaccaaatttggtcgttaacatatgcccccccaagtccagaatatttggtaatgtttcggattttccatattcgtgtctccgagagtatcgctcattgccgtttttccgaccgttaccgcatcgctttaaatactaactgtcgtccccaagaaatttcacaccgttagctccgttttcaccgcttaagccaactttgtcttctctctctccggcgatccccttggcgcaccttacgaccccaaggcgatatcccctccgaccaaatcttccgcccgcggagatgtcgtcctccgccagtccgtccgtggcgccatcggccgaatacgtagaggtaagtatccatcggctagatcctctcttttcacaatagattggttcttccttgccttatcttattttcttcttctctgttcttgtttacatctgtagcacttgtccaatctggtcgtgatccttgtcacatgagcaccactattttcttggtccgatcggcaatcttgatcccactgagttcatcatcgccaaaaccaataggatcccttttagattggccaatccaaatctaggccactgaaagaataccctcaaatcttggccttctcttgagaaaacttctcctgagaaaagttgtgctgtgtggtataagccccgtatcggctagcaagcaggtccattgggatgaaccaggaatcggccaagcgcttgctcttactttggcaaattcggctaaggatgaacccctgatggcctctgccgcttatttttggtccaataccctcaatgcttttctgttaaaccaagggccgatgaccccaactctgatcgacatcactatgattaccggattagatgtaatttcatcggctaaccccatgagcttgaacaacaagaaccagtttgactttaggaccaaaagcatagggggctggtctggctatgtagcaacatacatgggcaagggatctgtcacccctcgagaacacactacctttctcatgatgtggctcgagaagtttctcttttatggatcgagctatggtccgactaccaactggcaattcttagccgaagcccttgaaactaagaggcaacttcctttgggcaaaatcctcctcgactatctgtatcagatgttgagtaatgcatcggccaagatagccaccggttcagtagtgggtgcgggtggaccatggtggttgttgcaaacatggctcaatctcattgttatgagagttgtgaattggccacccctgacagaagctgaattcccgaggctggaacccactactaatgatgatggggaagaggtcacccaccgccgatgcatatcatatggagaagctgcatcgacaccaaccgattctggagcaaagctatcggccgaactgctcaaagattagttctgcagtttctatgaaggcttccagagagatgcttgagtttggttcccttatgaggactcagtgaattttgatcacccggcagacttcaggtttgaggatatcaactctgaaaagtataaaaaatccacagaagtcttctcggctgccattagtccatgcattcttcctattggcatccaccaagggagaaatatacacgtgtcctatgagttctatcatccgatgagctcagctaggcaatttggaatgggacagatgccaattagcttattctttgccgataaaatccaatgcagaggggagatctcatccacactaatgatggatcggctgctcaatatcccaggaccctctctgggtagcattgataacatagagttggcaaggtttaggagcagaaactttgacagatggtggggtgaatggaagcaacatatattccattagccggcctctacgtacatgacagttctgtttcctgatgttgtccctcaggtacatctttactttgtcaattctgcttgaataattgtcagccgacttgaatcttgactaccttctctctttaccttgcagacaacataatctccccctcctcgcaagagtaacagtggaagggacatagaatatgctctaggacttttaccaaatggaggtggattagctcctccggtcctcgtctatcat

SEQ ID NO: 7132 - DNA, 1097 bp, Oryza sativa
  unsure (1)..(1097): unsure at all n locations
ctccccctcctcgcaagagtaacagtggaagggacatagaatatgctctaggacttttaccaaatggaggtggattagctcctccggtcctcgtgtatcatgcccccaggacctcaagtctgcttcaagagcagacgatagagccagccgatgtcggcaggaagagaaagaccaaggcaccggcagttgatccatcagctctggttcacaaaaagaaagcccagaagcataaacccaagctagccgacgacttgcctgccttagatccatccatcgagcaagctctggatgaagaagaaattgaggaagacgtcgatcaagcggcagccgaactgagcgatgaagaagaaaaaacaccattagcttcacccaagcaaactcctccaactcctgctgccccgactcacttctcaagggtaaaccactcaccttgactccctcttataatcattttattcatagccgatcactcataaatctcgttttggcagaaaaagaagactgctgtgaggaagaaatcgacagcaacaacacttaaaccagctccaccagtaagattttcttatacaaattctttctctaatctgatcatagctgatatttacttcacacttgtctttttgttgcctcctcctccttcaccacctgtgcagcaaatgtcaattgaccgtaccccatcggctacaggaagtcatcatgttgaagaagaggaacaaccagccgctcctgccatcctagaaagtctttcattgacataagatcttagatcggctgacactgtttgatatttaactatctttaaatttctcttttccagaccttagccgatctattctcctttgacatcaaagattactttgataaagaagtagaagaagaatccacaagcaaggctctagcccctctggatgaaaatgtcaagaaaacactcgaagatatatcccttcggctagagtcatcattagacaacttggtggccgactgcggttccatccgggcacggtttgctgaaatccaagccttaatcccggatgatctggcannnnnnnnnnnnnnnnnnnnnnnnnnnnnnnnnnnnnnnnnnnnnnnnnnnnnnn

SEQ ID NO: 7133 - DNA, 1646 bp, Oryza sativa
atagtgggtagtactcagtcttgctctctttcccccacaccagagctgaagatcttcctagtgggagctgtcttgtcgaagttggtttcgtcgttgctgtcaaggattgcctgtggaatggagttgccccgctgcagaagtcaagtttccaagtctagcttgttttatcttttccgctgcatttgtaatcttttatatttttgcaagacgtggatctgtatgtcaacaattgtcgtttgtgtaccctggctggtcctggacaggggtttaatacacattcagcttagaaattctggttcgtgaatttctgggcttgacaatcttccaagtgctgttgaagaacagagtctagattgagatcggctatcaaaaatgtggctgacatgaccaagtccctcaaagtcatctctggaaccgacgcccaagacatccaagccatcgaagaagtagatcaaattagacaacgggctgtgttggctatccagcgttacttgtctggataattggtcttgtaataggataacttatttttgtaatcggctaagaaactctgatacccccttttgtcactgaactgctgtgccgattaataaatcttaacttgttcaaaaattcgcaaaaatttgcaaccgttcgtatatatgtgcccccctaattttataatgatgaaggcattgaaaaaattataatttggactaaggaggacatagccatatcggccattgtacatcggtaaaacacaaccgattacggtatgaaaacgactaagggcgatataaacatatcggccatttgtacatcggcaaaacacaaccgattacagtatgaaaatgactaagggagatataaacatatcggccatctcaaggcgatgtaaatacatcggctatcatgcatcggcactatccagccgatcatgcattaacccaaacacttgggtaatatttcttcaagtatttgccattgagggctcgtccataaacatctcaatcaagtccttgcaacatataagcccctttggacacaaccttatggatttgaaacggtgtttcccaattcggtgaccacttgctgaatttgctatctcgagttcctatcggcaaaatcaatttccaaataagttcacctacagaaaacaccactttcttgttgtaatgtcgagcaatgtgttccttatccttagtaacttctgcaagggctctcaatcttgattgaaccaagtcctccctctcatcggccatgagattgtaatattcatcggctgtcaactcattttgtaagtctatcctccttgaaccgattcgcacttcccatggtaaaactgcctcatgttcataaacaagtttaaaaggaggaacttggatcgaaccgtgacaagccatccgataggaccacaatgctttggccaatctagtatgccattgccgaggataatcgaaaatctttctcttaatcaatttgatcaaactcttgttagacgcctcggcctgcccgttagcttgtgtataatatgatgaagaattcaaaaatgtgatacccatgctatcggcaaactgaacaaactcatcggacacaaagatcgagccttcatcggttgtaattgtttgaggaataccaaatcgataaataatatgctcttaaacaaa

SEQ ID NO: 7134 - DNA, 769 bp, Oryza sativa
  unsure (1)..(769): unsure at all n locations
aaaaattcatacctaattcatcttagctccgatttagttggttcaaagtctctaaatttttctaaaattgagatctacatgctaaaaatatccacatgtactgttcatgcttgtttatgtgctgttttggtgattttgctcttttctgcttagattccgtcgtttccgaagagtccgttttcgccgaagaagagtttgaagagttccaaggccagcaaggcaagtcacacagatcccaaacaatcctttgagcatgttgatcctatttaaagctattgtttcttttcaactattgcatttattttcgaatgtcattgggtggaatcaacctattctttgttatagcccttttgttcttgattactttattccttgataccttgggttattataatttgactagttgagctttatttatattggttcaactagatactagatataattgcttagccctgcttagaaacattagcacactattgggataattaatgactcactgttatttcatgatggcttaatgatagttcatgatggtcgattgtgattggttaattaattaatgtgccaactaaaacctgataatggtgggttgtgagcacatggttttgatggtcgtgctcatgataattaaggaccggttcacgagtttcggttgtgaaacattaaccgtgccaaccacaagccagcatgggcaacggctttatnnnnnnnnnnnnnnnnnnnnnnnnnnnnnnnnnnnnnnnnnnnnnnnnnnnnnnnnnnnnnn

SEQ ID NO: 7135 - DNA, 983 bp, Oryza sativa
tcttttggctttgggctgaaagtcggcccaaaatctctcttctctctcctcggcccagccggcccagtccgccgcagccgcgcgcgccctcgctgtcgctgacaggtggggcccacctgtcagtcgtcgtctaccttcggccgccgccgcccgaaaccctagtttcgcgccgccggcgtttcccttccaaatccggccggtcctttccttctccggccgaatcaatagaggggaaacattctccgggatctcctctaccttttctcctttggaatctttggctaaatcgctttggaaagagttggattcgagttcgtctcggatttgttcttcccgagctttccttcgccgttgccgtcgccgtgggccttcgccgccgcctccgagcccctttaaaaggacccccggtgtctcctctacccgtcgccactttcgccttcgcctctcgtcgtcggaaaagccctagcgccgtgtgccctagctttgccgtcgccgccgccgctccagccgtgcgccgccgtcgctccagccgtcgccgtcgctcgggaagaccgtcgtcgtggtcgccaagtcgtcgccgtcctcgtccgccccttcgccgtcgccggagatcgccggagcttcgtcgccgtcgtcaacccgaaggtttccgccgtttcctcctcgtcgccgtcgtcgtccgttgttcttccgccgccgttttggtcaccggtgtgttcgccgcgtcgtcctctacgtgctggtgccctccgtttgcgtcctcgcgccgccgttcgccggcgagcgtgcgccgcccgagccgtccgttccgccgagccgccaccgctgtcggtgacgtcaccgctgacgtcatcggggtcgtccccgtaccggtcttgaccgttcgatctcggccgtccgttttggattggatcgatctcggccgtccgttcgcgtgaaccgccgcccgtgcgcccggtccaccaaaaccctagccgctaacg

SEQ ID NO: 7136 - DNA, 940 bp, Oryza sativa
  unsure (1)..(940): unsure at all n locations
nnnnnnnnnnnnnnnnnnnnnnnnnnnnnnnnnnnnnnnnnnnnnnnnnnnnnnnnnnnnnnnnnntttcgccggtggttgttggccccggtatgccgtcatcggacgtgtcgcttagcatccagctcaggcacttcttactgaccaatggtggtcgtatggacaggttggtgttcatcatcaccttgatgatgtgcatatggtgcatcatattttttcgcggaccaccttttttttccttgcttagattacgggtttacatgttaatatttctggtatgcttgcagcgtgaaactgctagagatcgacagctctgttgcgtatggaaacaatgtgctggaatcgttctccgacgggagcctgacagaggagcttttcatagacgtgttcagctcgattctattcaaggatgacatgaagtacaggctagataattatggaaaaaggattttcattccgacttccatatcagtaacgtgaataacgccaatttctactgtattcctttttttcgtacggtgcagcaacatgattgtttttctgttcttttttttcgcgagatgtgactcttttggttcacaccaacacatggccacacttttttttttttgcagtttctcctgaacattgattttatcaaacaaaatggaaagatacaaattttccactgatgctttggccggaaacttgcgcgactacatccagcattggttagttattaatttttgcataaagactaatgccatgtctacttttttcccctgcatcgagcatcttttaaacccagcaatgctattgtaagtttcgtttctttacttccaaacactgaatggacagataatggttcctgtgctccaccactatcactggtctctagatgcaatcaacattgcacacaggctggttgacataatggatacaaacaactacactttgctcg

SEQ ID NO: 7137 - DNA, 693 bp, Oryza sativa
  unsure (1)..(693): unsure at all n locations
nnnnnnnnnnnnnnnnnnnnnnnnnnnnnnnnnnnnnnnnnnnnnnnnnnnnnnnatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcatataaacctatagtctagg

SEQ ID NO: 7138 - DNA, 4537 bp, Oryza sativa
ccggcggcccatccgaaaagaaaaaggaggaaaaagggagggaaaagaaaaagaaaaaggaaaaggattttccctggaattaaaaattgcactttagtgatttttaattggttaaaattatttctagagctctgaaaattccactaaaaatcctgttaatgaatttcgacatgtagaattcaagaaaaattccacatgtcaaatccgattattatttgcattgttttcttagggttttatcctgatttcctctgcattttcttggggtcatttgtaatttacaatttggcttgggaggaaaacttcggggtgtgacaaacctaccccccttaaacggaatctcggccccgagattcggaggagctggtgaagaggtacggatgggcggctttcaactcatcttccctttcccaggtcgcttcctcttccgaatgatgactccactgaactcggcaaaaccgggtgacctttgaatttctattgttatagaagggctgaattgaaccgaagtggagctattccctggggtatgaacccgcatcggtgtgctaagttcctctcttattaacccatgcatcccgacaaatttcttggagatgaaagaatgcgttgcaccagaatcaaaaagtactgttgcagggattgagttaacaggaaacgtacccagtacgacctctggtgctgcttgtgcctcctccgcagatgcgtggttgacacgagcctggataaaccttggtccggcacgcctgggcttcgggcatttgtcagcgaagtggccaagctcgccacagttgaagcaggaccctggttttgctcccgtctccttcttggcttgtgcgggctggcctgactgtgccggtgccatcggtgggcgtggagctgtaccgcggttgggctgacttccatggtgattctggctgccactggagccctggtggaagttgctggggttgaatgggcggtgttgacgaacaatcatggtggtaggtccaccctgctgcccgggagtgaagcgcggcctctggtgacttccctgatgtgccctgaactgcgcggccttcctcttcctatccatcttgttgcgttgatcccctggcggattgccttgtcaaccagcctctcaaagtcggcgtagtccccagatatcagttggttggtcagctcgtcatccagacccgccatgaacttctcctgcttctcggcgtcggtgcggacatcctctggtgcatatcgcgcgaggcgattgaactcatggaggtactctgtcacagtcctgctgccctgatggagcgcccggaattccctcttcttttgtgccacgaccccgtctggcacctgtgccttcctgaagctacggcagaactctgcccatgtgacttcagtacccggtgggcgggtggccatgtggttgtcccaccaagctgacgcaggaccctgaagctggtgtgtggcgaaagcgaccttctcctgatcattgcactgcaggagattcagcttcttctctatcgcatggagccagtcatttgcctccatagtgttggtggtgctggagaaggtgggtggcctgacacgtagaaactccggcaacttggactgagggggagggggaccaaactgctggtgctgctgttcggcgtgctgcatcatcctctggtgcatctgctggtgctgctgctgcatctgctgcatcatggctgccatcatctgagtctgatgtgccataacttgggcaagggtcggattctcgggaagtggtggcggaccattgccagaatcactgttggggtgcacaccatcagcgcgttcttcaccgttgctgccctcgcctgtcgtgcggttgccagtcctggtgtagaccatctggagggaaaagcagacgggggagaagaagaaaaacagatgctcaagaactaagctttattatataggaattaaaactgcaattgttctgatctgaattaaaacacttaaaaagagcaaacaaaaatccttattaagacagccatatcataggcacatgatatcgaccgtcgactgaccccaaacaagcaacctaaacacacaaactaacaagcagaaactagacaatcgataaactaatgggaaaacgagcctaatgctcggaacggctcctgcggccggtggagtcgaaagcgtcctcctgctcgtcacctggtccctctgaacgactcctggagcctgacagatcagtctcgccgctgccactgggagtagcggacaaccaacctccggtaccactggctggacctctggcggctgatgctggagcgaaggagagagtgaacgcgggagctggagctggaggaactgcgggaactgccggagctgcgggcggaactggaggtgctgcgggagctgctggtggaggtgggttcctgggcgcaagctggatgcgcacgggtgcagtcgtcctcttacggggcgtagtgcggatccggactcctcctggtgctggaagacccttcaactgagcattctccttcttcaggcgcgctatctcgtccttcagagcgacgatcctcatgagcttcccatcattcaaggccttggtcgccttgtgcaggtccgagtgcatctggtccaatcccctcatcacagcacacatgtgaccgaaggtggtgtcgttctcgccagctgtcggacggaaggagctgacgccatcaccatgggctcgacgggggtggtagcggtacgccgtgtcgtggaagatgtagtcgtggcgctcccgtagtctggccatcatcaagtaggctgcctcctgacaggcgtgatctgctgtgcctccagatgcctcgaccgccatgttagcgaggcaagtccccacgtaaccatggacctccaagcggacacggtgaggaagctcgccactgagcggcggaatcgtcgtgtactccggcgcgtcggggtagcccaccaccagggtcatgcgtgccaactctgccacgaaatcaatcatgccttctccgcggtggttgggtgggtgaccggccatctagagaagacaaaggagtaggatcaatgcatgctcaaatccaaatttaaataaagcaataaagactcaaataaaggaatcaaataagagcaaaattttatgcatagatcattttacatgagcgcgaataaataagacagactcacataacgataaaataatgggaaattagatacataataataataacgaacaaagcataaacaccttgcaacccatgttaccgagctaggacctaatgcatttcacccctcaaaccccaactgactgacgaataaatcccaataattttactaaaaccctagactgactcgttttgaaaaactcactttaaacgagcgaccaagatttttcccttgaaccacaagaacagatccccattttcccggaacaaaatccaattgcaaagaacatatgcaatgaaaaggattcagagggctcttaggtctttccatttggcttgtcctacggtcaaggtcggctctgataccaacttgtcacgcccagaaattcccgaatagaattccaagcagaatgtgtattaaaacccccgtccaggaccagccggggtacacaaacgacaatgttgacatacagatccacgtcttacaaacattataaaggtcttacagaaatgcagcggaaaacaaaagataactggagctaatccttgacttgaactgcagcgggaacaccactccacaggcatcctcgacggcacggacgaagcctactcctcggagaacctgccatcggacacatactcgagctctgaggttggggggaaaagtagagcaagactgagtactacccactgtactcagcaagtcataccggaatagaggtatgatgcagggatttaacaagggatagctaagcaggttcatttgcataaatactggcatttataaacaggaattgaatgcgaaaacagttgtaataattaagcagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagcccgtgcccacgctggcttgtggaagtacgataaattcttcagggcaatccgcgaaccggccttaactgccatgggtgcgactagaaaaccatgcacccacaagccaccatgtggt

SEQ ID NO: 7139 - DNA, 1095 bp, Oryza sativa
  unsure (1)..(1095): unsure at all n locations
nnnnnnnnnnnnnnnnnnnnnnnnnnnnnnnnnnnnnnnnnnnnnnnnnnnnnnnnnnnnnnnnnaagacgagccgaacgagccttcaatcgacctccaatgcttggaagaactagagtgacttgttaagtcgttgtcttagatcgttgtgttagtttgtttgctttaagtttgcttgtgtgtggctcgcatgtgatttacatcagtggtgggatgtaattgcatgtgtttgtttgcttttgagtgttaggaagttggtgagtttagtggtgtgagagtcttcagtttgtaataatgaaactcagttaagatcaataaaagttaaagtaattctctatcctaagtagttccccggtttctcttcttgtgccctgttcctgccagatggtgaacactcgcagcaatgggaatggccccaacaaccccaataacaataacaatggagagaacccaactctggcccaagttcttgctcaacagacacaactcatgaacatgatgatgcagcaatttcagaatcagcagaaccaaggaaataactatgcacctcctcagaataagttagcagaatttcttcgtgtgaggccgcctattttctctagtaccactaatcctgttgaagctggtgattggctgcatgccatagagaagaagttggatttacttcagtgcactgatcaggagaaggtatcttttgcatcacatcagttgcatggctctgcctctgaatggtgggatcacttccgcctgaataggactactgctgaacctatcacttggcttgaattcactgctgctttccggaagacgcatataccatcaggagtagtgtctctcaagaagaaggagttcaggtcgcttactcagggatctcgctctgttacggagtatctgcacgagttcaatcgtcttgctcgttatgctccggaagatgtgcgtaatgatgaagagcgtcaggagaagtttttgggaggacttaatgatgagctttcttacccactcatggttggagattatcctgatttccagaaattagtggataaggctatacgttaggaggacaagtacaattgcatggagcagaggaaacgtcgg

SEQ ID NO: 7140 - DNA, 779 bp, Oryza sativa
  unsure (1)..(779): unsure at all n locations
cccaccaagctgacccaggaccctaaaggtgggtgtgtggcgaaagcgaccttctcctgatcattgcactgcaggagattcagcttcttctctatcgcatggagccagtcatttgcctccatagtgttggtggtgctggagaaggtgggtggcctgacacgtagaaactccggcaacttggactgagggggagggggaccaaactgctggtgctgctgttcggcgtgctgcatcatcctctggtgcatctgctggtgctgctgctgcatctgctgcatcatggctgccatcatctgagtctgatgtgccataacttgggcaagggtcggattctcgggaagtggtggcggaccattgccagaatcactgttggggtgcacaccatcagcgcgttcttcaccgttgctgccctcgcctgtcgtgcggttgccagtcctggtgtagaccatctggagggaaaagcagacgggggagaagaagaaaaacagatgctcaagaactaagctttattatataggaattaaaactgcaattgttctgatctgaattaaaacacttaaaaagagcaaacaaaaatccttattaagacagccatatcataggcacatgatatcgaccgtcgactgaccccaaacaagcaacctaaacacacaaactaacaagcagaaactagacaatcgataaactaatgggaaaacgagcctaatgctcggaacggcttctgcggccggtggagtcgaaagcgtnctcctgctcgtacctggtccctctgaacgact

SEQ ID NO: 7141 - DNA, 20232 bp, Oryza sativa
ccgtgcatttggtccaagaaatcccactcttgtatcaatgatatgggaaaggaaagacttcaagagactcaccccaagggacattcttggaagaattgtgtctcatgagatgcaagaagaggaagctcgtgaagtgagacaaatagtgaagaatgccgctatgatcaaaaatcaagaagttgctttgaagggaaaacaagaagaagagtcaagttgtgaagaaagtaaagatgaagagatggcttttattgtcaagagattcaagtactttcttcgcaagagtggctatggcaaagggaggaaggatgatgataagggaaagaggcaatcaaagagagcatgcttcaattgtggcgaatatggccacttcattgccgattgtcccaagtcaaatgaagctaaggctaagggaggcaagaagaagccgaagcgtgctcatgtggcggaggcacacatggcggaagtgtggtactccggagatgaagaagatcccgatcacgaggtcaagctcaagcccaagtcaaaagacaaggttgaaggagaaggtggtgttgctaccgtcgccttcaagtcatcctcttcaagcaaggagcatcttttcaacaacttaagtgatgacgacgacgactcctaccactactcttgcttcatggcccaaggccgcaaggtgatgactcaaaagccctctcaaacttctcttgatgttgattccagtgatgaggaaagtgataatgaattagatgatgtacttaagagctttagcaaacccgctatgcaacatttggctaagtgaatgagagctttagatagtaaagaacaatcactcgaaaggtaagaagaattgcttattcttgagaagaaaagaaaccttgccttacaggagagcttaactaaagaatgtgctaaaaatgaacaacttgctaatgagcttaatttggctaatggttctttagctagccttagggatgtcaatgaaattcttcaagaaaaatttgttaatttagacaaaagtcataaagatcttgaagttcaatttgacactctttggaatagcacctctcaaccaaatgtggtttctaattcttctaaccctactactagcaatggttgtgctaggtgttacaatattgatttgaactcttatgctactaatattgatgctatgcaagctcttaagaaagagaatgaaaggttgagcacattggtgaaatatggatgcatgaagacataccattcaaaagatgccctttacaagaccatcaccgctcatcctaacaagaatggacacggctcgggttttcgggtggaagtcatgtgtctaagcgtgtgatggtaaatgggaaagaatgcttgatgtttgtgagagaaggtacgtaaagcaccacaagcaagtgaggtgactagtcttgtgagctgccagggacccggaacatccggacaaaccgggagaaacttccgggtgggagtctctgtctctcaaaaattcccaccaggaagttccgggccaatggccgtgcacacgatatgaccggaagttccggtcacaatgccaggaggttccggccagagggtttttactatgattcatatgtaatttccaaaaattcagagggcaaagtggttgcctattttaatgggaattacaatgatgagtaccgcacttgtgtgtgggtgacaaaggctttggtaactaacatcaagggacccaaacttagacaagtttgggttcctaaatcccaagcttgatttcttttgtaggcatactcctccggtggttcaagttaggttgtggacagtggttgcaccaatcatatgactggagagaggagtatgtttacaagtcttgatgagaagaacggaactcgtgagaatatcatgtttggagatgatggtaaaggaaccgtaattggtctaggtaaaattgccatctccaataatcaatctctctctaatgttcttcttgtcaattcattaagatacaatttattatccgtttctcaattgtgtaagttgggttacaattgcttgtttaccgatgaggatgtgaccgtctttagaagggatgactccgttgtattcaaaggcaagttgaagggtgatctctatcttgtcgatttcgatgtggatagagtgaatccggaagcttgtttgattgttaaatcctccatgggttggctatggcatcgtagactagcccatgttggaatacggaatttggcaactcttctaaagggggaacacatcctcgggctcactaatgtcacatttgataaagatcgtgtgtgtagtgcttgccaagccaggaaacaagttgggaatccacatcctatcaagaacatcatgactacaacacgccctcttgagcttctacatatggatttattcgggtccatggcctacataagtattggaggtaacaagtatggttttgtcattgttgatgatttttcccgcttcacttgggtgtattttctccatgacaagagtgaggctcaaaatgtcttcaagcgcttcaccaagcaagcccaaaacctctatgatctcaccatcaagaaggtgcgaagtgacaatggagaattcaagaacactcaagtggaggaattccttgatgaagagggaatcaagcacgagttctccaccccctatgatcctcctcaaaatggcattgttgagaggaagaaccgaactcttattgaagccgcaagagcaatgcttgatgagtacaagacttcggatatcttttgggcggaggctgtgagcaccgcatgccatgccatcaatctcctctacctccataagatcctaaagaaaacttcatatgagctcttgagcggtaagaaacctaatgtttcatatttttgtgtctttcggagcaaatgctttattccgagtaagaggcctcgctcatctaagttctcacctaaggtggatgagggattcttacttggctatgaatcaaatgcacatacctatcgtatcttcaacaaaacatccggtattgttgaagtcactagggatgttacatttgatgaatctaatggctcctaaggagagcaagttgttgtacatgttgtaggtgatgtggatccaagtcaagctataggtactaaggctattggagatatacgactagtcgagacgcaggatgaccaagaagatagggatcaacctccgtcatcgacatccaatagccctacaagtgctgtgtctgctgagccggaagttccaggtcctattgaccggaacctccggacatctccaggcccagaagttccgggttctacagtccggaacctccggaccagcggtagtgaagacgtgccaacggcgcaagtggatgggatcgatgttccgggcactttagagcatactgatcaggctcaggtccccccagtgcaccatccaaggatacatcacattgtccaaagagatcatcccgtcgacaacatacttggtaacataagaaaaggggtaactactcactctcgtgtcgcaagtttttgtcaacacttctcatttgtctcttctttggaaccaaccagggtggaagatgcgcttggtgatccggattgggtgatggctatgcaagaggagttaaataacttcactcgcaaccaagtatggtctttggtggagagacccaagcaaaatgtcatcggtaccaagtggatcttccgaaacaagcaagatgaacatggagtggttgtaaggaacaaagcccggttagttgcgcaagggttcacccaaatcgagggtctcgattttggtgaaaccttcgcacccgttgctcgccttgagtcaatccaaatgcttttagcctatgccgctcaccatgatttcaggttatatcaaatggatgtcaagagtgcctttctcaatggacccatctcagaattggtctatgtggagcaaccaccggggttcgaggatccaaagttgccaaaccatgtgtacaagctccacaagacgctctacgggctcaaacaagcccctagagcttggtatgaatgtctccgagatttccttttgaaaaatggttttgaaattaggaaggcggacactactctcttcactaaaaagcttgaaaatgatttattcaattgccaaatttttatcgatgacataatatttggttctactaatgcctctttttgtgaagaatttagtagtatcatgactaaaagtttcaagatgtctatgatgggcgagttgaccttcttcctcgggctacaagtgaaacaagcacaagagggcaccttcatctctcaaaccaagtacgtgaaagacatactcaagaagtttgggatggaggatgccaaacctatcaagacacccatgcctaccaatggccacctagacctcgacgataatggtaaatgtgtggaccaaaaggtatatcgctccatgataggatccttgctttacttatgtgcatctcgtcccgatatcatgcttagtgtttgcatgtgtgctcgctttcaagcggagcctaaagagtgccatttgattgccgtcaagagaattctaagatatttagttcatactcctaaccttggcttgtgatatcctaagggttgtgactttgagcttttgggctattccgattcggattatgccgggtgtaaggttgatagaaaaagcacaactgggacttgccaatttcttgggcagttccttgtttcttggtcctccaagaagcaaaattccattgcattatccaccgccgaagccgaatatgtcgccgccggttcttgttgtgcccaactcctttggatgaaacaaactctaaaagactttggctacaacttcaccaagatcccactcctatgtgacaatgagagtgccatcaaaatagccaataatcccgttcaacagtcacgaaccaaacaaatagatattcgctaccactttttgagagatcatgagaccaaaggagacatatgccttacccatgtgagaaccgagaaccaattagacgacatattcaccaagcctttagatgagaaaagattttgcgagcttaggagtgagctcaatatcttagattctcgcaacattaggtgatgggtggttggctaatttatagccaaacatgtatcactaaaatgtaaataaaaaaattgagtttttgtgtcctgtgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataaataaacggcgcagacggctccactccacaggcatcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttcagaatttaataaaacagttaggtattaattaagcaatattaatccaacgctatacaacataccctgttgtataggcccaaccattctgaacaaccaccccggctgcacagttctatctccaaaccaggaatataccattccaaaccaggagctaatcaaattattactagtttaagcatcttttattatgatgagaggtgtgagactaatcacgaaagacattgttcgacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcgcataacacaatccactgcagcgcaccttcctggatcataatcacccccttataaacaaggcatggactccccagcgacccccgtgggcttatctgtcacgcccagaaattcccgaatagaattccaagcagaatgtgtattaaaacccccgtccaggaccagccagggtacacaaacgacaatgttgacatacagatccacgtcttacaaacattataaaggtcttacagaaatgcagcggaaaacaaaagataactggagctaatccttgacttgaactgcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaatagaggtatgatgcagggatttaacaagggatagctaagcaggttcatttgcataaatactggcatttataaacaggaattgaatgcgaaaacagttgtaataattaagcagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcatataaacctatagtctaggttttaaatgagatccccaatgtgtgctagttgaactaagcatggctaagcaattcctagtccaaagtctaatcatgttataacccaagctaacaaaggagcatgatatccaaaagcatggctgtaacaataggtatccatcccatagtgatattataaaacaatgcaatatttgaaagaaaacaatagagcatttgcaatataggatcaacatgttcaagtgacaagcatgacttgccttgctccgctgctggagggacctcggcgactatctcgaagtacaccggagcgtcggagggatcggaatctagcgacataccaagcaaacattgcaaacaggctataagactactgaaacagagaacaaaaccatttttaatggattctacacatttttcttgatttactgagacttgaatgggattaaacggagctcggatgaattagttatgaattttagaagattcactgtgtttattactataaaagaaatccttaaataatttattgcgcaatattaaccagggctgacgtcagcgagggggcgcggcgccgacaggcggggcccaccggtcagcgaccgggagagagagaaagggggtggcggcgcgcgggcccacgggtcagcggcacgggggaaaggaggggcggcggcgccacgtggcggccgaaccgacggccccgatctacccaagggtagatcggacggcggcgggacctcgcggccggggcgcgcgggcgcggcgcgagacggcggcaaccatggcgccggcggcgcggcgctcacacgggggcggcgcgcatgcggcagcggcgcaaggcggcgaccgaaggcgaccgaccggcggcggggagcggcggctagaggaggagcggcggctacgcggctaagcggcgcgcacgcggctacccggtacggggaaaaggagaaagaggagggggaagcctcaccggacaacggtcgacgacggcggccgacggaggacgacgacgacggcgggacgagctccggaacctcctaacgaacaaaaggagagggattagagagagaggaaagagcgtgggagggcgagagcgccggccgaaggcggcggccatggtgccacttgccggcacacgacggggatgggtctccggcggcgaacctcgacggggaaggggcggccgaggtagatctcgaccccgcgaagctaacggcggcgacggcgcgagacggcgacgagcctagcggcggctagcggcggacggagtagcaaaaacggcggcggcgggtggttgcacggcgcggaggcgatggggagctcgggagagatcggcgaaatggggaaaaagcgagagaggaggacggcgatgcttaaaaagggggagagggagccggacgtggccgggagcggcgggattcgacggccgacgtgggggagtggggaggagagagaggcgggattcggttttcgaatcccggccatctcgggcgcgggcgcgaacgggagggagaggggaaagggcgcgggagacgcggcgcacgcgcgggcgtggccgacgtggcccgggagagacggaggcgtgggcgcggcggcggttttggcgcggcggcgcggcgggatcggcgggaggtgggggaaggacccgacaggtgggccccacctgtcggcgaccccgagagaggaggcgggcggcggctgccaggctgggccctcggcctgcggccggcccagcaaggaggagggggaggaaggaggggaatgggccggcggcccatccgaaaagaaaaaggaggaaaaagggagggaaaagaaaaagaaaaaggaaaaggattttccctggaattaaaaattgcactttagtgatttttaattggttaaaattatttctagagctctgaaaattccactaaaaatcctgttaatgaatttcgacatgtagaattcaagaaaaattccacatgtcaaatccgattattatttgcattgttttcttagggttttatcctgatttcctctgcattttcttggggtcatttgtaatttacaatttggcttgggaggaaaacttcggggtgtgacattatctccgccacttctcagtctggtgccccgcaatgaaccatgctatacaaaagataaagccgttgcccatgctggcttgtggttggcacgattaatgtttcacaatcgaaactcgtgaaccggtccttaattgtcatgagcacgaccatcaaaaccatgtgctcacaacccaccattatcaggttttagttggcacattaattaattaactaatcacgattgaccatcgtgaactatcattaagccatcattaaataatagtgagtcataagttatcccaatagtgagctaatgtttctaagcagggctaagcaattatatctaatatctagttgaaccaatataaataaagctcaactagtcaaattataacccaaggtatcaaggaataaagtaatcaagaacaaaagggctataacaaacaataggttaattccacccaatgacattcgaaaataaatgcaatagttgaaaagaagcaatagctttaagtaggatcaacatgctcaaaggattgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaaccggattaaaacacttaaatcggttaaaattgaattatgacgcaataatgaattatttttgaaaaggaaaagaggatttattgcgtcagcgggctagggtttcggtggaccggacgcacggcggcggttcacgcgaacggacggccgagatctaaccgatccaagatggacggccgagatcgatcgggtccacggcggctcacggcggacgaccccgatggcgtcagcgatgacgtcaccccggcggcggcggctcggcggcggtcttcccgagcgacggcggcgtctggaacggcggcgaagcacagctggagcggcggcggcgacagcgaagctagggcttgcggcgctagagcgattccgacgacgagaggcgaaggcgagggtggcggcgggtagaggagagctcggggaggcttttaaaggggctcggaggtgaaggcgaaggcccacggcggccggcgacgaggaaggaaggttcggcaaaaacgaatctgagacgaactcgaatccctcgatttccaaaccgatttagccgaagattccaaaggagaaaaggtagaggagatcacgaggatcatttcccctctatcaattcggccggagaaggaaaggaacggccggatttggaaaggaaacggcggcggcgcgaaactagggtttcaggcggcggcggccgaaggtagacgacgactgacaggtgggccccacctgtcagcgagcgagggcgcgcgcgcgggcggcggactgggccggcttgggccgaggagagagaagagaggttttgggccgactttcggcccaaagccaaaagaagactttttaaaacctttttcaattaaaattatttcttaaatgcaattccatttattaaaaatactttcttagctcaaataaatcccagaaaaatctaggaattatagaattaagcaaagtatttaatgaaattttatcttggcccattttatattggaatttattaattaaaattagatcttctcttcaagacttttaaaataaattctagaaattccaattaaacaacaatttatatattttaaattttcagggtgtgacatcctgagatcacttcttggtagaagatggtcttgataccaggaataaagctcaaacattcaccctatatccaaaaaccccttttgtgaaaatttttgcaaattccttgctgtgccttttattgcgaaaatttggcttttatccccttcttgtggtgtatattgaccatggttatgtaatgttgattgtaggctggtcatatacgtcataagtctctgcatgtccatagttccctatttccccgcgttgaattctcatctcttccttgtttttggtcctgactgccctttatctgtcaggccggaagttccgggcctccttgtccggaacctcggggtatcggggagtatatatactcagggggagttagaagccccattctctctcctcatttcttctctctccccgacgccaaccctagccgccgctatagtgctcctagtggcgattttcactttcgtccaatcaaattcgtttcttctccgtggattcatccacattggtggctgggaggttctttctgtgatcgattcgcagtttcttctctcaaggtagaacttttggattccctctctcggttcattgtgtttttatcccgatctctaaatctgtgaaccttgggagaaaaccacttggatagtcttgtttctgctaccttgttgatcactgatctataggatttgttcacatgcactggctatttttgaaacctctgttcttcatttttgccggccggaagttccggtgttcttgcacccggaacctccgggcgctgtccattcagcctgccattcttgtttctctcaaattttgcctaactactgcactccaatttgttgattcctgttgcagtaagtactatgactcgtgagaaaagacagaaagcctctcaggatgtgtccggtgatgagagtcctcctattcggtatcctcgtggtcgtttgggtaaagagaaagtggttgagggcggcagtggcagtggcactcgtacttctcccagatttacaaggcaatccagcaaccgtcctgttcagattagggatgttgatagtggtcaaggaagtgatgcccctaatacaagaggtcacgggagaggtggtggtcgcagttctggggctggaagggcatctcatgatttccctgtaggatctcgtgagaatcccgttcggctctacaagactcttggttttgacaccactcctatgcaccacattggaagacccaagtccaactaccttcatcaacttgccaagtgtagacgagatcgtttgattgatccagagtcacagcctgaggagtgtcacgccctaaaaatcgtctaaattaataatgcgtattttaaatcatttttagaaattattttaaaagcctacaagttaaactctaataatcaaggaaaattatcaacataaaattgagctagataaaatttcattaaatactttgcttgtttatctattttctagatttttctgggaattatttgagcaagggaagtatttttaataaatgaaacatcatttcacaaattatttttattgaaaaagtcttaaaaatcctcccctaagtcgttgggccgattcgggcccaactcttctctccccgcgcaaggccaagccggcccaagcggcccaagcagccgccggccccctctcctcctcacagccgccgacatgtggggcccacatgtcggggttgtcttcaacctccggccagccagcccaagcccgagccgccgccatcccccgccgattccgccgccctcggtcgcgatcgagtccgattgtttgaggggttttggtccccttgttgtcctctatctatcccccaaaaatcggggctaatcgcttcgtatcttacccgaatcaaactcgttttcgagtttatccccaaaacctaaacctagtttttctcggtccgattactcgcggttggagtctgatctctccaatataaggctataaatagcaccccctagtcgccctctttcgtttgccccatctcccgagctctctcgtgccccgtagcgccgccaccgcgccaaccaagccgccgccgccgccggccgacgtccagccgcgccgcgccgtcgttttagccgtcgccgccacctcctctcaccgccgtcgggtgcgcatggaagaggggaagctcggccgccccttagccatcgccgccggccgccgtagcgccgtcgccgccgctgtccgagccgagccgccgtcgagcctcgccgccggtcgccgttcgacgtcgtccgtcgtgttcgttggtaccggtgagttcgcaatgttgtcctctacgcgtagatgccctctaatagcccggccgagcctcctagcgccggtggttgtgccgcccgagccatggccggcgacgatgacgtgatgacgttataaacctttttttaagttttctttattagatgcaaatcgattaaaacttcggaaattcataactaattcgtcgtagctccgattcgagtggttcaagttgctaaattttttctaaaattgagatctacatgttaaaaatatccacatgtactgtttatgcttgtttttgtactgttttgttgattttatttttttgctctagtttcaaacgttcccgaggagagcgtttcagttgaggaaggttcggaggtgtttgtggaagctcaaggcaagtcacacagatcccaaataaccctttgagcatgttgaacccgtttaaagctaatgttttatttcaacttatgcattattttcgaatgtcattgggtggtgaaccttttcccaattaattaatggccgaagataactttattttcctatgggttataatttgattagcttggaccttatatattggattggttcaactagatgctatatgtatatttgattagccatgcttagaaatatcagctcattaagggatgaattatatatatcacattattaattatggatatatttaatggtagctcacgatggttaatcgtgttatgttaattaattaataactaaaacctgattaaaggtgggttgtgagcatatggttttgatggttgtgctcatgacaattaaggactggttcacgagctactgttgtgaaacatttaccgtgccaaccacaagccaacatgggcaacggctttatcttttgtatggcatgattcgttatggtgtgccagactgtgaagcggcgagaagtccgtgggggtcgctggggagtccattgcctctggtttagagggggagattatgatccaggagtggtgcactgtggtgagttgtgttgtgtgaggggtattgtcacagttcctttccgaggtaccgtggtggtgctgaggcgcatggtgacatgttgtgggattgtatcttgtgggtacagtggtacacctctaatcagagtaaaactattcgaatagccgtgcccgcggttatgggtgagttgagcaatgtttttcgtgattaatcccacactattcattaatggtacttgtgataattaatttgactcctggtttggaatggtatattcctggtatggagtttggatttgtacaaccggggttggttgttcagatgaggttgggcccatgcaacacggaagtgttgtatggtgtttatttaatactgcttaataattcaactggtttactattctcataaatatttattaaatgctgtttatgcaaatgagctttattatgccgtcctttgttatcctatgcacttgcatatttgctgtgtggcttgttgagtatgtcatatgctcattcttgcaatattcattcatcagaggaggagtacttcagtgaaggtgatctggaggactaggcttggtccgggttaagttgcctgtggagtggagtctccatagttgttccgtagtttgcttttattttttttccgctgcgtagaatgttattctttgagaggaactatccacctctgtaataatttattatttgcgaatattaaatagctgtttatttgtactctattatcgatttgttattgtgtgcctcggctgattcctggacgagggtttaacacacatgtaagcgtttgaaattttgggtagaaattccgggcgtgacaaggagtcacaggatcctcgcttcaggactttcactcaattggattggtataactcagtgattatggctagagagaatccagtggttgagatgaagtgtattgattgggcttacatgaggaagaaaaacaatgaagtgttcaaccaagtgatgcaagtgtgccacaatgtcacgtcctgataaattcatcccaaaataaaaatcattccctaaaaggaataatagaattaattaaaattcgaaaagaaattggcaaacactaaaatacgtacaagaaaaattcgaatgtggcccggagaatttttgttaaattctccttggtctaaaaagagccctcaaattttacttgaattttcagagcaccggaaataattattaagcaacaaaaataattattagagtttattaaaaagaaaaacctaaaaataaccctccccttccctttgggccaagtgtggcccaaggtttctcccctctccctctcggcccgcggccgaagtccctctctcctccctctctttctctccctctccttctctccctccttctcttgggcctcctccttccccggcccactccctcctcctccctctctcccccgggcccccctcccctcctctcctcctgggccggccgcccggcccacgccgcgcccctgcccgagccgccctcctcccgcgtgcgcacgcgcctgtcacgcacgcgcccacgcgcgttgaccgcgcctggcaggcgggtcccgcctgtcggacccgtcttcctcccccagccggcctcgtctctctctccccggaaacctagcgccgttcctcccctaaatccacgcgaatcaatgcccttctttccaaattgattggggggaattaatccccattccttcctcttcaattccccccaatttcccccttgaatggcgcccccaatcgtcgggaacggacgcgtctttcccggccgctttccatggccgccggccgccattcccgcctccgttccgaccttccccgtggccggctccctctcctctcctataaaatggaaccccctcactccgttctctcgttttagccccctcccgcgatctcccgtggcctcaccacccctccctgccgtcgcccttctctttcccccacgccgggcgcctccagccgcctctccctcctcgaccgtgcgccggccggccgtgccgtcgccttccccggcgtcgcagccgcctcctctcccccggcctgccctccgtttcgcgcggtgaccgccggaggcgcgttcccgccgtcgtccagtggcgttgccgccactgtaccacctccagccgcccctgccgcgccgctcaggtgcgggccggccgcgccgtctcctccctcggcgtcgccgcgtcgacctccaccccggcctgccctctgattcgtccggagaccaccgtcgtgccgcgccggcctctccatcctcctcgccggaatttccccggtcgaccgcgtcgccgtcttctccggcatcgcagcggcaaggtcgtcctcggcatcgcttcccctccatccaaacccctccgcggtccatcatcgtcgcctccgttcgttctcgtcgtcgacgtcccgtcggtcgcccggctcgtcgtctcgtggcgccacctccgtcgtcggcatcgctgcggcgtgttccacgccgtcctcgcatctgtgcagctgctgccggctgccctcgtcgcctcctcgccggccccggtcatcgtcgtcgtcgtcctcctcttgttgtcctcatcgtcgtggcgttcgtccttccgtcaagccgttcgcgttcaccgcccgcgtttcgtcaagtgtgcagcatccccgtcgtcgtcttcgtcctcggctccgcgtcgtcaagccttgtgccggccgcgtctcgccttcgtccaaggatcaccgccgaagtcgttccctcgccgttcgcctccatcgtccccgagctgtctccgccgcgcccgttcgtcgttgtcgttcccatgcctcgtcgcgtggtggtaaggatccctctccctcgctgccccgtcctcgtcctttcggtgccgcccatgcccgttgtgcggttgtcggccccggtacccgtgtatcggtgtcggcagtcgttcgcttgtgcgtgtggtgaccgtgttagtgtgtccgctcggtagccgcgtggtttccacgtgtgcagcccgtgtggtgtctagtggagttcgtttgtcggccactcgcctcggttgacacacgggatctgcttctgtcgacccgtggaccgtctctgtgtacccggtctaccacggtcctttaggttgacatgtggggtctgcatgtcaacagcgcagccttcctgtcttttccagactagcgcttacacatgttttatagttgcaaagcctaattacaataatccgtaaatctccatgtaacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttcttgaagcgtggttcgcggtcgtcaccgaaggttcagcaggccgttctctgtgagcaaggcaagtcacatcatccttgagcatattgaatcccagtctataaaattattttgatttaaattaatgcattatcgctttatttaaattcccgcgttatcactgttttatttagccatgcctatttacctttgttatgaccttattattgttattgatattattaccttgttcaccctagaataaacaaaaccccaactagtgggcactctattcatggttccactagtatgaatttaggtaggtgcttcgctgattaattaggcaacattaggtggtttttataactctagactttgggaatattcatatcacttggacatattggaatggtcggattattgtggaattggatgcacacctccccctctattcaaaaccctcaaaatggttttaggctgggctcggggtgcatggttttgttagtagcacctcggccacataaggaccagtcttcgggcctctgttgcaaagcactaccgtacttccacatgtctagtgggtaaggcttagtttgtggctcagtctggttataaacaaaagtacacggatggagatggacgaagtgggggcttgatggacatctctaggacaaatgaaggctacacgggctgcggcccggtagtcgagatgtcatggcacagggctggtgtcctgctgctaggggctcaattctgcctgcctgtccgggggttccggccgtaggtgggttgggtcggtactcttgtctatggctaggatgggttggaaactatgtcatgtcttctgtccatatgccgtggtggtatgtggcacgtggttgcacgtgaggaagacgtgtcttgtgggtaaagatgtacacctctgatcagagtaaaacctattcgaatagccgagccctcggttatgggcaagcctagcaatgtacccaagttagtgttttaaattcttaaaacctgcttaataactaaaatgtggaatggttggcctgggttggcttggaacgagctgggacccagggtcgggttgccagttcggtctgaatcatcgtaggccttgggttaaggcaggttcgtgtgggtccacggccttgcttaataatattgtatagctctaggatcgtgtttacaaaatagctttgggcaactaagtgacttttaaatgctgtttactgcaaaacttaacccctatatcattatccccttgtacccctttgcattaattatgcatctccggtgtggcttgctgagtactgtggttgtactcattcttgctctatctttccccccttcagtaagagaagctttggagaagaagtcttaggtggagtcctggcttataccccagttgagcgcctgtgaagatggagccgtaggcccgctagtccgctgctgtttatttttgtttctcaggcctaaagtgtctttgtaataatgtaaatattatcgatataataaatatgtgccttttgtatcatgtttgtatggtgtacctggcttttcctgggatggggattaatacactagcgttcgggaaaaggtaattttctcggtcgcgacagtagttttactataatataaatagaaatgcatggttttgcagagaaatcagatgtacttgacttctgcaagctgggatgtacttcttcagtgtgcagcaagataaacacttgtaagctggaaaaacatgaaactgaatcaccattagttttcaacgaaaaaggccaatgcgtacgatcattttccttttcatttcagttgctgccaatgaaggagtgaatgctgccgtggagcgttgcgagcatgcatgcgatcgcttctgcacaaatgaagctcagactgtcaccgttgtgtcctaatcaaacgcaacatgcaaccagaaagggtttcacacacatcgaagcccatacgaggctatgaacctggagtagtcataaataagttggatatcctgatatccaagccagtgtgctatcaacttctcttgttttgtgtctctttgtatttccaataagccatgataattgcaatatgttgtcttgtcctgaggacatgagcatacgataagcgatgatatcattggcaaataaataaactttctcatttgttttacgccaatgcctcatgagttaagacctgtttagttcccacgcaaaaacttttcaccctgtcacatcaaatgtttagacacatgcatacatggagtattaaatatagacaaaaaaaactaattacacagattgcgtgtaaattgcgagacgaatcttttgagcctaattgcgccatgatttgacaatgtggtgctaaagtaaacatttgaccatggttagatccatatattcttacacttgtgtttttttttttttgcttttcttttaccttaattgtgatggatctatgtattttaaattgtcagtgtagagattatggtaccatatacgtagatggatgggctatccgactgattataggggcctcg

SEQ ID NO: 7142 - DNA, 12313 bp, Oryza sativa
  unsure (1)..(12313): unsure at all n locations
nnnnnnnnnnnnnnnnnnnnnnnnnnnnnnnnnnnnnnnnnnnnnnnnnnnnnnnnnnnnnnnnagcgcttacacatgttttatagttgcaaagcctaattataataatccgcaaatctccatataacaacattaaactccggatgatcatatcttggtcatacgaactctgaatcgacccgttcaagtctcctaatgtttgttataaactaaagaaccgtgtgctttctttttatgtattggttttgcttctttataggcttgtagctttgcttgtgtgcttcgcgtagcttctgttgttccggaggttctcgaagcgtggttcgcgttcgtcgccgaaggttcggaaggtcgcatctctctgagcgactctagtcacatcatccttgagcatattgaatcccagtttataaaattattttgatttaaattaatgcattaccgctttatttaaattcccgcgttatcactgttttatttagccatgcctatttacctttgttatgacattattattgctattgttattattaccttgttaaccctagaataaataaaaacccaactagtgggtactctattcatggttccactagtatgaagttaggtagatgcttcgctgattaattaggcaacattaggtggttttataactctagactttgggaatattcatatcacttggacactatggaatggttggattattgtggaattggatgcacacctccccctcttctcaaaaccctcaaaatggttttaggctgggctcggggtgcatggttttgttagtagcacctcggccacataaggaccggtcttcgggcctctgttgcaaagcactaccgtacttccacatgtctagtgggtaaggattagtttgtggctcagtctggttataaacaaaagtacacggatggagatggacgaagtcgggggtcaatggacatctctaggacaaatgaaggctacacgagctgcggcccggtagtcgagatgtcatggcacagggctggtgtcctgctgctaggggctcaattctgcctgcctgtccgggggttccggccgtaggtgggttgggttggtactcttgtctatggctaggatgggttggaaactatgtcatgtcttccgtccatatgccgtggtggtatgtggcacgtggttgcacgtgaggaagacgtctcttgtgggtaaagatgtacacatctgatcagactaaaacctattcgaatagccgcgccctcggttatgggcaagcctagcaatgtacccaagttagtgttttaaattcttaaaacctgcttaataactaaaatgtggaatggttggcctgggttggcttgggacgagctgggacccagggtcgggttgctagttcggtctgaatcatcgtaagccttgggtgaaggcaggttcgtgtgggttcacggccttgattaataatactgtgtagctctaggatcgtctttataaaatggctttgggcaactaagtgacttttaaatgctgtttactgcaaaacttaacccctatattattatcccctgtactcccttgcattaattatgcatctccggtgtggcttgctgagtactgtggttggactcattcttgctcaatcttttccccccttcagtaagagaagctttggagaagaagtcttaggtggagtcctggcttataccctagttgagcgccatgaagatggagccgtaggcccgctagtccgctgctgtttatttttgattgtcaggcctgaagtgcctttgtaataatgtaaatattatcgatataataaagatgtgtcttttatatcatgtttgtgtggtgtaccccggcttttcctgggacggggattaatacactagcgtttgggaaaaggcaattttctcggtcgcgacacacaacaagaatcttggagatattcttgccttggagtatgattggaatgaggaggtcattgcacagttctatgcaacagcattctttggtactacaaggaagggaaccccatatgtgaagtggttgactgagggtgttaggcacaagatttccatggcacagtttgctgagatgctggggttagatgaagaggatctcaataggcccaacattcatagtgaagcacccctccccatgatcaagaccatgttcatgtatgcaaaggatgctcctaggacttgcatgggatctactcatggtttgcatcccaactataaggtgttgtattccatctttcgttggtccttgcttccaaaggttggagatgctactgctttgtcatccaagcatgctcatcttctcagtcgcatacgctaccatcagcctcccttcagtgtgatgaagttgatttggtatgagatagccaacaccattcttgagcctaagcggggttgcatctatgctcctttcattatgaagatgattgagacagtcaccagggtgttctacatcaaagatgggcgccacaatccttttcgccctcgtgctccaccttcctcttctccagtgctacctagatctgttccttctacttcagctggtctttcttctagtgcctcaccaagttcctcgagttcttctcccatcaagaaggcacttcaggcaatcttctgtatgtgtgctaagactgccaagaaagtgaagaagatagaaaggcgtcagaaggaagatagaagagaggctagcaaagaagtgtcagatgattctgaggatgaggtctatgttgatccattggaggcttatgaggcagcccgcaacgttgctggtgaaggtccttccacctacttcaatgaagaatcttctcattctgatgatgatgataatgatgatgatggtgatgagggtgacaccgaggcagctgctgaggatgctcccactgatgttgatgagggtgataccgctgctcagtccgatgagtctcatctttccggcgataccgagattgttccctctgatggagatgaagatgagtgatcctcttcctctcatagtttctcgctttttggtgtcttgatgccaaagggggagaaattgtgaattgaagggggtcatttaaatccttttgctaccttgactattgtctggtcatttggccggaagctccgggtcctgtgatccagaggttccggccaggcagatttcctctctattatctctctctatatggacatgtaatcgtattctattatggttggatgtaatgactattagatgctttattttcgtttatgtcagtaagttagaccatatggatgttgcattttgatgtgatgttgtgttcttttcatctttttgagtgattggcttgtcatctagtctttctttttgcatcactcatcattcaagcacttttatctacatctcttatttgatgaggatagtgtgaagtttcttttgagctttccttcatcttatgcataatgtattcatttcaagttcattatatgcatatctttagggggagcttcacacttctctcatcattctaaatttaaatcctattatttttttgtgtactttaaccatgttgtcatcaatcaccaaaaaggggagattgaagatgcacttaaaccccctagtgggttttggtgattaatgacaaggtggttaaaggggactaacatgtttatcaagtttattcacaggagtttagtcccaaagcaagttgtgatggttaagaatgcaaggagaccccccaattcgaatgttcctaagtgcgaaaatcaccgtaggtgattagactaggtttttcactttcgaaattgagtttaggaaaaaccgtactattaagaggggtttcaagtgtggttctatggtatacaaagtgctcttagtcatatccatgagtcaaaagatttttggaatcatttttgaaaaatgattttctccccaggacagagagggctacccggaggttctggccgaaacttccgggcgccgtttaattgcaaaaattttcctaagtgctgcccggaagttcctggcacttttgcccggaacctcatggcaggtttccagttcaaacatgtgagtaacggctagatgacgtcacctagcggttatatatatggatttcatccccaggtcaccctttttccattccacttcagttctttcatgttctagggttttctagctactcccaagcttcctttgcttcctccactcaaatctagagcctatcttgtgagattgggaaattagatgagagtgtaggagtgttttggagatggcttgaagattaggtttgattgagcactttggtgtcacgtcctgataaattcatcccaaaattaaaattcattctctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattattaagaaataaacaaagttgaaaaggttttataaaaagaaaaatccctaaaagaagtccttttccccccctcccttcttgggccggctcggcccagtccctccctctctctctcttcccccgcggcccatcggcctcccgcgcgcgcgcgccgttgacaggcgggcccgcccgccgccctcgctgacgggtgggtcccacctgtcgtcttcctcctcgcgccgcgccgccgctcgcccgtgccctagcgccgccgccgccgcggatttcgccgcatcccgccgtccccgcgcgcattaaagagggggaaaatcacccccgtgattccctctcccgtttccccctcttttccctcttctctccctcggattcgttcgaatcgcgcccgcaatcctcgccggcgcaatcaatggcggccgagatctccgggcccgtttcctccctctccggccgcgctctccccctctcggcgctatataatcgttccccgagctccgctcttccgtttccgccgcttgccgctcgctctcgccttcggattcgtgctcgcgacgttctcctctctctccgccgtcgccgccgaccttcggttagccgccgtcgtcgctccggtcttcctcccgactcggcgccacctccatcggcttcgccgcgttgtcgccgaccccgtccgccccttcgcttcgcccgccgaccgccggagctccgtcgccttcgtcgtcccgaaccgcgccgccgcgttcctccgctccggcagtcgtttccgccgtcctcgttgtcccggggtgagccgtggaccgtccctctcgcttccctctcctctccgctctctcgggcgccgctccgccgcgccggtggtcgccgacggtgaccatcggggcgcgggcgcgcgtctcccgtcggtcgagccggcgaggccgccttcggccgcctcccgcggctgccaggtggggcccggccgtcagccgcccgcgcccgcgggtgcggctgacgcgtgggacccacggcgccggccgccgccagccgcgtgcacccggtccaccgtggaccgagaggctgacgcgtgggccccactcccgtggacccggtccgcgcgcccttctccctcggctgacgcaataaatgggtttttaattaaaatttaaatgaagaaattcgtaaatatccatttaaagagcatataaacttcaaatggccataacttggccatttgaactcggaattggaccgttcaagtctctaatttttccttaagaagtcaagaacccatttttgtgctttgtttctgctgttatgtggagtttattagcgtaaaagccttttcttttccgtcggtcgtgtagacgctgcagcttcggaagatccgctcttcgtggaagttgaagccggcatttgggaaagcgagcaaggcaagtcacatcatccttgagcatattgaatcccagtttacaaaattatttttaatttaaattaatgcattatcgctttatttaaattcccgcgttatcactgttttatttagccatgcctatttacctttgttatgaccttattattattgctattgttattatttccttgttcaccctagagtaaacaaaaccccaactagtggacactctactcatggcaccactagtttaattttaggtagatgcttcgcaatttaattaggcaacattaggtaattttataactttagactttgggaattttcatatcacctggacactatggaatggtttggttattgtggaattggcttcacaccgctccttctattcaaaatccccaaattggttttaggctgggctcgaggtgcgtggttgggttttgctagtcgtacctcgggtactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgcttggggctcagtcctgcctgcctgtcccgggggttccggccgtaggcaggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgtttcaaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaaggctgttactgcaaaactcaacccctatattattatccccttgtactcccttgcattaattatgcatctccggtgtggcttgctgagtactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttaaaaatgaaactatttgcgaaagtccctttttcctcctttcccctgtgctatttgcaaagtgtttattcccttttcttccttcttcaaatttcaactagtactagatggtcagctttgcgaagaagaagatgtcgtcagttgtttgccgaagctccggaagactgcaggatccgctagcgaagcgaaggaagaagtgaagccagctgtgaaggagtgaagatcttgggaacccgtcgcagaacctaagccaccctgtagggtagtgttgttagtcgtgtgttccttgcttgtgtgtgtagcgcgtggtttgcatcggtgggttgtgatgtaaccatgctaggttgattgcttaatcaacttgcagaataagtgaaacaaacaacacatcagcaagaagagttagttcctttaaggtcctgtctctagttctggtctattctttcctggcttgtttcctctctcacctcaatccctgtaacagatgtttaacagagaaaaaggaaagaatgtcagcgggtatgcctcaagtaactcaagttttcaactcaatccaccactggcctcaagagagttaaccagggcacacccttggtccattccaagcatgccgcttagttcacagctaccattggttggaagtcaagaccaaaatcagtatgtgtttgatcgagcatttgccacccaggtcaatgagcttccaatgccagaagaggatgtccccttttgtcacgattgtagagaacaaggacactatgccctgaattgtccatgggtatatgccaaagaagccccttcctttggtttagcagggcagacatcgctaaaccagcctcctcacaccaagacaagcttgcagcctagtgtgcaaagcagagagcccaatgaagagaatccattgaatcctgggaattgctctcctcctagcctttcgtaccacgtggggtcacgtactaagcacgccaaaggcaagaagagtaagaatcagaagagaaaagcgccgatgcgaactgaagaagaagtacgtaagatgactattaccagcaccgaatggtctacagcagggataactattcctagacgtcaatgaggaaataccttccgaggtgcacgacagttgacccagcacctcctaagccatggtggcagagtatctgatagtgaagggtcagatcaagtctcctcggattatgaagatgagtcccccccacatctcggcgaggaagagatggaatcaaaagcatgcccccgttgtggagaaattggacacattgctagcatgtgtctcacactctgccctcattgtgaagaagaccatccaccaggggagtgtcccacccgcaaggtcacatgttttctatgcgaaggtacaaaccatgtgcccaaggattgccaactcagtgtgttgttgaccaagaccgcagaaatccaacgaacgaccctacgattgtctcgtcagctagtcagctccaacagcaatatcgacgatatcatccacagcaccaatgctcctcctgctgcacctgactctgcaataaatcatagcaataataccttcagcaccaaccattctcggcaccgacagcctcagcaatgaattgtcgtcgatggaagaagttgtttctctccccgacctactccaggccgagcgaagggaaatcaacatcaggagggtgataccaagcagaagaccgttacccacttcaaccagcaatcagaaggaatttttctcctgtgaatgatagcaatacgcagtcctaccacatcatcacagaaccaatcaaggatgcagtcactaggacaatgccagctatatctctcctgaatcaaaatgagcagccccgtttgtggttttcagttcgctacttatcattgtgtaatagaaagtttgcagcaatcatgtaataaataaatatattcatgactataaaacagtgagcttgctatgtttatggatgattcctgttgaggatacaatgtaccgatgttaagcaccttccctttttgtttaagacagtgccttgtattcatgtaaaatgggagaaatttgtaataaaaacaagttctaagaggattctttcggaagatgctgatatgggattatgtgtttactgtcaaaggagacctagggtctcatttcaaaggaactatgttccaacctcgagttaataaccaacctgatgatagaaaagaaaatgccgagtccgggaagatatctgttgcttcaattgtcaaggaatgggtcatttcgccgacaagtgccccagaccgagaaacatagctgccagcacgtcagtccacgcaactccttgcaatcagaagcttgctcctcagcgaattgtcatccatgcatcccgaagcagtcctatagaccgcgttgcaacagctccaactccagcgagtgcattaccacaagttgtcaatgctcaatttcagccccagccatcagttgacaagacagaggccagtatcggcattgtacctttggatgttccagcacagcagccaaagaaatcaagtacaagatgaagaacccgagcgtaagaaagttattgtctgttacaaactgtagtacctgttaaggaagcagacatgccaatcgccaagtggtcactggagcaaatacagtacctgataagcctagcgctagtcagaagcaaccataatactcttatatcagtgttcaaatacttttgttttatagttgttccccgtcaatcatgtaataacagagaaacatgagataatgaatgagtttgataagcttatgaaggatccatgttaagagtgcaagtgctgtgagttgtgcacattttgttgttgattagggagacctagggtctcatttccgtaaacccaaaatctgttaggaatcaaatagtctagcgattgatggcgaagaaaatcaagtgatcaaccaaagaggcatttgtttggactaagagtttcagatgtgtctcttcggatcaaaggcaacaatcgtcagtctagtctttgacgaaccacatcaaggtttcacggaaaggcagcaagccaaaggacctcatcgtccccagaagcgtccgcaatccacatcaaagaataccacctgttagagataagccggaagatgattgataaaagagattggcaaagatgttctccagcatgaaagaagtaggccgaaaggtgattgataaacagaaacatgctctgcaccgctcaaggaagacccctgattgtaattgccccgcagcagtcaccttgtcattaagtaagcaagatgacctaggtaaaagtgtttttatgaaggcaaagagtgaaatcttcaactcggtatcagatgctacacggagtgaaaagtgcaagcaccggttaccaggcaatgccatgacttgggagatgatccaatgggaaagaacacatcaaggttaaaggtgtaaaggaatacgttgaatgctaactgaggacaacctgaagataataaggggaagtaaactgaatgtaaagaaagtgaatccgagttgcttgttcgtgagggctattcccagttatgaatcaagtgatatgttcgaagataatctacagaggtcagattaaaagcacatctaacaacgaagcctcagatttgacagggtaatgattagacaataacaaatccagcaataaagccattggagaagacgtcaaagtatgtcaagtgggataaattggttctcttgggaagcataacttatagttagagtggttgacccttgcatcgaatagccgaagtacctagcaccggagaccaggaaagctaatatgagacagttgatggcaagttagaagtgaatgacaagcatgatattcttatgatgacaaacatagtatcctagtaatgacaagctagtgttgacgcatgacgtgaagtggtaacttgtctgaggttgactccgaagatatgaatcatgagaagttctggaacggaagcatcactgaactaccgcaacctagtctgagtcagccaaaaggtgcaccctggtccaagtcaggtgaagagaagattccatctgcaacaggagatcgagccaagcagtccagagtgaagaagtttgttaggcaagtttgttatagaagacggagcggaagaagtcagacaagaagagaagaccgcccaacctatcttcttgctagcctcctcgaatctcggggacgagattcttgtaaggggggtggatttgtcacgtcctgataaattcatcccaaaattaaaattcattctctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattattaagaaataaacaaagttgaaaaggttttataaaaagaaaaatccctaaaagaagtccttttccccccctcccttcttgggccggctcggcccagtccctccctctctctctcttcccccgcggcccatcggcctcccgcgcgcgcgcgccgctgacaggcgggcccgcccgccgccctcgctgacgggtgggtcccacctgtcgtcttcctcctcgcgccgcgccgccgctcgcccgtgccctagcgccgccgccgccgcggatttcgccgcatcccgccgtccccgcgcgcattaaagagggggaaaatcacccccgtgattccctctcccgtttccccctcttttccctctctctctccctcggattcgttcgaatcgcgcccgcaatcctcgccggcgca

SEQ ID NO: 7143 - DNA, 4795 bp, Oryza sativa
ttactgcaaaactcaacccctatattattatccccttgtactcccttgcattaattatgcatctccggtgtggcttgctgagtactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacatttggataccttgtgagctgtcacttgggcttattactcttggagatcttctcatagacggttaggtgtttcccgtgagcttccaaagatcttgtggatgtcccgggaaagtttgtgaagattttcctcacctccggaaggaaacgaggtaactgagtaaagattcttgtgctgagttttcagaggttgtcctaggcagagcaacttgcacttgtggtcttttctagaagaaattttgagttggatcttggtggtcactcaattctagaaaatgacctagaagtgttgagttgaaggttgtggatctcttctgggatctttgcataagtgagccaaggggttaatcgagacccggctctttggagcacctcaacggagagtaggattcgtgtgatccgatcttcgggaaaaaatcgtctttgtctctcttgtgcatgatctttgtgtgaatctgctgatattctgcgatctttatcttgttcccctatgtgcctaaacttctcttgctaggacctgtttttcatctcagtttaatttatctctgctgcccggaagttcctggctcaagaactccggaagttctgggctactcatgctgcccggaagttccggtgttcatcaccaggaggttccgggccctgtcaattgaaccgatgcaattgttgagaaaatttcaggaaagcctattcaccccccctctaggctacatctctgcacgttcactgggatcgttccctgtgacatgtcttcgattataaaattttttgccgcatcaaagcaaaaatcatcagcctcttcgttacgacccgcgacttccccgtgaaaagtccatatcttgtaataatccataaatccacgctctacaatgtgcaaatatcatttgggtcttgcatcatcttttcgttcctgcaatcaaagcatggacagaaaatgtccctcttgttctccctcaaagcatgtgcatttgcctgatcaacaaaattggatgctttcttcaagaacgccagatgaattctttttgctggtccatctaccaaaagaacatatttcatgagtcgaattgtactatatttaacatatgaaaaaaatacaacttaaacggacattatattgctattcatggtctagtggttccaataaaattaaattaataaattaaatattacttagaattactagatttgcaaacctaatatatttgtcgaattccactgaaaaaatttgaaataaacagagggaactaaacaaaaattaaattaaagttctacggagaatttaaacatgcatgcaacatttgtaatcaataataaaaactgtccatttccaaaaaattgtaaattttcttagcctttatccaatgacaaattaaattaatggaggcaaacctaaaaaggaatcggactacggaatactttgaaaaacatgtgatacaaacaatacatattagctcaaaaaataaataaaaaacaaaaagtgcctacactctccatttataaaactgtaaatttcttcgcattgcaccgataaaaactaacaaaaatagaagcaaatgaaggagaagatcaagcattacaccttatatatggatcaaaatcaaagatttgaggtcgaaaaccttccccttaatttttcaaagtttacgagagaaaacgccggaataaaagcggcatggtcgggctagagtgtacatagaccgacatcatcgcgtgcagtcggattaaatggcctgcacaggataatgcatcttctcgtgcgggcgccggcccggcgccggtcctcgagtttttttcacgcggcgctagttacggccctcctagaaccaaacagggccggcgtttaggaaaatgatttgtgtagtgttacctactctgcctattgtgtattgtgtagtactccgtccattccaaaatttaagactacaaagctatatttggagagagcgagagagtagcgattaattgattgtttttttattaaaaatgaaccagcggtgttgctcacgcccgaccggcagtgataagccagcagtagcccattacgtggtagcagtagtgattgaattattttttcagcaaaatttttaacaaacatctaactatatcaggccagtaatatactagctacatgctggtaaggcagaagatatggctttaatataccagtacgttcacctcatgtgcagctaaaatatttcagaaatcggaacttgcagtctacagaacaccgtacatgctcgatccacatgggcagctactacgtaccacagctaatgcaaacaaacaatatatatggcgcacaatatatatagttattaatgatccaattagttaaataatcactgcatcatgcagtgtagcttggtcgtgagatgcttggctgcgcctataaatacgcgcctcactcccaatatccgcatagacgagagcaacaaattagcagtagcctttgaatccattttggtttagtttgttgatcctcgagtaaacatcacttaaaactagataggaaatatggaaggtgcgaagagtttgatcatgtgtgctctggtgctaagtggtgtagctaggaatttttttgttgggtagtcctatttcctgtgagggaggaaaaaaataggtgtgaccaagtaaaaaaaaataggtgtgaccaagtccctagtagatagaaaaagaatgatgaaaaacaagttatactacaatatttacaaaatttgtccctgcttgtgccaacttattatactacaattttaatatcgccatactatctaatatgcatttacaaaatttgttaaagaccgcccaattcgaataaaccatcgtaacataaacaccatgacagaaaaaaagacagctagctctaatctaatcgtataaacaaactcaaactcaaagcttgacaaaaatgcaataacaaatatataacactctagagttattaggttaactaacaagtttaagaagcatgatatatcagtaagtatagttcgttttgcaaatgatccatgaattgtaaagactgaataagagcaaatcaatttaagagtataaatctcaaaggtaaatacgaaatgctttagcaaactttgtggccaaagaaatttattttgatagtggggattaaggtctctaggctagaatctagggtagtcctgtgtccatatggaccaccagctagctacgcccctactgcggtgctaggcttactcctgcagcaggaaacattccatgtggaagctacgacctgctgcccatccacctcggcaagaaaagtcttcaacttatgctgataccgtgccccaatggacgcttgtgctaaactctctggctgcaaaaatgttgatgggagttgccagccaccttacaatcatttcacccttcaccgtaactcgggtaaaacggacttaactattaactctatttctctattcttttgtactgttaattaatgttgcaatatttatttctaaactccccatctcttagttacgatttcacaagcaaatttcttatataaccgccagtaaaaaaaatagagtaccgctataaaaaatattttttctaagtagtgcgtggcacattacaaggatttggccgcgtccagttataaagtttgttgatgacaagaagttgtacgttagtcagaaacctgcattagcttgcaaatacccaatcctcatgttctcatggatcgctactgttgtgctcgagtgggctctaatgctactgatatgtttacatatatgtacctatactaacaggatatttactagatgcttccaagttaataaaaatatctagccaattattagctggatatgttatactatcatatccattgatcactaaatctacgtgtgtttgttatagacaatactaaaatctgtctatcctaccccacttctgaaacccccatctacttctaaatcccatctgctctgaatactgttccatcagctattttcgaaataatgtcttaaatttctttatcaaacttaataagcagtattatagccgatgaggcatgtttagggtcttttattctttgatctatccagtctatagccgatttggtctaactccatcggctgagacgaccaacgatacgctatcagccgatcaactatcggctaactctgcttctatctttcttgctgattgcagaatcaaatcagctatcaagcccttgacactctcgaggctacccttggacctgcactggagttaagcagatctcccaggccgctgtgttttccatcaaaagcacgtttaatggagcaactcatttgcacatgattggacaagtattaggtaaaaaggattttttttaaaaaaaaaactacttccactatttcacaatgtaagttgttttagcattttccacattcatattgatgttaatga

SEQ ID NO: 7144 - DNA, 681 bp, Oryza sativa
  unsure (1)..(681): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccatctaaacagggcattataaacgtttcgtgctatggtggatgggcagcaactctttgcttccacctggatcttctcttgttgcaggactaagcctagcactagcatacacgcaatcaaactgttcacaccttccatgtttcctagcttgttttccaatcagatttactcgaggatcaactaaaggaagagggctgtggttgtgcatacgattggagagtgagacacgcctatttataggtgaagcctatacagatgattatgttattttaattcacaatagttatattgatgatctgtactctgtattgtttgtttagagaccaagccacttacactagtacataatagacttttccgtgcggtcaaaatacattttttccgtgcagaggacctgcccgtctacacccaggtatctacgaaaatccatatttttgcgttcggacgggcggaccgcacgtgataattgattatcccgtgcggtcgtgttaagtagaccgtacgggataattagttatcccgtgcggtcctattatattgacctcacgagataatggataatcccagtcggctagcatgtg

SEQ ID NO: 7145 - DNA, 8056 bp, Oryza sativa
ctatcccgaccgaaccaacatggcacccggagcacctcgtattatgtgatgaattgataagctaggaactaaatccatatataaatgaataattatcaaaaaaattacatatataccacatatcctatatcccaaaaatcacaaaattgacatataaaaaaaattgcatctacatttttgcctaacaattgacatcgcacaaatttgataattggtcatctcacaaatttcataaatatcaccctaagtcccaaatttcacatatcaaaaattgcacatatatataaaaatattgcacatatcctaaatttcacatatcacaaattgcacatgtcacaaattgcgcacatatcacaaattgcacatatcacaaatttcacaaaaaaaactcaaaaatgattaccgccaatggcttgcagaggaggtggccggcggtggaggtcggcgacaccggcggtgagggcgaggaggagaggcggcagcagcggcccaaatcttgatggctagaggtagaggaggagaggtgtagaggaggcggcaacggtggtggttggggaggaggtccccggcgttaagggcgaggaggagatgagccgacggcgctggtggaggtcggcggcgtcttttggtgctcggtgaggaggcagcggcggtgaaaaactgggcagtgtaggtgcaaatttcgtacgcccgcccagtgcttatatatccatattatcgcctcgggtggcttatgccacccgcacgggataatcgatattcccgtgcgggcagtttaagtagcacgcacgggatgatattatcccgtgcggacggcttaagccacccgcacgcaaaaataaatgcagataaattaataaatcccatctaatatggttaattaatcaatataattattcaaccacaaattaaatatagctatagttaattaaacccataaattatttaactataattctttaactataactaaatatagttatagttaattaaaccacaacttaattaattaatcaatacaattattcatccatatgattaatgcaaataaattattcaaccatagaaatatatttatttaaccacaaatgaatttcaatcgcatctaattaaatcgcttgtatattgatcaaacctcatcttaattattcaaccatatgattaccagaaataaattattcaaccatataaattgagaacgacacatatagtatggataaacatggaaccataagtttgatacattaatcgtttgaagggagccataagttgggtacattaatcgtttacaaaaacaagttgtacacaacaacatatatatatacatatatatatatatatacatatatatatatatatatacatatacatatatatatatatatacatatacatatatatatatatacatatatatatatatactaatgttttacaattttcgcaacaccatccttccacacggacgaaaacttctcttcgtcaagggttgtctcaattcgcttgatctggttaggtagatctgtgaataatgggacgtcgtcgtattggttgtaaactgacgcgtctttagtgttatcaatgccaaagatgtgttgctttcccggtacagtaatgtccatccgctcgtcagatgggtccttcacatagaaaacctgtgcaacacgattagcgagaacacatggatcatccttgtggcttagtttactacgttccagaaccgtaaagccgtagtaatcgatggataggcctgttgtgtctttgacccactggcatcatagctccgggacctggatgttaatgccatagtcaagctcccaaatgtcttgtattatccgtagtatgacttattctcccctattgcgtccaacgcctccacacgaactccactattctaacctgcgcttttcttgtccttgcctatgtgtaaaacataaatccgccgatgtcgtacaattgccatgagttcatgaggctacttgggccagttgccagccagtgcaagcgattcaccgaacggcaagtttttttccttcaaccattcaggaaatttgcatttatgttcctttgagatccaagtcgccgcccttctagggttccaggctcttatctcgttcatgtgtctgttggtatttcttaacgacattactagaaatataattcccagcaatggcgcagaaatactcctagtatattatggttacaaagttcatccgcaagcgcacgaatataccattgtagcatttcacccgagagtattccaagtgtatcgtatttatttaatccagtggcaagatcatggtatagagaacttgactaataatttatttgttacttgtaatagtcatagtctaagcaggggttaagataatctaagggtacagtgacacacaagcagactactcattctcatactaaattatctaagctaagtggaaagaaaagagaaagagaatctattcctatacttctactatacatagtatacatacattctagttatttgatatactagctaataccctctatctgatgccctcctggtactttgagaagccacccctgacgaccaagctccttacgacagcccgtcatgaccatacaaccggggctaaatacggaggagtacccttcccaggaaagtaacttaggactatatacacgcctggaggaatacccattctgagctgtcaccatcagcggcccacctctcatccgcagcatataaccataatgataccccgtaatttagacaccacgtctaaactgccagatactactctaatatcatcgtcatggcatagagtaattgcatacgcaaacattataccttcaccaaagcatctcccagataagctagcagtataataagtataacgtgaacaatatgtaaagttggcattcatatactcggaaagtatttcaataccataattgtataaagaagagtattctagataaagtacaaagcttacaaaagagaatagaagagctactagagcaatacctgaactcttccgaaggcttccagattccgatctctactctattcctattccactagcttaagaacactaaactaacttgagagaatatgagagagctcttgcttgaggtgtggggaagaagtaaggagatgaagcccttttatagctaaactatgacggttctgacagttggaatggtcggaattaccctccaaccgtcataggggcttcatctcagccgtccagccaaaacctggatccaacagccaaaccaggggcaggcccatccagccaacaacttcgctggtggcctactctactgctcctctccgcagacttgtgaattttggcccaattcgtcgtgtcatttctgagttcttggcccatttatacataagtctgattcacgacatcgtccgattgatttatcgtctgatttgatgtcgattctcctccactttatggttattctctgcaaaaggttagtgaaccaaatactagtggaatattattgttctaaccaaatactagttctcctctattttggtaatattgacggtcgaaactgatcgctaacgaccgtcaacagtgtccctcaatgtacggcttgaggatggcgagttgttgcagcatgccgctatgtgcttccgctacagctttgtagtcgttatcatagaatcttttcttgtctatggtccacttcccagttaactgaccctcgtgttcaacgggggttataccaatgggtgtggtgtccttcatgtaatatctttatcattgattccttcggatgagctgggttacggacataccctttcagaactgacatgtacctctcagacgcccacatctgatgtaggtataggggaccaatttcgataatctgagggacgatgtggacaatcagatgctccatcatattgaaataagatggagcgaaaagcatctcaagctgacacgctgtttcggttgcgaatgtttgaagggggcctaaatcttcaggatcaaaaacgttctgtgatatgtgagacatagaaagcattggctcggcttggaggtggtttccttttttaaaagaaattcggggagagcacaaaggtaccagttctataaccgacaccaataacctagtgtcattggtgccaaccaattggtgccggcagagaaactggcacctattgccggttctcaaccgacacctatagggggtttctgtactagtggatgtcatcaataaggaggttgagtaaatagttaacccgattaaggatcataatcaaggcaagtaccctccctccctttgaatatattgaaactcaagctttcggcaaacatgttgttttacaaaatttgcacatgtaattctaatgaaggaataattagaataccttgtttgtactcaaatggatctatttatctttttatatatgccaaatactttgccttgcttgacaagcttatcatggatatggatcatacttatccatgttgttttgaacacatttaaacttatttccatagatatgccatggagaattaccatagttggccaggcaagaaacttgcaactactatgtgcacctcagttatacacctacaaatatgccaccagacacgctgaaatgactgcagcgcctgcatcactgatttccccccttatatcagattcgatacggtacttgggcttcgatcttaatttctttctagctagctgaaccacagatatttaaaaagaaacgatggagctggtagctagcgatagatactctgaagtctgaacttacagtgctttggatcaggagtgccgtcaactgcacgagaacatatgcaaatcgagtgtgtcgtgctggcctgcagctacctatctgatcaataattaatatgtgcatgcatatctcatgttaatttactctctgtggatcgatgcctattgtcaccttccttatatatatatatatatatatatatatatatatatatatatatatatatatatatatataggacactcatatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatatatatatatatatatatatatatatgatgactcttctgtacacccaggtgcaggtactccctccccctagtggattatccaatagctaactgatgagctagttcgaaaaacaaaaatcaaaatattttttcccgcatgcatgggcaacgaaggcacataaatcagctgatgtgcatccgtatctagtcaataattcatccatgcatttcggtatgtacgtaccagaaccaaggttgaaggagtatatatataccttttctttttcaggatctagtatatattgttttttttatgatctagcatgtactagatttttgtttgctggagtatatgcctttttattgtaatatccagtatgtatatatgtagtacagtatgtacttttttaagttaagtatatacttttttaagttagtaatggtatatactgttttgaattagtagagcagtatatacctttttaggttagaagcggtatataccttttctacaattagtaacggtatgtactttttaaattagtagagcagtatatacctttttaagtaagtagtaccttttttttatgttagtatcagtatatttttttaggtgagtatcagtatatactactgttatttcaaagagtactgatatacttactttttttttcctggaactgagtatatactagatttaatttcttggaacgagtatatcccgagttcttttctaaacaagtttgtactactcttctttcaatgagtgtactgatatactatttaatttcttccacaaattatattttctgatttcaggtgtgaacatgaaattttaaagaatagaaagttctttcctcgatttagattaaattgaagcatagtctgatcacaagagaacttgcaataatgcaggcagtatatggattcatacatatttagccattctgaaaaagaagaaaaatgaatgtacagtacacccaattcttgacctgcacaagctgctttggacagaattttcatactgccaaatccacattttctgcatctacatcagctaatcgatgcaactatgcgaatactgcccggtgttggccaccatcaatggtgtatttgtcatgcatctgtatggagcaaagaactagttaattaggagcttcatcattcttcttccacatcggtagcgaggagtcgtagcggcgcactgtggtgcagccgcctctctgctccttcgattgctgcggcggtgccgtcgccgccaccatgatgccgtgatgcataggcttcgcaaatcgatcgatgccgtgttgtcgtcgccgccattgatgaatatgaaatgaaatatcggactggaaagtcttgttcttaccatcatcgagacaattgtggggagttgccctcactacttataatttctccaccgcttggatgggctgctctgatctgcgatcggggtgaactcccgttgcctctgctacaagcagtgccaggatgtcaccagcgcctgatgtctcgttgccccgaccatgatcctgagacggcacggaatcagaacaagcgatcgggtgatcatccgaaattccgaatgaaaacaaacgcgttaaaaacaaacgaacctgcacgtcgtggagagtcgacgaggggtacgccgctcgtggtggcgatcagcaaaccagccaccgacgatggagatgcccacctagattttgccgtcgtcgtcgcgccggtgaaagacgaatggctgggactcatttgatatatgcggtcagttttcatgatccgataaacatgggataattaaagtattacgggaattgtttttaccgaaaatcaaaacgggtttcaacaatagcatccgctaacatccaggatcggtactgcttttgatgaacggtggatgagagcaggagtacgtactccctaggagtatagaaccatttccctaggagtatatatatatagagaggtcactcaatcgatcaggcccacaatgagttcatgttagtgaaaaccacagtgacaatgtaaaaaatgttgtaacatattcacgatacttttcactaatgcaatatatgtatttttgtcggtattaaatgtttgttagttcctaatattgtgtatgcattagttaattaattaattgcaacattattgataaaaaaatattattaaaaatttggcgggaaaaatcaaaagttggcgcatatttcccaaggtggcggctccttcttatcacaggtgtgctctccctttttttcccaggtggcgcatcatggtacaatccacctaggaaaataatcttcccaggcggaccgtctgcgaaaatcgtcaattttcataggccctacaggtggaacagccgtccgtatagtaagaatgatcttggccgcttgtaaaaatcttttttctaagtagtgaggcctactctcggagaaaatttagcattatatagtacgctgttttttacaagttaaattttgatcaaagtttatttttaatcctagaatataaaacagcgatatttttcagccaaatatttatatcgagataagtaccaccctggctttattagaaatgaaaaatacacacacagcgtcgtgcatatttttacgggttaattggatccatgccactacaaatatgccaaattagaaaaata

SEQ ID NO: 7146 - DNA, 24049 bp, Oryza sativa
tggtggtgggctgtgtgtagaagccggggacaaagcataacatgtgttagaagaagtcgcccaatggtggccccgcaccgtcgaagacgggaaagatggcctccatcggcttgagggaagaagagcacagggagggaaaagggaagggaaggggaggggcccagccggggggacctcgccggcaccgttgactcccttcggcccgccggcaaggcaggtagcggcgcgttgggccagtggcggtgtcgccgacgccgccggaatgcgcgtgaaggagaggaacgggaggaaaaagttagggttaaggctgtgcacgaatctcaaagcatatccaacagtcaaaatttttaaagattggaggtgagattttcagtcaacagatatataaacagtcccatacataaaaggctcgttaaaaataatgtatgtttctggttttttgatgggccaatttcaaagatgctatatttattagccaatgatatcgtcactcttgatatggtcacatcctcaagacaagatggcagattgcgattattatggcttattggaatacaaaagagcacaagacaaaagaggttgacggcacactggcttgggcatcataatatccaacttatttatggctactctcgaggatagcatagccttgcatatataggcttcgatgtgtgaagcaccttatgcttgcatcttgcacttgcttaggaagcaacagtgacgacctcagcttccttggagcagaagcggtagcgtgcattgttgcaactatccacggcaccattcccttcttcattgacagcaactgaaaaaaaatgattctatacattagctaggtatataaaacaaatacattttacattttctttgaaaatcaggagtaattttgtttgatgttttctctagccttacaaatgttaatggtgctgcacacggaggaagtacatcccagcttgcagaaatcaagtacatccgattcctctacaaaaccaagcatacgtgtgttagattcatgtaaaactaatttagtgcatccatgaatggttgtacccatagaaattacaaaattagcagcgcaaaagttagagatggttgtacccatagataatacaaatttagctagctaacttaattatattccagcagagtgagaactgccttctgtagactgtaactcccatttcatggaaaactttggctgcccatgtggtgaacgtgatgagacattaaagcttaaccacgtggcatcttatgccttactaatcactattgcacaataggtagacactactggaacaaaccatctttgctgggttggccaaaaaccacattagtctcggtttgaataggaaccgggactgaacatctttttttgtcccgattaaaaagcccaaccaaattttcttagaaatgtcacacccggagtttccccttttcattaatttctaattcactaatgaattgcctatagaaattactttggttaaccaagagaaaacataaattaacgatatgtttaataatcggaattgtcaaggagaatttttttttaattctctttgctctaaaatcattaacaggacttaaagcagaatattcagagcatcggagttaatgatgttaatctaaattatcaagttttaaagtaataatattttttctctctcacctatggtcgtgaatcgtgcccgattcactattcactgccccctttgttcgcggtttcgttttgcatgacgagccgtgtccgttttcgttcgcgggatccatttccattcttttcctaaaacggtaccgcacgtcatttccattgggaaagtccttatcctattttcccaattcctatttttcctccccctctcctcctcccactcggccgccacctcctcctctccccgcgcgcgcgccgccctccccctgttcgagtccgagtcggcctcctcccctccggccccatctcctttagtttttcccctctcatatataagttagagcccctccctattttcgtttttgtttttgttttgtccctagtcctagctagccgctgccgccgcctagcccaagtgccgcgctgctgcccgctgctgttccgccgccgccggtcagtgccaccacctcccgccgtcgccgccatcaccctagcgtcgccggtaatccgttttccctctctgtgtcatggctatcgccattatctatccggatctaatttttttccgtcctaggtttcgatctaacatcaccgttgtctccgcgtgttgccatcggaccgtcgtcaccgtcacctccttgccgatcgtctcggtttggtgaggaacctatccataatctcctgattagggtgttaattctttttagtgtcatcattgaaaccctagttgtttagccccggtaaaaccctagctgccctagccggccgtgccctagccgccgccgccgtgccctgtgccgcgcctccgccgccctgttgccaccctagccgagacgtgccctagccgctgctttagatgccatcgccgccattctaccgcgtcgtcatcgtggtttgccactgtgctgtagctcggtagccgagtcgcaaacctgtaggtgcatccctaacccccttccggcctattgtttgccgtaccgagcctctgccgtaaaccatgtctagttttccgtagtcgttctaagccgctggttccgttgactgtttggatggtcccgtgacacaaaggattggctcgttgagtggttaatttgtgaggcttgcttaccggagatttatttacattgatctatttatctatgggcattaatatgtaataattgattaagtttttttggttattagtaataacgtagctcatattgtaaaattcataactaaaaaatccaagctccgttttagcccattcaaattgcagtgaacttgttgaaatgtttagaatccattaaaattagtttcctttgctgtttcagtagccttattgcttgtatttcttgtttgctttgtttgtcatttagattctgttagttctggtgatccagtttatttcgaagtggtcgccaaggttcagtcagctcaagagcaaggcaagtcatacgtacatcattgatcatattgagcctatttcataaaatcattgatcataacttgggttataattgactagatgattggtttaggaatgcttagccatgcttagatcaattagcttacaatgggattcatcataatttaatcctgaattttattattggtgtaccaccatggttatggtttaattaaactaaaatatactttaatagtgggtcgtgggtacatgcatgattttgaaagtcgtgcccatgacaattaagtaccagttctcgggaatccttggaagatatactcctacttaccacataccagcgtgggctctaggctgaatctagagtataacttaacctagctgacataccatggcaagggtagaggcaatggtgcagttcggacgtggacattggtctctgctgtagctggatttacctaggcacgagaggggacttcccaacttgggagaaggagggggtgaaatctgaggtgggtatgtttggttagggagagttatatgacgggttttgtcacgatttccccctttgcggtatcgtggcgatacttcgaggcatggtaacatgtgtagaatcgtgtcttgtgggtaaagttgtacacctctaatcagagttaaaactattcaaatagttgtgcccgcggttattgggtggtgaaccagctcaacgtgattagtcccactataataatttgacttatagaattggtgtagttcaggtggttttggttgggcctgttgcaacgtggatttagcgttggacagtgatgatttaatactgtttaaccatatatattgtttttactatttcaaaatatgatttataaatgttgctttactgcaaattatcctatgagccatttctttgtgaatatccttgcatcgtaccttcccgttggtatgacttgttgaatacggtgattggtactcagtcttgctttatccccgccccccagaagtaaaggttggttcagatggtgagtttttcgaggattgagcttgtttcggacgtcgaggattgcctgtggtttacggaggaagcttcactttggtagtgaagattaagtctagtttattttgtttttccgctgcgtatgtgagttttattttgttattttgtaagacgtggatctgcctatcaaattgtcgtttgtttactctgactggtcctggacagagatttaatacacattctgcttgaaaattgggttagcgaatttctgggcgtgacaagaaatctctcccacctatttataatgtcccatgcctttctctcgatctcctcgatcctctgtctcgcgctctctctatctctcccgatctctgtcgatctccctgtcctctgctctctgtatctctctctcgttctctcttgtctcggtggccgcagcggtggcctcggcctcccctccgccagatccagcaggatgggaagccggccggcgcggccgggcgtggggcggcggcctcgccgaaccctccgccagatccggccggaggggaggcagcgggatgggaggccggccagccaggcagcagcggcgatcactacaggaaatcttatgatagatgacgcttcatttacgtcacaaacacataaaatttcgtcacgtttcataatatgtgacgcttgcgtgacaaaaattcattcgtcacctatcatgtcacgcccagaaattcactagtaatttccgaactaatttgtgcaaaatcctcatccaggaatcagccgaggtacacaaactgacaatttaatttacagattcatcataataataacgttacatacttacaaaagaaaagagaaaacaacagcggagttacggtctagcgaagctccggttccactcccacaggcagctcaactggggtagaagccaaacgtcttctcctttgcgacttctcttcaactgaggtttgattgattattgcaaggtgagtacatggaataatccgcaagccacacagcaaatatgcaagtgcacaaggataccaaaggatggcataatatagggctcatttgcaaaagcagcatttagcaaacatttgagaattgtaaaatagtagagtaattaatcatcaatattaatcaacactgaacagcataccctgctgcacaggcccaaccatcctgaacaaccatacctggctgtacagatctatctccaaaccaggaatataccattccaaaccaggagctaatcaaattattaccagttatagcatcttttattatggtgagaagtgtgagactaatcacgaaaggcattgttagacccgcccataaccgcggacacggctattcgaatagttttactctggccagaggtgtaccactgtacccacaagacacagccccacaacatgtcaccatgcgcctcaataccaccacggttccttggaaaggagctgtgacagtacccctcgcacaatacaatccaccacagcgcaccattcctggatcataatcacccccttataaacaaggcatggacttcccagcgaccccgtgggcttatctccgccacttctcagtctggtgccccgcaatgaaccatgctatacaaaagataaagctgttacccacgctagcttgtggttggcacggttaatgtttcacaatcgaaactcgtgaaccggtccttaattgtcatgagcacgaccatcaaaaccatatgctcacaacccaccattatcaagttttagttggtacattaattaattaaccaatcacgattgaccatcgtgagctacctttaccatgtacatcattaagtaatagtgaaacattagttatcccaatagtgtgctaatatttctaagcatgactaagcaattatatctaatatatctagttgaaccaagatataaatccaactagtcaaattataatccgaggtaatcaagaaataggataatcaatgcaaattggccataacaaagaaacagtttcacaccacccgatgacattcgaaaataaatgcacagttgaaaaaaatagagaatttaaataaaggatcaacatgctcaaaagaattgtgtttgggatctgtgtgacttgccttgcaatagtgggtcttcaattaatcttcttgaacacttccgacgcacacgcgatccttcgaaacgacggaaacgacaagctaacacgcaaaacgaggaaaaagactaataaaaaccaaataaatagtacacataaagtaaacaaacatgtagatcatgattttagatgaattatgagacttgaacggcctcattccgacttcatatgaattagttatgaattttacaagattaattccaattaaacctattaaagaaaagactattccaaattaattaaacaatttacaaataatttataactgagataaaagattaaaacaacctccggaaaaagattagattatatttggtagatgccatatgataaaaaagaactaatatgccattgaaaagagagaacggatttatattgattttggatggctaagattaatcttgacatagagttgaccaagattcaacggattagattgatctggcaagcgagcctcacgagataccgacttaacgagtcaattctacgtgacacgggatcacccaaatgatcaaccgaaaccggcgaacggaaccggcagctctgaacggctctaaactaaaggacgactcaacacggacgaacgaacgaagcaaggggaacacctcgtttgaacgaacgagcgaacgactcaataacggctgcgactaaaccggtgagctagacacggttcacgataaagtcccggtacgacaaacgataggccggtaggaattaagggatgcaccttaggctttgcaactcggctaccgggcaacgacagcgaacaaaccacaacaacgacaacacgggatagcggcggctaggtttaagcgacgcacggctgcgacacggtacagcagcaacggcacggcatagcacagcggccagtggctcggtggttgcagtagcagaacggcaacaacttggcacacacgagcagcggccaaacagcagctagcggcaagcggtaacgcacagcagcagcaacacgactgtggcagggagcggcacaatggcagctaggcgactagcgcagcggtgacggcaagcaacagcggcacaaccagtagcgacggtgcacaggctagggcagcagtgcggcgaacaacaacgcaacgggcacggctacggctgcgacaaagcggcttggcaagcgcggcgatgggttgaaatctaaaccaaggagacacggatagacgtcccaccgaaccaaagcgatcggagagagatagatgacggcggtgaaccggcggcaacacacggagacgatgacgacgctagggccatacaagattagattagatgggattaagaccctagggataaactacactgggaacggcataggagcggcggttgccggcgaaccacggcacaataatgcaaatggagggcaccgggagaaagaggaggcaatggcgatgcttaccaacacttaaacagcgatgaacggcgaaggagatggccggcgacgagattgggacggcggcgaggttcgggtccacggcggcgatggctttccggcgatcttcggcggatgacagatggcggacgggcttctcctcgcagctgcgaatccaatggagacgacggcgaccgaaggcgacgacggacgtcgacgaacggctcggctggaggcacggcggcgacggcggcgctccggttcatgatgacggccaatctccggtgggattcggcgaaaaacaaccagcggccgggatagagctcgactttgcggagccgagggaggtggcggcgctgactggcgacggccgaggcgacggcgcactgcggctggagcggcggccggaggtggagagagaaggcgagcgcggggagagcgtttccggcgacggcggaggacgggacttgaggacgacgaggcacgggagctcgggatcaagcccacatcgacgggaaaaactcgggaaagtctagggttctcgccggaaaaaggaaaaattgaaccgcgaaattggaaaggatttccatagaaacttttgggatttcctggggaaaaggaagaggagattgagaggattccattcccgaaactaatttggaaaaaggagcaacgagtaggccgaattttggaaggggatcggcggcatcgggctctgctacagcgtgcacaggcaggagacggctggagcttgaagatggagtactgtagcggcagggaccacaaacagactttcggccgggctgagaggaagggagagaatgggctgaattcggcccaagactaggaaggaagattttattgcttttccaaataaattaaccaatgagatgatctttcaattgttaaaaatactttcaatactcaaataattccaagaaaaatcttgaacatacttggacactctaagtatttaacaaaattgaaaccagctcattaaatgattaatttaatatgaataattactgaaatattctttatattattaaaattaggaattgagctctgaaaaatccgagaaaattccagagagtataattaatcatggagaatttaacaaaaattaaatccaaccatgctttatatttaggaaattttatttcccacatttaacttcacttgtaaattaatgaacatttaatataaattctattaataatttattaaataatttataaatcctgaaacgaaaattcaggctatgacatatcatgcatctctaatagcgttctatgacgaaagatttttttctattaatctagtgacaatccttccgtcgtcatagctttgtgacgctcatatttttcattatctagcctaaaaaacgtcataaaatagctgatgacccattaaaattcatgtatttagcaccttgtttatgggtttagcccaatggcaaacccgactagattttagcctagtccatccatgttgtagcatattgtcaacacaattctattatatccatttgctttaatatcaaataataaatgggccatgtccattgcaaaagcccatataggcccaaatattataccacaccattttctgcccgtcatgttgtattcatttacattagtatcggctaagcccatagagggccaacaatgaaacacaataacaacccatatagcacaaaggtcaaagcacaattagcatccaacacaacccgacaaacatccaatacaacacaaaacttacaacccagttaacagccaaatccaaccacattccaaatccagccaaattcgtctactagtgggaggacaaggtcgtgccctgcttcttctcatttacttcttgcatatcttttgccatgaaacagacatgcatggcaggaagatatgcatccttagctgactagtatgaatcagtttaacatatatgtgcagctacaatatacttcgacagaggaagctagctttagctaatggaaatagagaacttcaaaaaattatgacttacactttcttaattactactaaacttcactgtacaacagaagatagatagcctcgaagtatcagctctgcaaacatgctgaaagcagtaatgagtgtaaactgataatcttgaatagtgaaaattttaagcataatacgactgctgagtaatagttttttcgttaatgcatgatatgccacataatcatctgaaaatccaacctgtctatattactaattgatacttcaatactacatccaaatatctcaaaatttaatctgttgacattgctaaatgatagtatgcactcacataattcaatttgcaaccacagcttaattaatttgcatctagttcaatccatacttgtggtaaagattattgaacttatagatagaaatctagaatttctcaagataaaaccctatgttctgctagatcaccacaagagaaaatgttaaatgatatgccgactgtaccatgataaaaaaaagaagatatgccaagtttggcatggttgcataatctaccagtctactcaatgataccagctcagttgtctcaacttaacaaacatatttgaattgaaaaattataacacttccaaaagatgaacatttttttgtgaaacaagacaatgccagcttttgattgcaatgtttttgagaaatactattagaggcataagtattgctacactgtcaaaagcagagattttgttgctcccggtccaacttatattattctagtacacactagacaaatacaaaggcacacctgtgagacaaacagcttaaaagaaacttgggagggccaactcagaccacactaactttatgaatcagatactgaaatcagttcattatattctaaaatgtaaaagttctgggaataactgctaattagatcctaggataaattctgaaaaatttctggcacagtaacataattagaacctaggataagttttattgaatgatgctgaaaattacatgatcctacactttgaatatcatgagaagatctgtactataactaatttaattatcacctatgaagcctgaccttaaatataaaaagatgaaactgatttctaaataatcggtaacaaggtctatgcgtcctattcattcctcttaaggggcaattgtgttcttacccctactttcatatctaattgtaattttacccctcttttctgttgtttgtaattttgccctcatttttttcgaacgaagctgccgtttgcccctatattggatgaccgtttggtggacccaaaataagagtgtaaaaaatatagatgaaattactaagagaaaaacaatggaccattataccccagtgcaaagaacaacaccctgcattgcctttttcatcccaccacccgatccccattctgattacttgattagcctaaccctagtggcaccgtcggcggctgtgcacaggcgagataggccggcggctgggcaaggctgtgatgcccagcgagcagcagcagatgcccacatcagcaaagcgagtagggggtgttggcggagtgagcaagccgcggcttcggcggagcgagtgaataggcggcggctccgacggcagccgcaagcaggaggcagcttcggcggcacgtgcgagcccgcagcagcggcatcgcacgagaaggcggcgactccggtcgtgctgcagccgcctcttatttttctttttctttttccgatcttgtgctactttatgaggagcttgtttgtttggtgattttttactggtgaatgcgatggatctttttggtaaattttcgcacctggtgaaagttctgtgaaatcctatcaatgatatcgaagttctttcaaaatttgtccaagtgcgatcatatttttttagaaaatacacaaatcctattagaaaagtaggggcaagtgtacagggttatacttgtcttttttagtttcattgacaccgttaggtggttttaacagagtaggggcaaatcaaagtttcgttttgaaaaagtgagggtaaaatcacaaaccttagaaaagaggggtaaaatcacaattgcatatgaaagtaggggtaagaacacagttgccccttatcttaactattacccatactgctacatggtcccccatgtcatgccctaaccatttgctccagatggtttattataaaggtctatgtttctgttcatagactccttaattattcaaattgatctctttattaaaaatatgctactcatggactcctatatgaactataattgatctataattgaactagcctaattgacagagttgttatacttcttatgcttcatgataaattaaatctgtgctagggttcagataataatttccaagtccatggctaaatctaaaatctgattttatctatatgtcaagtgtatcaatatttttactctggacaaagatttgcagttactaaattatatacattctactgtctcttgatttatcccctaaggccctctttgctccctcacttcagcttcttctggcttcgctgctaaaccgaacaaagaaaagcaaacacaaaggcgagtacatctttgaacatcaaaacatccaaagctgccccttcaagaaatcaagaaaagaaacaatttaactgcaaacacatgtgtaaagcaagatctggatatcaaaacacccaaatctgcccatcttgcagtatgtacgaaacttcaaagaaacctaaattcactgctaaacccaatacttcatcaatcctctaatagcgtggtcatctaacggggggagaagaagaggcggcggcgcttactgagagcacggtaaaaaagaaccagagcatatggcctcatacctagcaggagcaacatcagacatgacatctacgggcagcaagggcgcaggacaggggatgaagggaactagggaagagttactttcgtcggactccgacgactgggcggcatcgctggcgtgtggccggccggtggactggagcctggcagcctgcctgcttttggagggatcgctggtgccgcggcgtggtcggctggccgcgcaaggcgcgtgccgctggcggctgccgagccgggcgggcggcgcgcgtgtgactgcgtggaggaactgactggggcggcggggcgatggcgaaactggcacggcggcgacaggtggcgggcacggtgcaaccgcgcaagccgaccggccagtctggggacacagtgagcggtgaggaaaccggcgctgctagacgtcgaacgtgccggacgccgttgacaagaccgccccggggccgtcgctgcaggcccgtaataatgtgctaatgtgacaagcggctataatatacagtgatggcgatggaagttatctcatgagaggtcaaggtaattatgaatcaatttcaaccgttggtcaaggtaatcatgacaagtattatggagaagaacttgctttcagatttattgtgaatcaatttcagtttaatgattatactgcattatgaacaattctcacatatggataactctttacaccattagtggtagatcatctaggagccctgctaacttgtggaatttacagtgccgaatttgatttcaaatcagctgcaaaatctgcaatgttctctcaatcacgaggaggctacttaggcttcgttcgttcctggttgatctgggagattaagagagaaaacacctcgttttccacgcgcacgcttcccaaactactaaacggtgcgttttttgcaaaaaaattctataggaaagttgctttaaaaaatcatattaatccatttttaaaatttaaaataattaatactcaactaatcatatgctaatggctcacctcgttttgcgtatcttcccaatcttcccaatctcctcaatccccttctcctcaaacacacccttagctttttagtcatgttaataatccggttgttgatgtcgcctgcaatctctgttgaccacaacgtatcaccacacgtgggctggttgaactcaacatgtgcattaacccaaggtgattctcttcttcaaaatctttctcttcatattttccatagggggtaaattagagattgcaaatccatattaacctgtttacagtgaaaattggaatcactttaaaggagaggggttggaggagaactggaaactagaaggtatgttgcttcattagactagatcatatgtgtatttttcaagtacatcttttttgcttgattagttccagtctgcgctcctccgcaatgtgtcatggattcagagacattgaattgctgattttaagtacagagtcaatcgttaatccatgtcgaggatgtccaaaagcaatgataggctccgtgcaagggcatgaagcctcactggtggagaaaccatctttcgtcggtcggccgatttccacaatagtcccggatgcaataaaaaccggggctaaagatgatttttagtcccggttcaaaagggtaacgggcatatttgatctttagtcccggtttgtgttaccaaccgggactaaagatgatctttagtcccggttcgaatgctgtcaggtcatgtcaggcccccccggaatcattaccaaccgggactaaagtcgtaactttataccaaccgggactaaagatcccggtgatctttagccccggttggtgctaataaccgggactaaagtcccacccctatatatatgtcttcttcctcctccagctgcccgagcaagctttaaaatttcttcaaaaaagaggggaggtcatgccaaaatttctattaaatttattttggtgattacagagaaatcggaggtgcctaaaaggtttgcaacttcatcctccaatgtttttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaataattatttggtgtaatattttatgatttttgtatgaataaagatatcttataattattgtatgactgtcattattgtaagaataattatttgtgtacggttttttttgactcatgtagatggatcggcaatggatgtacgctgaccggcggtccaaagagtttatcgacggcgtgcagtattttttgagagtggccgaagctaacaggcaaaggggttttatttgttgtccatgcaataagtgtaagaatcagaaggagtattctgcatccaggactattcatttctacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttagtcagatgttgcaggatgccagggatgattgcgaaagtgaaaaggaggcccataaattggacaagatgttggaggaccacagaacttcgttgtacccaggttgcgagcaggggcacaaaaagttggataccactggggttagtgacaaggcatttggcgatttattgaaactcgtcaagaacattcttccggggggaaacaaattgcccgagacaacgtacgaggctaagaagatagtctgcccgttaggactgaaagttcataagattcacgcatgtccgaccgattgtatcctataccacggtgaggagtatgagaccctagaagcatgccctgtttgcaaagcactacgatacaagattagacgggacgatccaggagaagttgacgggcagctaacaaagaagagaattcatgctaaggtgatgtggtatttccctataataccacggctaaggcgtttgttcaggaacaaggggaatgctagaatgttgcgatggcacgctaaagagcgtcaataggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgaagccgattattattcaaggccccaagcaacctggtaacgacatcgacgtgtacctaagaccactagtcgaagatcttaaacagttgtggaagaaggaaggtgtccccgtgtgggacgaggacaaacaggaggagtttaacctacgagcgctgctgttcgtaaccatcaacaattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcctatagagagcgaagatggtcacgcggcgatgtggaaaaagaactctatattttgggaattaccatattgggaattcttggacgtacgccacgcaatcgacgcgatgcacctcactaagaacctttgcgtaaatcttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacaaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatcaatattctcgggcctatgtacctacacaacatgtttcctctcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtatacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagtaaaggaaagaagggtagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgtcgatgtaatgccgtaattattgtgtacacgatgtaaactattttggatgtattgattatccatataaatcaattgatgtatggcatatgttaattacgcacgattattagaggtttcaacaagtttaaatcatctatatgctagttatatgtgatacttacaatttttaaaagttttaaatcacacaggtggcaatttcatatgtatgttaattagagtttttaacatttaatttactagcattcatatgctaattataatttactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagtattaaatttaatataattcctacgctaagtatatatgatgattacaatttttattaattttaaatcatgcagtatgtacatacatatcttaattagagtttttaccaatataataatatcattcaaattatcgcaggcgcacataacttcctatgcaaactccttaaggtggcaacctgcgataataatatgtattcgtaggtggacgtcttaagcattgtctaataatttccctgctttatataatagataaattggtagagtttgtaaactaaattgtgaacattaattatagtaactcatgaggcattggcgtaaaataaatgagaaagtttatttattagccaatgatatcatcgctcatcgatgctcacgtcctcaggtcaagacagcatattgcaattatcatggcttattggaaatacaaagagacaaaacaacagaagttgatagcacactggcttggatatcaggatatccaacttatttatgactactccaggttcatagcctcgtatgggcttcgatgtgtgtgaaaccctttctggttgcatgttgcgcttgattaggacacaacggtgacagtctgagcttcatttgtgcagaagcgatcgcatgcatcctcgcaacgctccacggcagcattcactccttcattggcagcaactgaaatgaaaaggaaaatgatcgtacgcattggcctttttcgttgaaaactaatggtgattcagtttcatgtttttccagcttacaagtgtttatcttgctgcacactgaagaagtacatcccagcttgcagaagtcaagtacatcttatttctctgcaaaaccatgcatttctatttatattatagtaaaactagcttcttgcaggcaagaatgattgagccagaaatattgtgacattaattaacagtacagaagaatagaaaaatggagttaatagttaagtccgttttacccgtatcagagtgaagggtgaggtgatcgtaaggtggctggcagctcccatcaaagtgtttgcaggtagagagtttagcacaggcttcccttgagccacccgcgaaacggcatgagttatagacgtttcttaccgaggtggatgggcagcagctcttagcttccacatggatcttctcctgctgcaggactaagcctagcaccagagcacacatgatcaaactcttcacaccttccatgtttcctatctggttttcattgagatttactcgaggatcaacaagctaaatcaaaatgggttcaaaggctactgctaatttgttgctctcttttatgcagatgttgggagtgaggcgcctatttataggcgcagccaagcatctcacgagcaagctacactgcatgattcagtgattatttaactaattggatcattaataactatatttattgtgctccatatatattctttgtttgcattagctgtggtacgtactagctgcccatgtggatcgagtgtgcactgtcttctgtagactgcaagttccgatttctgaaatatttgagctgcccatgaggtgaacgtactggtatattaaagccatatcttctgccttaccagcatgtattacttgcccgctatagttagatagatgtttgttaaaaatttagcagaaaaaataattcaattactctgctaccacgtaatgggctactacacaataggcagagcaggttacaacactctatttgctgcccgctttagaatctccgggtgcataatcggcagtgaaaatgctactagcacctaatgttacttaatactccatgcgtttcgtgttatatgactttctagcattgctcacattcatatcgatgttaatgaatctatacatatatatgtctagattcataatatctatatgaatgtgaagaatactaaaaatgcttacagaagcagagttagccgatagctaatcggccgataggccgacagcgtatcgtcggtggtctcagccgatggagttagaccaaatcagctatagattggatagatcaaagaataaaagaccctaaacatgcctcatcggctataatactgcttattaagtttgataatgaaatttaagacattattatgaaaatagctgatggaacagtatttagagtagaagaaagataaataaagatagcgtaccagctaatactctagtacaaacctatatagccaaatcaatctatagcaatatatgatcaagtagagaccaattcagccgatatgacctagacttgatatattcctatgaagcgatctgtctatatagatggcgaatatacatgaaacaaataaagaaatatgcatatctggtaagatcggctgaaactccgatactatccctaattatgattaattccaggttagtttttagggttctaaacaagacttgggatgatgcatcacaaagtaggtaaagaagtctaaagtctaaacaatcaagcaattaatcacttttcaagatggtgaattccttaatcaatctaatatagtaaggcgatttagccgataccagcgagaaccctaaagccggaaccagccgatagggctaaatcgagatactaatactagattaactaagacatatgatagcatatggtcatggtaaaaggtctaaaacatccaaaacaacataattgctccgataggataagccatcgagacaggttacctcttgtcgagagaactagccgaaaagaagaacgaaaagggtggcgatgcgccgaagttatattggattgtctcccgtattacagagctatggggttcatatttataccccgagtacaaagttagtctattatagccacgactcaaaccttcctaaagataagatacaaacaagaccatatacagtggtctcttgctaaatctaacaaaacccgacataactaacttaattaacagatacaattgccttaaatgagctctatctctatttggcaataaaagttattctaatctaggccaataccgagcccaagtcatattgtatcggctgctcgccttatcggctaggtgaacttcctgccatgtttcccgccgatacgacgctagccgatgcgcaatccgatttctgttccaactcgattccacatcaaatccacttcgatcttgattcttcctctttgagtctgatgcaaaattccgttgttaacacatgcccccccaaattaagctgtattatataatgcagcggaaatagctcttatcgggccgcaaaagtctaggtgttggtatttcttaacgactttactaaaaatataaattccaagtaatggcaaagaaataatcctggtatatttatggttacagaagtaatccgcaagcgcatggatataccattgttgcatttcacctggaagtatttcaaggtatcatatttatttaatcgcaagagaagatttataaaagaactatgtgaacaatttatatacatcacgtgtataatcaaagtctaggtaggggttaattcaaatatatgggtagagtgacacagcagaagaactctgattctcacaataattaatcctaagctatgtggaagaagaaatagaaaagcaaacaattccgatacctccaatatacactcaattctactccctccgtttcatattgtaagactttctagcataaccaatattcatatagatgttaatgaatctagacacatatatatgtttaggttcatcaacatctatatgaatgtgggcaatgctagaaagtctgacatttcgaaacggaggaagcagtttacatctactagtatactccctctgtcccaaattataagacctatattttttacacattcttcaataacatactttaactagtattttatttcattctatgattgcaacaaatatgaaattagcatcacatgaaagtacttcgaaatataaatctagtgagataacatgcataatacttagtattgatatagttagtatgattattagtcaagagctaccgagtttgattttcattaaaaaggcggcgccctaaaatttgaaacagagggagtacaactgtgcggccaatacctcctaatagtgctttcttggtgtttcgacagaccaccctgggttgccgagttttttacgacaacctgtcatggccgtccaaccgggactaaatgcggaggagtacactcccaaggaaattgtatttggaatacatgctaacgtggaggaatacccgtactgagctgtcaccatcagcggcccacctctactgtcccgtagcatatatacccaaataatgatatctaataatctaagcaccatgcctacattattaaatactactctatatccccatggatgacatagagtaatcgaatattcagaccttaaacccacaccactgcacctctctggtaagctaacccacaattataacaacatagatataaagtagaacctatactcagagaatgtaaactaccgaaagtatatccgctatgttgtattgatctgatgatatggttgtgaatatgcctttggagggctcccttcccatcttctacaggttgggggcagggttagaacggtaggaatacgacatcagttttcttcatctactttacaattttaccaaaccaggactacaggtcgtttccttgatacacaagcaaacgtaatacccgaggcccctataatcagtcggatagcccatccatctacgtatatggtaccataatctctacactgacaatttaaaatacatagatccatcacaattaaggtaaaagaaaagcaaaaaaaaaaaaacacaagtgtaagaatatatggatctaaccatggtcaaatgtttactttagcaccacattgtcaaatcatggcgcaattaggctcaaaagattcgtctcgcaatttacacgcaatctgtgtaattagttttttttgtctatatttaatactccatgtatgcatgtgtctaaacatttgatgtgacagggtgaaaagtttttgcgtgggaactaaacaggtcttaactcatgaggcattggcgtaaaacaaatgagaaagtttatttatttgccaatgatatcatcgcttatcgtatgctcatgtcctcaggacaagacaacatattgcaattatcatggcttattggaaatacaaagagacacaaaacaagagaagttgatagcacactggcttggatatcaggatatccaacttatttatgactactccaggttcatagcctcgtatgggcttcgatgtgtgtgaaaccctttctggttgcatgttgcgtttgattaggacacaacggtgacagtctgagcttcatttgtgcagaagcgatcgcatgcatgctcgcaacgctccacggcagcattcactccttcattggcagcaactgaaatgaaaaggaaa

SEQ ID NO: 7147 - DNA, 826 bp, Oryza sativa
ataggcgcagccaagcatctcacgagcaagctaccatgcatgattcagtgattatttactaaattggatcattaaatacttatatttattgtgctccatatatattctttgtttgcattagctgtggtacgtactagctgcccatgtggatcgagtgtgcactgtcttctgtagactgcaagttccgatttctgaaatatttgagctgcccatgaggtgaacgtactggtatattaagccatatcttctgccttaccagcatgtattacttgcccgctatagttagatagatgtttgttaaaaatttagcagaaaaaataattcaattactctgctaccacgtaatgggctactacacaataggcagagcaggttacaacactctatttgctgcccgctttagaatctccgggtgcataatcggcagtgaaaatgctactagcacctaatgttacttaatactccatgcgtttcgtgttatatgactttctagcattgctcacattcatatcgatgttaatgaatctatacatatatatgtctagattcataatatctatatgaatgtgaagaatactaaaaatgcttacagaagcagagttagccgatagctaatcggccgataggccgacagcgtatcgtcggtggtctcagccgatggagttagaccaaatcagctatagattggatagatcaaagaataaaagaccctaaacatgcctcatcggctataatactgcttattaagtttgataatgaaatttaagacattattatgaaaatagctgatggaacagtatttagagtagaagaaagataaataaag

SEQ ID NO: 7148 - DNA, 3451 bp, Oryza sativa
  unsure (1)..(3451): unsure at all n locations
nnnnnnnnnnnnnnnnnnnnnnnnnnnnnnnnnnnnnnnnnnnnnnnnnnnnnnnnnnnnnnctgaagcatttttagtattcttcacattcatatagatattatgaatctagacatatatatgtatagattcattaacatcgatatgaatgtgagcaatgctagaaagtcatataacacgaaacgcatggagtattaagtaacattaggtgctagtagcattttcactgccgattatgcacccggagattctaaagcgggcagcaaatagagtgttgtaacctgctctgcctattgtgtagtagcccattacgtggtagcagagtaattgaattattttttctgctaaatttttaacaaacatctatctaactatagcgggcaagtaatacatgctggtaaggcagaagatatggctttaatataccagtacgttcacctcatgggcagctcaaatatttcagaaatcggaacttgcagtctacagaagacagtgcacactcgatccacatgggcagctagtacgtaccacagctaatgcaaacaaagaatatatatggagcacaataaatatagttattaatgatccaattagttaaataatcactgaatcatgcagtgtagcttgctcgtgagatgcttggctgcgcctataaataggcgcctcacttccaacatctgcataaaagagagcaacaaattagcagtagcctttgaaccattttgatttagtttgttgatactccagtaaatctcattgaaaactagatagaaacatgaaaggtgtgaagagtttgatcatgtgtgctctggtgctaggcttagtcctgcagcagaagaagatccatgtgaaagctaagagctgctgcccatccacctcggcaagaaacgtctataactcatgccgtttcgcgggtggctcaaggaaagcctgtgctaaactatctacctgcaaacactttgatgggagctgccagccaccttacgatcacctcacccttaactatgatgggggctgctgcccatccagcacggcaagaaacatctatacctcatgccgtttcgtgggtggctcatatgactcttgtgctagactctctggctgcaaaattgattttgggagatgccagccaccttacgatcacctcacccttcactctgacacgggtaaaatggacttaactattaactctatttcactgttcttttgtactgttaattaaagtcgcaatatttttggctcaataattcttgcgtgcaagtagttgtcacgtcctgataaattcatcctgaaataaaaatcattttctaaaaggaataatagaattaattaaaattcgaaaagaaattggcaaacactaaaatacgtacaagaaaaattcaaatgtggcccggagaatttttgttaaattctccttggtctaaaaggagccctcaaattttacttgaattttcagagcaccggaaataattattaagcaaccaaaaacaattatcaaagtttattaaaaagaaaacctaaaaataatccccctcctccctttgggccaagtctggcccaaagtcctccctctctctctcggcccagcccaaagtctccctctcctccctctctttccctcctctccagggccttttcttccccctccgggccaagctccttcccctcccttttttctcccgggcctcccctcctgggccggccgcccggcccaagccgccccctgcccgagccagtcgcgtgcgcacgcgcgccgcacgcgcgctgacgccgcgcgcccgaccggtgggtcccacccacccggtcgtcgtctccttcctcccccagccggcctcttctctctcccgtgcaaacctagcgccgttcctcctccaaatctgccccattcaagccggctctttccaaattaattggggggttttaatccccattgaatcctcttcaattccccccaatttcccccttgaatcgtgcccccaatcgccgggaacgcccgcgccaactccggccaccttccatggccgccggccgcctttaccgccgccgttccgacctccccggtggccggctccctcccccatcctataaaatggaacccactctttgcgttctatcattttagcctcctcccgcgtcttcccgtggccgcaccacctctccccgccttctccttctctctctccggcgccggccggcctccagccgcctctccctcctcgcccgagcaccgtccggccgcgccgtcttctccctcggcctcgcaggtgcatcctcttccccggcgccgcctccgattcgtggggaaatcgccggagacgcgcccccaccggcgacagtggcggcaacgccactgttccgcctccggccgcctctgccgcgtctcccgtgcgccggccgacgtcgccaccacctccctcggcactgtgacgttgtccactcccctgtcctcacctcctccttgcccaaatctcgccggaacgaagtcctcgccggcatccagtacatcccctcacccggccggctactgttcctcgctagtgcaccggtcgacgtcgtcgccttcccttccggcatcgcagcggcaaggtcgtcctcggcatcgtttcccctccatccaaacccctccgcggtccatcatcgtcgtctccgttcgttctcgtcgtcgacgtcctgtcggtcgcccggctcgtcgtctcgctgcgtcgccaccgtcatcgtcatcgcagcggcgtgttccacgccgtcctcgtctccgtgcagccgctgccagctgccctcgtcgcctcctcgccggccccggcgtcgtcgtcgtcgtcctttcgtcgttcccggtcatcgtggcgttcgtccctccgtcgagccgtcctcgtccgtcctcggtgtttcatcaaggtcgctgcagcccccgtcgtcgtcttcgtcctcggctccgcgtctcaagcctcgtgccggccgcgtctcgccttcgtccaaggatcgccgccgaagtcgtcccctcgccgttcgtctctgtcgttcccggccgcctccgccgcgcccgttcgtcgttgtcattcccacgcctcgtcgcgtggtggtaaggatccctatccctcgctgcaccgtcctcatcctttcggtgtcgcccgtgcccgttgtgcggttgtcggccccggtacccgtgtatcggtgtcggcagtcgttcgcttgtgcgtgtggtgaccgtgttagtgtgtccgctcggtagccgtatggtttccacgtgtgcagcccgtgtggtgtctagtggagtccgtttgtcggccactcgcctcggttgacacacgggatctgcttctgtcgacccgtggaccgtctctgtgtacccggtctaccgcggtcctttaggttgacatgtggggtccgcatgtcaacagcgcagccttcctgtcttttccaggctagcgcttacacatgttntatagttgcaaag

SEQ ID NO: 7149 - DNA, 644 bp, Oryza sativa
  unsure (1)..(644): unsure at all n locations
gactnnnnnnnnnnnnnnnnnnnnnnnnnnnnnnntgagccattctacgggtaatgcaagacatgcggcagcttgactatggcaacaacatataattcccggagctatcattccagggggggaaagacacaacaggtctatccatcgactactacggctgtacggctctggcacgtactaaactacaccccaaggaagagccatgagctctcactaatcctggcgcgcaggtcaactatgtgaacgacccgattaactagcggatggacattactgttccgcgtacgcaacacaagtgtgacattgatatcactaaggacgcgtctaactacaaacaatgcgacgacaatccattattcacagatctacctaaccggatcaagcgagtttggacaaccatcgacgaacagacactattgcctagtggaatgatgggtgcggcaaaatgcaaaacattcgtgcatatgaacatatgggtatacactcatatgtatatgaatatacatatatatgctgactggcgggcggaccgcactagatgaatgaatataccgagcggtcgagataaatagaccgtacgggataattaggtatcccgtgcggtcctaatatattgacctcacgagataatggataatcccagt

SEQ ID NO: 7150 - DNA, 892 bp, Oryza sativa
  unsure (1)..(892): unsure at all n locations
gcacttgtggtcttttctagaagaaattttaagttggatcttggtggtcactcaattctagaaaatgacctagaagtgttgagttgaaggttgtggatctcttctgggatctttgcataagtgagccaaggggttaatcgagacccggctctttggagcacctcaacggagagtaggattcgtgtgatccgatcttcgggaaaaaatcgtctttgtctctcttgtgcatgatctttgtgtgaatctgctgatattctgcgatctttatcttgttcccctatgtgcctaaacttctcttgctaggacctgtttttcatctcagtttaatttatctctgctgcccggaagttcctggctcaagaactccggaagttctgggctactcatgctgcccggaagttccggtgttcatcaccaggaggttccgggccctgtcaattgaaccgatgcaattgttgagaaaatttcaggaaagcctattcacccccccccctctaggctacatctctgcacgttcaattggtatcagagcctggtgctcttgattcaagcttcacacctttgagtgatccacgatgtcggacttagggggaaagaacggggaaaatgaaatgaagatgaagcgagtagcaagggaactccaccacccaagggagctactataccttttgattacagcaaacttaccattccctctcacaacttcgtctccgtgccttcagggcgtgctcctcaatttgatcagacatattatgctgcttggaagcacaagatgaagggcatctaatctctttgcatccaagtatttggaatgatgtttgtacaggtattgatatannnnnnnnnnnnnnnnnnnnnnnnnnnnnnnnnnnnnnnnnnnnnnnnnnnnnnn

SEQ ID NO: 7151 - DNA, 516 bp, Oryza sativa
  unsure (1)..(516): unsure at all n locations
nnnnnnnnnnnnnnnnnnnnnnnnnnnnnnnnnnnnnnnnnnnnnnnnnnnnnnnaaacagaaacatacattatttttaacgagccttttatgtatgggactgtttatatatctgttgactgaaaatctcacctccaatctttaaaaattttgactgttggatatgctttgagattcgtgcacagccttaaccctaactttttcctcccgttcctctcctccacgcgcattccgccgccgccgccgccaccgccactggcccaacgcgccgctacctgcctcgccggcgggccgaagggagtcaacggtgccggcgaggtccccccggctgggcccctcccctccccttccctttcccctccctgtcctcttcttccctcaagccgatggaggccatcttccccgtctccgacggtgcggcgccaccatcggccgcctcctcctaacacatcttctgctttgcccccgccttctacaccagcccaccaccagcttctgaccccgccctcccgatcc

SEQ ID NO: 7152 - DNA, 738 bp, Oryza sativa
  unsure (1)..(738): unsure at all n locations
nnnnnnnnnnnnnnnnnnnnnnnnnnnnnnnnnnnnnnnnnnnnnnnnnnnnnnnnnnnnnnnnnnnnnnnnnaatttcagaatcagcagaaccaaggaaataactatgcacctcctcagaataagttagcagaatttcttcgtgtgaggccgcctattttctctagtaccactaatcctgttgaagctggtgattggctgcatgccatagagaagaagttggatttacttcagtgcactgatcaggagaaggtatcttttgcatcacatcagttgcatggctctgcctctgaatggtgggatcacttccgcctgaataggactactgctgaacctatcacttggcttgaattcactgctgctttccggaagacgcatataccatcaggagtagtgtctctcaagaagaaggagttcaggtcgcttactcagggatctcgctctgttacggagtatctgcacgagttcaatcgtcttgctcgttatgctccggaagatgtgcgtaatgatgaagagcgtcaggagaagtttttgggaggacttaatgatgagctttcttacccactcatgggtggagattatcctgatttccagaaattagtggataaggctatacgttaggaggacaagtacaattgcatggagcagaagaaacgtccgattgctcacttcaaggcacaacagggaagtatcagaaaccgcgccttactttagaccccagtctatgccacagggagg

SEQ ID NO: 7153 - DNA, 722 bp, Oryza sativa
gaacccgcatcggtgtgttaagttcctctcttattaacccatgcatcccgacaaatttcttggagatgaaagaatgcgttgcaccagaatcacatagttctgttgcagggattgagttatcagcaatcgtatccagtaggtcctgtggtggtgcttgtgcctcttccccatatgagtggttgacgtcagcctgtataaaccttggtccggcacgcctatgtttcgggcatttgtcatcgaagtggccaagctcaccacagttgaagcaggactttggttttgctcccgtctccttattggcttgtgcggtctggcctgtctgtgccggtgccatcggtgagcgtggagctgtacagcggttcgtctgacttccatggtcattctagctgccactggagccatggtgcaagttggtgtggttgaatgtgcggtgttgaccaacactcatggtggtaggtccagccttctgacggtgagtcaagtctggcttatggttacctccttgatgggcagtaagttgcgcagcttgcctcttcgtagccgtcgtgttgcgttgatcctcgtggcggattgccgtgtcaaacagcctctcatagtcggtgtagtcttcacatatcagttgattggtgagctcgtcatcagaaaaagacatgaacgtttcttgtttatcggcgtcggtccggacatcctctggtgcattcgggggtaccgagctcgaattc

SEQ ID NO: 7154 - DNA, 554 bp, Oryza sativa
  unsure (1)..(554): unsure at all n locations
nnnnnnnnnnnnnnnnnnnnnnnnnnnnnnnnnnnnnnnatttggcagcaggagagcttcttgaggttgcaactcctggaaaaggtttgcttcttatttgacatattggatatttataaggaccatgcccatatatattttcctcatggctgtattttttgtgtagttacacaagaacagcttgatcgagctaaacaggcaaccaagtctgcagttttgatgaacttggaatccagagtatgcatttctaaccactacttgaatcctttgtgcttatcttttgtttcctgttgtatccttgacactttgttttcttcactgcaggtcgtagcatctgaagacatagggaggcagattttgacgtatggggaaaggtatggttgcaccagcattggtaacatagcaacaaaagtcacctcacatggttcttaaacctttatgtgcactagccatgcattcactatcatttatgagctatgattgtgcaatcatgctgtgtcctgacaattttaagaacgggaactttagcatgtcattaaaatcatagtgaaacc

SEQ ID NO: 7155 - DNA, 907 bp, Oryza sativa
  unsure (1)..(907): unsure at all n locations
nnnnnnnnnnnnnnnnnnnnnnnnnnnnnnnnnnnnnnnnnnnnnnnnnnnnnnnnnnnnnnnnnnnttgtttaagtgttgttttggtgattttgttcttttctctttagattccgacgttcccggagagtccgattttacaggggaagattttgaagagtttcaaggccagcaaggcaagtcacacagatcccaaacaaccctttgagcatgttgatcatgtttaaagctattgtttttattcaactactgcatttatttttgaatgtcattgggtggaaataacctattgttttgttatagccctttttgttcttgattaccctattctttgataccttgggttattataacttgactagttgagctttatacattggttcagctagatattagatataattgcacactagtgggataacttatgcttcactattatttaatgatggcttaatgatagctcatgatggttaatcatgattggttaagtaattaatttgccaactaaaacctgataatggtgggttgtgagcatatggttttgatggttgtgctcatgacaattaaggaccggttcacgattttcggttgtgaaacatttaccgtgccatccacaaaccagcgtgggcaacggctttactttctgtatagtatggttcatagtagagcaccagactgtgaagtggcggagataagcccaccggggtcgctggggagtccataccttggttataagggggtgattatgatcccggaacggtgcactgctttgaattgtgttatgcaggaggtattgtcacaatctctattcggtacttggtaagtatcgcgacgcatggttgacatgatggtgaggttgtgtcttgtgggtacagtggtacacctctggctagagtttaaactattc

SEQ ID NO: 7156 - DNA, 1396 bp, Oryza sativa
  unsure (1)..(1396): unsure at all n locations
nnnnnnnnnnnnnnnnnnnnnnnnnnnnnnnnnnnnncgactctatgccgagccactgcttgctatgactcacatatcacaatcgactgggcttcttaaaagttacgcgctctggaggcatggccaacccaaacagcgtgccaccgtgagatgctttgcggtccgacttatctcaatcactaggatcacccgattgaacacgatcacaccttacatgatcgcaagcgggcccctaaacctacattacatgtgggcgaacgaaaggaacatgtctgttgtggaaggtactgttcgagaccgagatcatcctatggaatcgatgatccatgatcttacgtgaaggacaccacacccaacggtataaccctcgatgaacacgacggtgagttgactgggaagaggcccatccacttgaactgattctatgataaccactaccgagctgtcacggaagcacatatcggtgcgctggaccagctcgtcatcatcaagccgtacattgagggacactgttgacggtcggtaccgacagaccgcaccgaaatatgaccatactggacgagaactagtattagaccggaacaataatatagcactagcgtgcggttcactaacctttggcatagaatgaccatggagtgtgcgagaatcggtagcaaatcagacgataaatcaatcggacgatgtcgtgaatcagacttatgtataaatgggccaagaactcagaaatgacacgacgaattgggccaaattcacaagtctgcgaagaggacaagtagagtagcccaccagcaaagttgttggctgaatggccctgcccttggtttggctgttggatccagtttttggctggacggctgagatgaagcccctatgacggttggagggtaattccgaccattccaactgtcagaaccgtcatagtttagctataaaagggcttcatctccttacttcttccacacacctcaagcaagagctctctcatattctctcaagttagtttagtgttcttaagctagtggaataggaatagagtagagatcggaatctggaagctttcgaaagagttcaggtattgctctagtagctcttctattctcttttgtaagctttgtactttatctagaatactcttctttatacaattatggtattgaaatactttccgagtatatgaatgccaactttacatattgttcacgttatacttattatactgctagcttatctgggagatgctttggtgaaggtataatgtttgcgtatgcaattactctatgccatgacgatgatattagagtagtatctggcagtttagacgtggtgtctaaattannnnnnnnnnnnnnnnnnnnnnnnnnnnnnnnnnnnnnnnnnnnnnnnnnnnnnnngc

SEQ ID NO: 7157 - DNA, 1252 bp, Oryza sativa
gatattaaagcaaatggatataatagaattgtgttgacaatatgctacaacatggatggactaggctaaaatctagtcgggtttgccattgggctaaacccataaacaaggtgctaaatacatgaattttaatgggtcatcagctattttatgacgttttttaggctagataatgaaaaatatgagcgtcacaaagctatgacgacggaaggattgtcactagattaatagaaaaaaatctttcgtcatagaacgctattagagatgcatgatatgtcatagcctgaattttcgtttcaggatttataaattatttaataaattattaatagaatttatattaaatgttcattaatttacaagtgaagttaaatgtgggaaataaaatttcctaaatataaagcatggttggatttaatttttgttaaattctccatgattaattatactctctggaattttctcggatttttcagagctcaattcctaattttaataatataaagaatatttcagtaattattcatattaaattaatcatttaatgagctggtttcaattttgttaaatacttagagtgtccaagtatgttcaagatttttcttggaattatttgagtattgaaagtatttttaacaattgaaagatcatctcattggttaatttatttggaaaagcaataaaatcttccttcctagtcttgggccgaattcagcccattctctcccttcctctcagcccggccgaaagtctgtttgtggtccctgccgctacagtactccatcttcaagctccagccgtctcctgcctgtgcacgctgtagcagagcccgatgccgccgatccccttccaaaattcggcctactcgttgctcctttttccaaattagtttcgggaatggaatcctctcaatctcctcttccttttccccaggaaatcccaaaagtttctatggaaatcctttccaatttcgcggttcaatttttcctttttccggcgagaaccctagactttcccgagtttttcccgtcgatgtgggcttgatcccgagctcccgtgcctcgtcgtcctcaagtcccgtcctccgccgtcgccggaaacgctctccccgcgctcgccttcttttccacctccggccgccgctccagccgcagtgcgccgtcgcctcggccgtcgccagtcagcgcccccaccttccttcggttccgcaaagtcgagctctatcccggccgcttgttgtttttcgccgaat

SEQ ID NO: 7158 - DNA, 666 bp, Oryza sativa
  unsure (1)..(666): unsure at all n locations
tgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaaggggggagaaagatagagcaagaatgagtacaaccacagtactcagcaagccacaccggagatgcataattaatgcaagggagtacaaggggataataatataggggttgagttttgcagtaacagcctttaaaagtcacttagttgcccaaagccattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattaannnnnnnnnnnnnnnnnnnnnnnnnnnnnnnnnnnnnnnnnnnnnnnnnnnnnnn

SEQ ID NO: 7159 - DNA, 894 bp, Oryza sativa
ctatatacacgcctgaagaaatacccattttgagctgtcaccataagcggcccacctttcagctgcagcatatacccataatgataccccgtatttagacaccacgtctaaactgccagatactactctaatatcatcgtcatggcatagagtaattgcatacgcaaacattataccttcaccaaagcatctcccagataagctagcagtataataagtataacgtgaacaatatgtaaagttggcattcatatactcggaaagtatttcaataccataattgtataaagaagagtattctagataaagtacaaagcttacaaaagagaatagaagagctactagagcaatacctgaactcttccgaaggcttccagattccgatctctactctattcctattccactagcttaagaacactaaactaacttgagagaatatgagagagctcttgcttgaggtgtgtggaagaagtaaggagatgaagcccttttatagctaaactatgacggttctgacagttggaatggtcggaattaccctccaaccgtcataggggcttcatctcagccgtccagccaaaacctggatccaacagccaaaccaggggcagagtccatccagccaacaacttcgctggtggcctactctactgctcctctccgcagacttgtgaattttggcccaattcgtcgtgtcatttctgagttcttggcccatttatacataagtctgattcacgacatcgtccgattgatttatcgtctgatttgatgtcgattctcctccactttatggttattctctgcaaaaggttagtgaaccaaatactagtggaatattattgttctaaccaaatactagttctcctctattttggtaatactcagggt

SEQ ID NO: 7160 - DNA, 603 bp, Oryza sativa
ccaactaaaacctgataatggtgggttgtgagcatatggttttgatggttgtgctcatgacaattaaggaccggttcacgattttcggttgtgaaacatttaccgtgccatccacaaaccagcgtgggcaacggctttactttctgtatagtatggttcatagtagagcaccagactgtgaagtggcggagataagcccaccggggtcgctggggagtccataccttgtttataagggggtgattatgatccgggaacggtgcactgctttgaattgcgttatgcaggacgtattgtcacaatctctattcgggtacttgttaagtatcgcgacgcatggatgacatgatgttgaggttgtgtcttgtgggtacagtggtacacctctggctagagtttaaactattcgaataggcgtacccgcggttatgggcgggtctaacaatgtctttcgtgattagtttcacacctctcaccgtaataaataatgttgtaattggtaataacttggttagctcctggctaggaatggtatattcctggtttggagatagaactgtgcagccgggattggttgttcagaacggtttagcctatgcaaca

SEQ ID NO: 7161 - DNA, 817 bp, Oryza sativa
  unsure (1)..(817): unsure at all n locations
cccctacctagactttgattatacacgtgatgtatataaattgttcacatagttcttttataaatcttctcttgcgattaaataaatatgataccttgaaatacttccaggtgaaatgcaacaatggtatatccatgcgcttgcggattacttctgtaaccataaatataccaggattatttctttgccattacttggaatttatatttttagtaaagtcgttaagaaataccaacacctagacttttgcggcccgataagagctatttccgctgcattatataatacagcttaatttgggggggcatgtgttaacaacggaattttgcatcagactcaaagaggaagaatcaagatcgaagtggatttgatgtggaatcgagttggaacagaaatcggattgcgcatcggctagcgtcgtatcggcgggaaacatggcaggaagttcacctagccgataaggcgagcagccgatacaatatgacttgggctcggtattggcctagattagaataacttttattgccaaatagagatagagctcatttaaggcaattgtatctgttaattaagttagttatgtcgggttttgttagatttagcaagagaccactgtatatggtcttgtttgtatcttatctttaggaaggtttgagtcgtggctataatagactaactttgtactcggggtataaatatgaaccccatagctctgtaatacgggagacaatccaatataacttcggcgcatcgccaccctttnnnnnnnnnnnnnnnnnnnnnnnnnnnnnnnnnnnnnnnnnnnnnnnnnnnnnnn

SEQ ID NO: 7162 - DNA, 692 bp, Oryza sativa
  unsure (1)..(692): unsure at all n locations
acgaccggaccggcgacggcgcaaggctgaacgaactgcgcaacggcggcgataggctacacggcgctagagctctaccggcggcgaaaaacgaaggcaagggtgncggcgggtaaaggagacaccgggggtccttttataggggctagggggccgcggcgaaggcccacggcggccggcggcggtgatggaaaggttagggttcggagagagagaggaatccgattcgagatcgaatccaccgatttccaaacgatttagccgacgattccaaaagtgaaaagatagaggagatctcggggatcatttcccctctattaatttcaccggaaaaggaaagggatgaacgaatttggaacgagacggcggcgcggctcggttagggttcgggcgtggcagctgcgcgaggaagacgaagactgacaggtgggccccacctgtcagcgagcggtacgcgcgcgcgcgggcggcgctcggctgcgggctgacctgggccggggaggagagagagaggtttgggccgactttcggcccaaagccaaaagagagatttttaaaactttttcatttaaattattcatgaagtgcaattccatttattaaaaatacttccttagctcaaataaatcccagaannnnnnnnnnnnnnnnnnnnnnnnnnnnnnnnnnnnnnnnnnnnnnnnnnnnnnnnn

SEQ ID NO: 7163 - DNA, 11024 bp, Oryza sativa
  unsure (1)..(11024): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattttatccaaacctttagttggctaaaatgatatatttatctacatatgactagatgttgtggcgtcttaattttgctttttaccaggacaactggttaagggaaatataaagcacctgctgcatatgaggagcaccaaaagtaatatgtagaaggccgtgtgtggaattttgctacaaacgcaagatttctgcagtggaatttggttgtgtttcttcatctactggttggatgcggaagcttatcatgcaggtaaacgtctgctgctactcagagtagaagcatctctgcaagatatttcttatccattttcatgtcaatactcataaggtgcaattgaaccatgatgcataaatatctttacaactatatctgagaaggaattgttgataatttgtttctgtttcagtagccaaattgctgaaaagtagaaacattggtattcaggcgaaggtattccaactttacttttgggtagtttgtgaatatgggttcatttatgcaaaccagaagtggaagtgggactcataagatattagtgtataatctgcgatacatgtacttgaagtggaagtgaatggcataatggctttgcttaaaattagtttcaatatggcatgatacgagatgccattgtcaggacacttatttaagcatgccattgcatgatatatatatctgttcttcacatccagtacaccggcaggtactccttaatttcatttcattgagcttttgtacaatggttctcagaatttttttttgttatattccttaatggcttcactcaaatgcttcttgcaggggaagaagagttatatgcagcccatttaatttctaagatttttgtagacagcatcagatagtactgtttgttgtttgccatggaggtgcggcagcagggcaagtaggaacacatgtatactccattccaaacttataacttcactaggccatgcaaacttggataaaataagttaagtattggatggatggaagttgcttctatctatactataaaaaacccttgtagctgattcggtgtgggttgttgcgcccctcgaaggtactcttggcagccaccgtgtattgatctgatcgtcttgatcacagacactgaaactttatagcggtgacttttttcggtggattaatttgttaaatcaaataccacatatattaaggtaaggtcaggaaggctgcggcttccacttgattggtactccataatagtgccaagtaaaatcagtctcactctgtagtggtagttgaatgaagttcagttccttatagtatatgttgcttttcagatttttgtttacttctcattctgtcagaccaaatcattctacagaagaaacaaatagcacatattttattagtctgtagagaaacttgcctttgcaatgacatagaatgtactgatacaatcaatacatagtgtaatgagatgtatatataagattagggcctggaatgtgtgggaagtaaagtggattgggacatggtctgaatccaacgattagaaaattaatgttagggaagataaacatacaaatattatacagataattttctaaagctatgtttcttgacatcacttgttctggataaatatgtatctcacattcagtgatagcatgtttatctttgtctcttgctgattagggttgcattattttagttaacatatttcctgtacagaagagatactggatggtatatttatctttgcctcttgccgatcagggttgcattgttttgattaacaacatatttcctatatagaagagatatgtaataacactgaaactcattaggtctttatattaaaaggacatatttcttagaagagagcttatctaagcatggaagcatggttgaggccaaaaatggcattggaagagagcttgtctatgcatggaagcagggttgaggctgtgctgtagcatgtaggttgacaacttgacaatgttaaatgaaggttgtgccaaagtggcggatgctacgacgaagcaaacatattaaaattaataaagttgtagcagtagaaagataatatgaggtaatactgcatttctttttttctgtacacatgatgactcaactataatcaaaggatgtagctggctatttatacttcagatggccttgatagaacttttggctcgcggaaggatgtatgccgctggaaagcagaaacgcatcaggaatggcttgcagcttgctgacaaatacttagcttgaatgcttgaatcagcgataaccaaaagagtattatagtcacggcggtatttgataatgcaaatcaaataatcaaaagacaatatatgtttcagtaaaggagattgatttaagacatgcaaaagaagtaataatgataagaagagttatatattttgttgttaatacgtcctgttataaatatttgaggtttactctccagcagggtttacaagaaaaatcaaacttattagactggcaaaaatgtttggttttgtgttttcagcaagtttaaaaattcgaactgactttaaatttttgacaaaattcaaccatattttaccagaagtcaatgttttttttgtagtaatcagttgggtcgttaacggtgcatacttaccaaaaaaagattcatacttgtctatcttaatttcttgaggaataactcaaccattcttttttgtgtggatatgcattgtcctcatacagtgtatattgaattgattagatataatcattgatgatcttgaataaataattttaagttatatcataatatttttttttgatatatgaccttcatatagtgtatattaaattgattagatataatcattgatgatcttgaataaataattttaagttatatcataatatttcttttttatatatgaccttggactgaaagcttaaatggacagattctaggaaaattattttcattgcagtcgaattttaataacttattaagaaaaaatgttatgacaccgtaacgttagtacggacatattactattaagatccaaaaacaattaaaatcactccacaaccacatgatgcatttaaattaaatttagttctcaggtttataggcttgggtatgttacagtcgtggtgtagatttgaatgccagttaaattttaactgatattacctgtggcaataatagttaaagttttacttctagccgatagttaaagcttttggatacaccacggagaattttagtgtgtttgctactaatagttatttttaactattattacgggcacacgtacgagtaagtatacatagattttcttgaatccttttatttaatctcagcagatcgatggtcaggatgggaatggcgagtaattctttaacttaatgcttcgtaaacttggatggattatgtacaggttgccccctatacgcgaaactagtttttttttactcatcatcgggttcgtgcctgcaagattgatttgtgcttttgagagtaatttttttaactaatattctgttcttccagtgaagcaagctacgtccgtttgttgggcaattgcttgactcttcacgtaataacctttgaagtgtttgaaaacattaggcgggatgaaaaaggagttatttttttaactttactcacagtggaaacacggattctttttcctcatagatagtggggtatacatgttcagttaaaaagtaacttgtgtgttgactctggtgaattcattgaatgtaccttgccgaagtcaggaccttattggttgtgctaggcgagttaaaaattgactccaataggaggaaacacaaaaaatagggtttttgtttttcagactagtggattgaagttgacaggtaccaatagtcataatgcatgccgagcaaaaacacatgtcaggatatgcaccaaccttgacattctataaggggtcatcacactaaccagtaccattcgaaatgtacagtgacaaacaccaaaagaaacatatatagtgagaccacactagttctaagctatggtaaagacatcatgtatcccaatgaaaaagtttttccaaaaaggtaaagcatgactgtttttttaggccgcaggatcgataacatcagttccgcggaacttctagatatcggaatggagaggcgcggcttggttgtactcgctgaacatcagctggtgcagggtgcttgaccggacaatcaccgagtcagtctgcaaaacacatgttggacgtgaattggtatagaatagtgtggaaatgaacgacgaatgagtcagtatacaaatgtaagggggtgattgctatagttaccgggatggaaagattctcgatggattccatgttgccgtcgtaagcctccatgaaccgcatgatatagaaggcgcagtcgatggagcaaatttgtatttttgggcactccatcatgttcttcctaaagccgccgaacctgcagaagctcttcggcactaccgcctgcagcgcatcgctcagacgcttgacgatgcgtttggccaacgcaccatggtggtcgcttaccagtgttccgagcaaagtgtagttgtttgtatccattatgtcaaccagcctgtgtgcaatgttgattgcatctagagaccagtgatagtggtggagcacaggaaccattatctgtccattcagtgtttggaagtaaagaaacgaaacttacaatagcattgctgggtttaaaagatgctcgatgcaggggaaaaaagtagacatggcattagtctttatgcaaaaattaataactaaccaatgctggatgtagtcgcgcaagtttccggccaaagcatcagtggaaaatttgtatctttccattttgtttgataaaatcaatgttcaggagaaactgcaaaaaaaaaaaagtgtggccatgtgttggtgtgaaccaaaagagtcacatctcgcgaaaaaaaagaacagaaaaacaatcatgttgctgcaccgtacgaaaaaaaggaatacagtagaaattggcgttattcacgttactgatatggaagtcggaatgaaaatcctttttccataattatctagcctgtacttcatgtcatccttgaatagaatcgagctgaacacgtctatgaaaagctcctctgtcaggctcccgtcggagaacgattccagcacattgtttccatacgcaacagagctgtcgatctctagcagtttcacgctgcaagcataccagaaatattaacatgtaaacccgtaatctaagcaaggaaaaaaaaggtggtccgcgaaaaaatatgatgcaccatatgcacatcatcaaggtgatgatgaacaccaacctgtccatacgaccaccattggtcagtaagaagtgcctgagctggatgctaagcgacacgtccgatgacggcataccggggccaacaaccaccggcgaaacaaatattgccggctcttgtatgaaccgctttggcagagaccatggcgttgaatttacgtcgttggtgtcaggcatggtctcgggcaaaagctgccaaaaaaacacaataattgtgtaaggggaaaaaatgttaaccgaaagtagaggacgatcggacaaagtataattttaactgccatctacctgtgtatcgctgtatgaaccatcaaagcacagcacaatataagagttgactgctcctttgatatgtagcaaaaggacagatagttgtaaacttgggtaagaaaaggtttgcagttaaaagataactaccagctgtgtcattgtgataagtatagtacagagttttcctggtattagttaattttttcctttaatttttggtagattgtgctatagcagataaaagtttgtgatgatcctaacaaaaataatgaactaaagagtttagttcaaattttactcataatgatattttcttgatttctcatccatttccagtgaggttgtttatttgaaccactagcttagtggttccttgatcagtgaagttaataaatgactatcttactgcagtttgcaactggagaaaacacctcacatattgcctcagaattaaacttttggtgcgtactgtttgaccaagcagacaatccctaagtgctcatgctcaagttgatgacaaaaaaaaatgtgtccagaggaaacccaaactacgagaatatgatttgatgcaatgaagcacaagtgaactcgacgaatgggatgtttgagaatacaaccacggagaatgtaggagccccctcgagcctgcaaatctccttgattttctcgttcacttgtgtgtcgatcatgtccgtgtccggcggtagaacaaatgacggtgacggcgtgacggaaagaaattgcgaggctgcgaagtaatgaaatgtactacaaggatatcactttgctgatgtatgtataacgatataatgggtaactaattctccttacatcgcgtggtatcttcggcgtggggcagctcagttgtttcctccgtcgggtgagattgttgttcaccggcactagtagcatgttccatatgaatgccggttgaagcaactggatcaataccaatcgcacacacagcctcgacgcctagtgtgtcttccacggtgtctggcgccttggatcttgagcggcaacttcctcagttgtgaggggtgcgctgtccgtgggggtggtgtgcgctgtgtcagaaccggtgagtcagcaatccaagactgggcctgatctgctgcatcatgacgcacaggaggtacgtagggcacaatttgcatgcatgggccggctcacttgcgtgggatcgttagggtgatctgtgtgttgatcaagcaaactcggtttagcgacgcacccatgctgctgcagctgctattgctgctgctcatcctcttcattgggattggtttcggcgccggtgggttgcacgttgctttgcctccggttgacttcttggcatcgggcgggctgaggcacaatgggttggggtgctgctgctctgtttgcttgtggcgcatcaattacacgctgacatagcatatgctgcttgtcaacaactatcctgaaatggcgctcgatctccactgcactctctttcgcctgcctgtcgtactcggcaatggattcttgcaagctactcctctgttcattaggcaacccacctaggtgtggccagatgatggcagacatatttgggaaggtgtacgccggcgccctgatggcttcaaccattggccccttccccttgccgggttgcttgatagcatagcaagtgctctccaacggtcgcagctgtgaggtacaaacagcgcgttagtaaaaaaaaatgtatatgcaggattaccaacgaatatacgataataggggtgcattgaaagctatatagaaatgaaaatgcaagtgcattgttcaggagccctcatgataactttatgattgggttttagtgtacaaatttagtgatcattaaaaatacccgcgtacgccggccccagtgtatgtgagcacatgaatttttattaatggaaaggaaaatggggaagaaggaatgtgaaacacttacagggaggttgcaaaacgggggcgtgccatcccctccagcttcctgatccgcactaaccagccgatcgacaatctccttagtatacacgtgtatacgaggggtgaacactagatcgagaccaacgtctgttggtgggagtatgttgtcaagatataataactgtgcaggaaggtagaatgttagtgagcattgcatcatatccagtaaaccggcagcaggcaataaagcgtcattttgcgagtaagaatttgggccaaacaaagtataaatgagaaaaagggcttaccaccggtaagacgacgcacgaggctattgacgatgtcgggttctgacgccaacacctgatgttgtcactcaaagctcggaacatagccgtagacaagtcaatggcagcgacccggtcgagatcggcggcaagccagacatcactcttggggacaaaaaagtcagttcttggaagtaggagcttgaaacatcacggataactcttatccgtgacgggtcttaactatgacccgtcatagatgagtttgggtcttttatttaggcccgataaggatgacggtcgtccgtgatggtggctgacccgacacatatgacttttcacattaataacctttggttcgtgacagtacccctcgccgacacagataaggcttcccgcctattacagatgagctatcctgagctagtgaaccaatctgaactgttgtgactactacaaaaaatagttttcgctggcggccagctggccagaggtgctgccagtgagttgtcacgcccggaatttctatccaaaattctaaacgcttacatgtatgtaaaccctcgtccaggaatcagccgaggcacacaataacaaattgataatagagtacaattattactctaattaataagcgaataaaatgtcattacagaggtagatagttcctctcaatcaataaagttctgagcagcggaaaataaaagaaacagcgcaggcgactcctcttcacaggtagcttgaccagggctacacctaatcatccacaccattagcatcactgtagaactcctcctctgatgaatgattgcaaggtgagtatatgacatactcagcaagccacgcagcaaatatgcaagtgcacaggataacaaaggatggcatagtatagtctcatttgcataaacagcatttaataagcaattgagaaaatagtaaaacagttgagtaattaaacaatattaaatcaacactatacaacacacccgtgttgcataggcccaaccattctgaacaaccaatcccggctgcacagttctatctccaaaccaggaatataccattccaaaccaggagctaaacaagttattaccaattacaacattatttattacggtgagaggtgtgaaactaatcacgaaagacattgttagacccgcccataaccgcgggtacggctattcgaatagtttaaactctagccagaggtgtaccactgtacccacaagacacaacctcaacatcatgtcaaccatgcgtcgcgatacttaacaagtacccgaatagagattgtgacaatacctcctgcataacacaattcaaagcagtgcaccgttcccggatcataatcacccccttataaacaaggtatggactccccagcgaccccggtgggcttatctccgccacttcacagtctggtgctctactatgaaccatactatacagaaagtaaagccgttgcccacgctggtttgtggatggcacggtaaatgtttcacaaccgaaaatcgtgaaccggtccttaattgtcatgagcacaaccatcaaaaccatatgctcacaacccaccattatcaggttttagttggcaaattaattacttaaccaatcatgattaaccatcatgagctatcattaagccatcattaaataatagtgaagcataagttatcccactagtgtgcaattatatctaatatctagctgaaccaatgtataaagctcaactagtcaagttataataacccaaggtatcaaagaatagggtaatcaagaacaaaaagggctataacaaaacaataggttatttccacccaatgacattcaaaaataaatgcagtagttgaataaaaacaatagctttaaacatgatcaacatgctcaaagggttgtttgggatctgtgtgacttgccttgctggccttgaaactcttcaaaatcttcccctgtaaaatcggactctccgggaacgtcggaatctaaagagaaaagaacaaaatcaccaaaacaacacttaaacaagcatgaacagtacatgtggatatttttaacatgtagatctcaattttagaaaaatttagagacttgaaccaacaaaatccgagctaagataaattagttatgaattttcaaagattaaatcggattaaatcatttatatggattttaattgaattatgacgcaataatgaattatttttgaaaaggaaaaagagattattgcgtcagcggctagggttcacggcggcggctcacggaaacgaacggccgggatcgatctatccaaatcagacggccgagatctaaacggtctacgaccggtctacggcggatggcgtcgatgatgtcagcggtgacgtcatcaccggcgacggctcggacggcgcatgctcgccggcgaacgacggcgcggcggcgcgaacggacggcacctacgggttgcgggcgacacggcgaactcaccggtgaccaaagtagcggcggaagatcaacggacggcgacggcgtcgaggaagaagcggcggcgtccttcggcttgacgacgacggcggtgcttcggcgacctacagagacgacggaggggtggacgaggtcggcgacgacttgacgatcacgatggcggccttcccgagcgacgacgacgaccggagcggcgacggcgcaaggctggacgaactgcggcaacggcggcgctaggctacacggcgctagagctctaccggcggcgagagacgaaggcgagggtggcggcgggtagaggagacaccgggggtccttttataggggctagggggccgcggcgaaggcccacggcggccggcggcggtgatggaaaggttagggttcggagagagagaggaatccgattcgagatcgaatccaccgatttccaaacgatttagccgacgattccaaaagtgaaaagatagaggagatctcggggatcatttcccctctattaatttcaccggaaaaggaaagggatgaacgaatttggaacgagacggcggcgcggctcggttagggttcgggcgtggcagctgcgcgaggaagacgaagactgacaggtgggccccacctgtcagcgagcgggacgcgcgcgcgcgggcggcgctcggctgcggg

SEQ ID NO: 7164 - DNA, 13553 bp, Oryza sativa
aaatcggtgccgccggccgccacagccggaagcaccgtcggctgtcgtcgcgacacctcaccatggccgccgcctaccgaagcccgcaccacggtattccaaaccgtagaggggagggggttggaatagccttgccatcgttatcgtggttgccgtcctcggcgcggtagacatcgttgtcattgtggcagccgccgccggatccacctccttcacggttgtgaaggacagcccgagcaacgccgccaccggatccgcacccaccctactgtcaccgtcgctgccctccccgccggcctcccccattgtcgcggcggctgattcggcgtccacggtcactgcggcggctgatccggtctccccgtcgccgcggtggtggatctggccacccccatcgtcacggcggtggatccagcctcccccgttgtcgtggcggccagcagcgaaggaaggccggtgggagaccggggggggggggggagggaaagaaggcgtgggccatcgcagtttgccggccgcctgtcaccgcgccgctgttgagccaccccctcccctgcaccgctgcagccgagcaccgccaccccgtgccgcagccgagccaccccctcccccgccgccccgtgccgccgagtgctgccgtcggggccgccgccgctgcctacgtgagccgccgctgccggtggggtgggaggaggagaggagagtagtggatggatttggatggagaggaaccagaaaaaaaggaggaggaggagaagcgagtggatggataaggaggtgggcggcaattttttttaagggaaacgcgcacggtgattttttttaatgtgcggggattttttttaaggacgatgctgcctagtaaccgccagcgaaaatcagtattttgactggctgtcttttaagagatcgcttgtaaaaacataggtattttttcaagcggactttaagcaaacgctagcgacaattcattttcactggcggtcctaaactctccatctcttagttacaatttcacaagcagatttcttatataaccgccagtaaaacaaatagagtaccgccatgaaaaatattttttctagtagtgcgtggcacatttcaaggattcggccgcgtccagttataaagtttgttgatgacaagaagttgtacgttggtcagaaacctgcattagcttgcaaatacccaatcctgatgttctcatggatcgctactgttgtgctcgagtgggctctaatgctactgatatgtttacatatatgtacctatactaacatgatatttactagatgcttccaagttaataaaaatatctagccaattattagctggatatgttatactatcatatccattgatcactaaatctatgtgtgtttgttatagacaatactaaaatctgtctatcctaccccacttctgaaacccccatctacttctaaatcccatccgcgtgtttcatcacttcatgatgtaaaataaaagtattagttgccggtctatatgaatattataacacacaccgtgttcaattaattaatatgctgcatttacctgtagtacatgtgtatttatatattgggtatatccatgagtaaaatatttaccggttgcacatgatatattgtagttacatgtgcaaatataattgcatgtaagttaaaataaaattacaccacaattatactataatttatatctgtcaaatttttgaaagaaattcacaactacaacaacaaactttctgtacgaggacccttggcggcgtctgcaaaaatgacctccattttcacatacggctacttaatagacccgcatgcaaaaatctattttcttagacgagcctcttaaggggctgcaaataaaaatgagcctattatcgcgtgcgggcctcttaaaggtccgcatacgaaaatttatttttgcatgcagatcttttaagggtccgctagcaaaaaaattttcctcctcaccgcttcaaaatttttcacctttcatcctctcctctctctcccctctgatattttccaccctctcttccttcacctctatctctctttcattctcttctctccctctctttggccctgtttcgttcaggggtgaaaagtttttgcgtatcacatcggatatatggacacacgtttgaagtattaaacgttgtctaataacaaaacaaattacacattctgctcgtaaactgcgagacaaatttatgaagcctaattaatcgatcattagcaaatgtttactgtagcaccgcaatgtcaaatcattgcgcaattaggcttaaaagattcgtctcgcaatttacacgtaatctgtgtaattagttttttttgtctatatgtaatactccatgcatgtgtccaaatattcgacgtgacgtggtgaaaagtttttgtctagcaactaacgaaggcctttctcttcctctcctctctcacttctatcacgggtggcgaggccgacaagaaggcaccgggagcgggcgccgccgctgcattcacggccaggagcggcgggcagcgcggccgatgaggaagtgctgggagtgggctccgctgcagtgcgggcggccaggagttagcgatgccaccctgcgacgcagattccggcagcggcgctgggcgaaggccacggcggtggccctccccagcccagatctgccggcggctgccctcccccgccccgatctaccggcggcgaccctcccccgcctggatccgccggccgccgccctccctgcccagatccaccggcgtcagcggcggcttgagaacgacagcgatagctggaggatgaggacaggaggacgacggcggaccggcggtgggtatatttttcaatttttggaatttttatttttttcgtgatttatccttttcgcatgcggccggctcaagtgtccacatgcgaaaattgtgttttttgcagaccttttcttccatgccatcgtctgtggaaatacgttttgcccgtttacaaaaacggttttcatagtagtgaaaatttgtcaacaaatacatatataaaaatacatatataggtagtctctaatgtgatctataaacatgagttatggattttctgagcagctatttcggactaagccttggggatgggaaaaatccaaatcatttagaaatcatgttttcttttgaaagttggatgacatgttctgattaaagtaacattacaacagtaaccgaaacttattttacattttcatgcattgtgtatatatgtctgcacaattgatgtcccattgcagttcacccacactgcaacaggaaattattttcattatgtcggagcaaaatagtgtacttttttgtgcaccaagaaattagtgtttgatatatacatgtggtaatagagaagatgatgttgaactgaccaacgtctccatcaactaatagttgagatgcaatgtacttgctttactcttgtttactcggaatattgaggttagtcatactattattttgaggtttgtttacagggtgcctttgtaatttttttttcttttgagaaacaaagaataattagcataaatgcaaccactcgtatcaaatctaggatttgaactcgggtggattggttccactaaaagaaacctaaccagttgagctacgctcgcttagcaagggtcctgtctgaccggtccactccagcagaaaaacttgttcatcgtcagatatctgttcacaatatttgcccagtctgcccagccccaaaaccacttcatcaccatatatttctaaatatcataaccaattatctctcgtgccaattgttcatcatgaaataataatcaaaacacacttttatttcacatatgccaatgtgtatttatgtttgtggaaagcaaattatcatttgctttgtttaggctaaaaatgcatctaaggctgcgttcagatcagcgttcacaatatttgcccggtgtcacacctgaaaattcaaaatttataaattgttgtttaaatggaatttttagaaataattttaaaaagtcttgaaaagaaaatctaattttaattaataaattccaatataaaatgggcccagataaaatttcattaaatactttgcttaattctataattcctagatttttctgggatttatttgagctaagaaagtatttttaataaatggaattgcatttaagaaataattttaattgaaaaaggttttaaaaagtcctcttttggctttgggccgaaagtcggcccaaaatctctcttctctctcctcggcccagccggcccagtccgccgcagccgcgcgcgccctcgctgtcgctgacaggtggggcccacctgtcagtcgtcgtctaccttcggccgccgccgcccgaaaccctagtttcgcgctgccgccgtttcccttccaaatccggccgttcctttccttctccggccgaatcaatagaggggaaacattctccgggatctcctctaccttttctcctttggaatctttggctaaatcgctttggaaagagttggattcgagttcgtctcggatttgttcttcccgagctttccttcgccgttgccgtcgccgtgggccttcgccgccgcctccgagcccctttaaaaggacccccggtgtctcctctacccgtcgccactttcgccttcgcctctcgtcgtcggaaaagccctagcgccgtgtgccctagctttgccgtcgccgccgctgctccagccgtgcgccgccgtcgctccagccgtcgccgtcgctcgggaagaccgtcgtcgtggtcgccaagtcgtcgccgtcctcgtccgccccttcgccgtcgccggagatcgccggagcttcgtcgccgtcgtcaacccgaaggtttccgccgtttcctcctcgtcgccgtcgtcgtccgttgttcttccgccgccgttttggtcaccggtgtgttcgccgcgtcgtcctctacgtgctggtgccctccgtttgcgtcctcgcgccgccgttcgccggcgagcgtgcgccgcccgagccgtccgttccgccgagccgccgccgctgtcggtgatgtcaccgctgacgtcatcggggtcgtccgccgtgagccggtcgtggaccgttcgatctcggccgtccgttttggattggatcgatctcggccgtccgttcgcgtgaaccgccgcccgtgcgcccggtccaccaaaaccctagccgctaacgcaataaaccctcttttccttttcaaaaataattcattattgcgtcataattcaattttaaccgatttaagtgttttaatccggtttaatctttaaaaattcataactaattcatcttagctccgatttagttggttcaagtctctaaatttttctaaaattgagatctacatgctaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaatcctttgagcatgttgatcctatttaaagctattgtttcttttcaactattgcatttattttcgaatgtcattgggtggaatcaacctattctttgttatagcccttttgttcttgattactttattccttgataccttgggttattataatttgactagttgagctttatttatattggttcaactagatactagatataattgcttagccctgcttagaaacattagcacactattgggataattaatgactcactgttatttcatgatggcttaatgatagttcatgatggtcgattgtgattggttaattaattaatgtgccaactaaaacctgataatggtgggttgtgagcacatggttttgatggtcgtgctcatgataattaaggaccggttcacgagtttcggttgtgaaacattaaccgtgccaaccacaagccagcatggacaacggctttatcttttgtatagcatggttcattgcggagcaccagactgagaagtggcggagataagcccacgggggtcgctggggagtccatgccttgtttataagggggtgattatgatccaggaaggtgcgctgcagtggattgtgttatgcgaggggtattgtcacaactcttttccgaggtaccgtggtggtattgaggcacatggtgacatgatgtggggttgtgtcttgggggtacagtggtacacctctgatcagagtaaaactattcgaatagccgtgcccgcggttatgggcgggtctaacaatgtctttcgtgattagtttcacacttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgttaaattaattaactgttttgttaaattctgaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggagtggaggattaggagtagccttggtcaagctgcctgtggagtggagccgtctgcgccgtttattttattttccgctgcttagatctttattgtttgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttacccatagaagccctctaaaaatattggaaaagtagaactgttctcctccctttctcttttaattaaaccaaactaatggcacatgcacttcataatctcttttaatggttctcattcaaaatttattccagtgttattagtactgtacatccattactgtactaatggctcatttatcagcaaaagttttacaatgttgttttatttaatcttgctgcaataaaataaatttagcatgttgattttataactttcttttgaaacctgttgttaaaaagtacaaaatttgtaaccttgttttcaactatttcaaattatcttgcaagtttggtttactttattcacttaccttttactttgaatttctaaactttattcaaattaatccaaaaacttgtgctattaattggataaaggtcttaactccctcctttcacttgtctttagatgccgcgctacaagcttgagtacctgtttggtgttgagggttttgtccaggagttgcgtacgatgtcctttgccattggatttgggactgcccctttttatgcccagattcctcatgatcgtcatgaagagaagtgccgagtcaaagtcaccttgaacagcaatagtgaagagatcccctcagtgatgttcgaagctggaggaagaaactacatccatgcatgtcaggaagtggcaaggattgccataggagagctccgtgatcgctatagtgatcagttggccgacactgagtatcgctaccatcctcgtcaaccccagggaagtgaccgtggcagctaccttgagactgaaggaattgagaatgatgctaccacaaggcatttggttgagatgctgtgggctatggatgaaggtcgtgcggagactgtgttagcggctcaagatcgtgaagaccggaatcgtggtaagatttgcaagttagaagacaaggtggatcgtttggaaaaggaattagccgcgttaaagggagaagcaccgccgcagaaggccaggattcgtcttaccgcaaggaagagagctttatttgtccctcgctatcaattggcgccaaaggtccgtgtggtggagaaagaagttgccccatcccaagcggatccttcggtcatcatcataagtgatgaagaagaagaatccaagcgcaaccattccaagattgagtgggtagcaacccaagatgatgaagacgagccgaacgagccttcaatcgacctccaatgcttggaagaactagagtgacttgttaagtcgttgtcttagatcgttgtgttagtttgtttgctttaagtttgcttgtgtgtggctcgcatgtgatttacatcagtggtgggatgtaattgcatgtgtttgtttgcttttgagtgttaggaagttggtgagtttagtggtgtgagagtcttcagtttgtaataatgaaactcagttaagatcaataaaagttaaagtaattctctatcctaagtagttccccggtttctcttcttgtgccctgttcctgccagatggtgaacactcgcagcaatgggaatggccccaacaaccccaataacaataacaatggagagaacccaactctggcccaagttcttgctcaacagacacaactcatgaacatgatgatgcagcaatttcagaatcagcagaaccaagaaaaaaactatgcacctcctcagaataagttagcagaatttcttcgtgtgaggccgcctattttctctagtaccactaatcctgttgaagctggtgattggctgcatgccatagagaagaagttggatttacttcagtgcactgatcaggagaaggtatcttttgcatcacatcagttgcatggctctgcctctgaatggtgggatcacttccgcctgaataggactactgctgaacctatcacttggcttgaattcactgctgctttccggaagacgcatataccatcaggagtagtgtctctcaagaagaaggagttcaggtcgcttactcagggatctcgctctgttacggagtatctgcacgagttcaatcgtcttgctcgttatgctccggaagatgtgcgtaatgatgaagagcgtcaggagaagtttttgggaggacttaatgatgagctttcttacccactcatggttggagattatcctgatttccagaaattagtggataaggctatacgttaggaggacaagtacaattgcatggagcagaggaaacgtcggattgctcacttcaaggcacaacaggggagtaatcagaagccgcgccttactttaggaccccagtctatgccacagggaggttcttcatctgttgttcgtccgcagcgtcagttcttcaacaacaatgctggcaacaacatccgcaatcaagctccacgtcctgttgcagctccaacacagcaacaacctgccaagagggagcaaggcagcaagcccgtggtatgtttcaactgtggagacccaggacattatgctgacaagtgtccgaagccccgtcgcgtgaaggttgtccctgctcagaataactctgctgtaccagcatcaaaggcccgtgtcaatcatgtcgctgctgcagaagctcaagatgctcccgatgtgattttgggtacgttccctgttaactcagttcctgcaacagtacttttcgattctggcgctacacattcattcttatctatgagttttgcgggaaataatgggatggaagtagaagatcttagacgtcctttgatggttagtaccccaagtgatcaagcactctctttgcaacgtagcccctcggtcagaatagaaattaagggagtaccatttctggccaatcttatcttgttagaatccaaagaccttgatgtcatcctagggatggactggttagccagacataaaggtgtgatagactgtgctaacagaaaagtaactctcaccagcaatgatggtcgagttgtaactgttcatgcattgtcatctgagtctttaaggtcaagactgaaccaaataactttggaagagattcctatagttcgggagtattccgatgtgttcccagatgatttacctggaatgccgcccaaaagggatatagagttcagaatagatctggtaccaggaacaactccaatccataagagaccttatcgaatggcagccaatgagttggcagaagtcaagaggcaagtggacgatttgcaacagaaaggatacatcagaccgagttcatcaccatggggagctccggttatttttgtggaaaagaaagaccatacccagagaatgtgtgtggattatcgtgcactaaatgatgtgactatcaagaataagtatccgctgcccagaattgatgatttgtttgatcagcttaaaggtgccactgttttctccaagatagatcttcgatcaggatatcaccagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacctagacaagttcgtagtggtctttatagatgacattcttatctactctcgaaccaaagaagagcatgaagaacatctttgccttgcattggagaagctacgagagcatcaactgtatgctaagtttagcaagtgtgaattttggttgtctgaagtgaagttccttggtcacgtcatctcagccggaggagttgccgttgatcctagtaatgtggaatccgtaaccaactggaaacaaccaaagacagtttcagagattcgcagtttcctaggcctcgcaggatattaccggaggtttatagagaatttttccaagattgctaagcccatgacacgactgcttcagaaagatgtgaagtacaagtggtcggaagaatgtgagcagagttttcaagagttgaaaagtcgcttaatatcagctcctattttgattttacctgatccaaagaagggtttccaagtgtattgcgatgcatccaaacttgggttaggttgtgttttgatgcaagatggcaaggtggttgcctatgcatctcgtcagttacgtccgcatgagaagaactaccctactcatgatattgagttagccgcagtagttcatgcgttgaagatttggcgtcattatcttttcggtactcgtacggagatgtacaccgatcacaagagtttaaagtatatttttactcagccggatctgaacatgagacaacggagatggttggaattaattaaggattatgacatgggaattcattatcacccaggaaaggctaatgttgtagcagatgctcttagcaggaaaggttattgcaatgctacagaaggacgacagttgccattggagttatgcaaggaatttgaaagattaaatttgggaattgtcaatagaggtttcgttgcagccttagaagcgaagcccactctaattgatcaagttagagaagcccaaattaatgatcctgatattcaagaaatcaagaagaatatgagaagaggaaaagctatcggtttcttggaggatgagcaaggaactgtatggttgggtgaaagaatctgtgtccccgataacaaagatttgaaagatgcaattctgaaagaagctcatgatactttatactccatgcaccctggtagtactaagatgtaccaggatctcaaggaaagattttggtgggcaagtatgaagcgtgaaatcgcagagtacgtaccagtatgtgatgtttgtcagcgagtcaaggcggaacatcagaaacccgccggtttgttgcagcctttgaagattcctgaatggaaatgggaagaaattggtatggattttattactggtttacctagaacgtcatcaggccatgactctatttgggtaatagtcgacagacttaccaaagtggctcatttcattccggtaaagacaacctattctggaagtcgattggcggaattgtatatggcaaggattgtgtgtttgcatggcgtccctaagaagatagtgtctgatcgaggcagtcagtttacttcaaatttttggaagaaacttcaggaagagatgggttctaagctgaattttagtactgcttatcatccgcagacagacggacaaaccgaaagggtaaatcagattttggaagacatgttgagagcttgtgctttagacttcggtggaagttgggataagaatctaccctatgcagaattttcgtacaacaacagttatcaagctagtctacagatggctccttacgaagcactgtatggtcggaagtgtcgcactccgcttttgtgggatcaaacgggagaacgtcaggttttcgggacggatatcctaagggaagcagaagaaaaggtgaaaatcattcaggaaagattgcgagtggctcaatctcgtcataagagttatgccgacaatcgccgtagggatttgagttttgaagaaggagattatgtgtatcttcgtgtcacgccttttcgaggagttcatcgttttcgtaccaaaggaaaattggcaccgcgttttgtgggaccctataagattgtcagtagaagaggagaagtcgcttatcagttggagttacctcaatctttggcaggagtccataatgtgttccatgtttcgcaattgaagaagtgtttaagggtacctaccgaagaagctaatcttgaacagataggagtccaagaggatctgacctatgttgagaaaccaatccgtatcttggaaacaagtgagagaagaaccaggaatcgagttatccgtttttataaagtccaatggagtaatcactcggaagaagaatcaacttgagaacgagaagatgaattgaagtcagctcatccgcaattgttcgccagttcttccgaatctcgaggacgagattctgtttaaggggggtaggtttgtcacaccctgaaaattcaaaatttataaattgttgtttaaatggaatttttagaaataattttaaaaagtcttgaaaagaaaatctaattttaattaataaattccaatataaaatgggcccagataaaatttcattaaatactttgcttaattctataattcctagatttttctgggatttatttgagctaagaaagtatttttaataaatggaattgcatttaagaaataattttaattgaaaaaagttttaaaaagtcctcttttggctttgggctgaaagtcggcccaaaatctctcttctctctcctcggcccagccggcccagtccgccgcagccgcgcgcgccctcgctgtcgctgacaggtggggcccacctgtcagtcgtcgtctaccttcggccgccgccgcccgaaaccctagtttcgcgccgccgccgtttcccttccaaatccggccgttcctttccttctccggccgaatcaatagaggggaaacattctccgggatctcctctaccttttctccttttggaatctttggctaaatcgctttgaaaagagtggattcgagttcgtctcggatttggtcttcccgagctttccttgcccgttgccgtcgc

SEQ ID NO: 7165 - DNA, 1470 bp, Oryza sativa
atgatggcttaatgatagttcatgatggtcgattgtgattggttaattaattaatgtgccaactaaaacctgataatggtgggttgtgagcacatggttttgatggtcgtgctcatgataattaaggaccggttcacgagtttcggttgtgaaacattaaccgtgccaaccacaagccagcatgggcaacggctttatcttttgtatagcatggttcattgcggagcaccagactgagaagtggcggagataagcccacgggggtcgctggggagtccatgccttgtttataagggggtgattatgatccaggaaggtgcgctgcagtggattgtgttatgcgaggggtattgtcacaactcttttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtttcacacttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgttaaattaattaactgttttgttaaattctgaaatgtttgctaaatgctgcttttgcaaatgaaaccctattatgccatcctttgttatcctgtgcacttgcatatttgctacgtggcttgctgagtatgtcatatactcaccttgcaatcattcatcagaggaagagttctacaatgaggctgatggagtggaggattaggagtagccttggtcaagctgcctgtggagtggagccgtctgcgccgtttattttattttccgctgcttagatctttattgtttgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacacccggtgtgactggcaccaaaaccatttcaccatatatctctaaatatcagtatcaattatctctcgtgccaattgtttatcatgaaataataatcaaaacacactttgatttcacatatgccaatgtgtattaatgtttgtggaaagcaaattatcatttgctgcgttcagggagctcactttgggaacttttcccccacgcacatttaacggagcaactcatttgcacatgtttagctaagtatcagctaaaatggattttttaaaaactatgattttaagcaacttttcaagattttttttttcaaaaatatacaccttttagagtttgg

SEQ ID NO: 7166 - DNA, 4286 bp, Oryza sativa
  unsure (1)..(4286): unsure at all n locations
tctgaaatgtttgctaaatgctgcttttgcaaatgaaaccctattatgccatcctttgttatcctgtgcacttgcatatttgctgcgtggcttgctgagtatgtcatatactcaccttgcaatcattcatcagagaaagagttctacaatgagcctgatggtgtggaggattaggtgtagccttggtcaagctgcctgtggagtggagccgtctgcgccgtttatttattttccgctgcttagatctttattgattgagaggaactatctacctctgtaatgacattttatacgcttattaattagagtaataattgtactctattatcaatttgttattgtgtgcctcggctgattcctggacgagggttcacacacatgtaagcgtttggaattttggatagaaatcccgggcgtgacacccggtgtgactggcaccaaaaccatttcaccatatatctctaaatatcagtatcaattatctctcgtgccaattgtttatcatgaaataataatcaaaacacactttgatttcacatatgccaatgtgtattaatgtttgtggaaagcaaattatcatttgctgcgttcagggagctcactttgggaacttttcccccacgcacatttaacggagcaactcatttgcacatgtttagctaagtatcagctaaaatggattttttaaaaactatgattttaagcaacttttcaagattttttttttcaaaaatatacaccttttagtagtttgggaaacgtgcgcatggaaactcacatgtacgaacacagcttaagtggtattaacactacaacaaaaacctcgtatagaggcacttttgtagaggagttttgcaaattgcttctaagatcataagttttatagtgtagagacacttcaaaaattatctagaaaacttttactctagagacaattttagctcagtttgttagatcttatcttatagaggcattctttcggcactataaaatgcgtttaatatgtaaaggcattttgttgagacattttaaactatgtagagatactttttagaatgataatgtgtaactaaagaaacaaacatacaagtaatgacatggaggtgagttggttagtgcattgaagattaaaatgatttaaccaagagatcaaggcttgacaaaagcaaggatattattatattctcttttttggactggttttatatggttgtggtacaatttaatgtctctagaaaatgcctctacaatcttatagacattttataaaatctctcttcgtttatagagagaattcaccataagacacttattattagacatgttttaaaatgcctctatattgttgtaaaggcatttgaaaagtgcctctattatactagaaaaatgtctcttacaaaacatttttcttgtagtactgtaacattaggtgctagtagcagtttcactgccgattatgcacccggagattctaaagcgggcagcaaatagagtgttgtcacactactacagattcgatttttccatgtagtcaaaaccgatttttccatgcggaggtagcgcccatctgcacctaggtgtttgcaaaaatcaacattatcgcgtgcgggcagcccaaccgcacaggatactctattatcccgtgcggccgggttacgtggactgcacgggataatcgattatcccgtgcgatcgagttaagaggacctcttgggataatagattatcccatgcgttatgttaagtggaccgtacaggatagtagattatcccgtgcagttcagttatgtcgaccgtacaggataatctattatcctagtcggctagcatgtgctaggccgaccgcacgggataatagattcgtgcagtcaccctagcaattgctaaccgtttgggaaaatgtacgtactcattattttttgtgtatttttgaatcgtaaagttacatataaattatacaagcacaattagaaacatcgatatatatatatatatattacatagcatatgtacatgtctagtgttcataatattaaaaatagatgttttttattctattgcatgttctctctcccactcccttaggtttttgaattgggggtccatagcaagttcgctgtaagggtcatagaactcccttggatggttgcggatgttgcaacgaatgaaccggcataagtccgcgcagatgttcagaagcgttttctggtcgaaccagtttgctgtatatgggatgctcggaagctatggaaaatagaagaaaaatgatatgtgttaaaagcgacttaaatgaactatttcctatatgtaaggagcatgatgacttatatctgtaaactcagttatgtatctcccacggaccctgagcatctcgcacacttaatatccccataggttggtactgttgggttgcttgtaacactgcgtaagaacagtagacacgtcagtaataagaacaaacaattgcatcatatacttaacgaatatatatatttgattacataccggccagcgtccctttacgagaagtcttgtcctcttttgatcctttacgaacccgccatgttttctgtaatagtcgtgttctctacaaagatgaaatatttgattgagctaactttatctttgatcctttgctttcttcctcttgattgccttcttctataccttcccgaacacgaccttaatcttcttggccatgtcgaagacttgtgcaccagttcatgcttcaggaggaagatcgttctctacggacttgtcaaataagttggccatcttacgccacttgtgcctctgtggtaagaaccgacggtgacgcatgtacactgtcttccttgaggaggtgaggtacctgtatgacgtgttgtcgatacatataagacatccgaacttcctcttaagctatcctgggagccaaaagttaaccggcaggtcgttgatggtaatgaatataatggcacgtagagtaaaatgctccctacagtactcgtcgtacactcgtatcccttctttccaacgcttcccaattgtcaaaccctcatcttgtactagctagaacctctggttcaacgtgccacaacatatcctccagatcaaaatcaatatatgtatcatctataccagagccaccacattttgggtgaagatgcacttaaaccccctagtgggttttggtgattaatgacaatgtggttaaaggggactaacgtgtttatcaagtttattcacaggagtttagtcccaaagcaagttgtgatgactaagaatgcaaggagaccccccaattcgaatgttcctaagtgcgaaaatcgctgtaggtgattagactaggtttttcactttcgaaattgagtttaggaaaaaccgtactattaagaggggtttcaagtgtggttctatggtatacaaagtgctcttagtcatatccatgagtcaaaagatttttggaatcatttttgaaaaatgattttctccccaggacagagagggctacccgaaggttctggccggaacttccgggcgccgtttaattgcaaaaattttcctaagtgctgcccagaagttcctagcacttgcccggaacctcatggcaggtttccagttcaaacatgtgagtaacggctagatgacatcacctagccgttataaatatggatttcatccccaggtcaccctttggccattccacttcagttctttcatgttcgagggttttctagccactcccaagcttcctttgctttctccactcaaatctagagcctatcttgtgagattgagagattagatgagagtgtaggagtgttttggagatggcttgaagattaggtttgattgagcactttggataccttgtgggctgtcacttgggcttattactcttggagatcttctcctagatggttaggtgtctcccgtgagcttccaaagatcttgtggatgtcgtaggaaagtttgtgaagtttttcctcacctccgcaaggaaacgaggtaagtgagtaaagattcttgtgctgagttttcagaggttgtcctaggtagagcaacttgcacttgtggtcttttctagaagaaattttgagttggatcttggtggtctctcaattctagaaaataacctagaagtgttgagttgaaggctgtggacctcttctgggatctttgcataagtgagccaaggggttaatcgagacccggctctttggagcacctcaacggagagtaggattcgtgtgatccgaacttcgggaannnnnnnnnnnnnnnnnnnnnnnnnnnnnnnnnnn

SEQ ID NO: 7167 - DNA, 805 bp, Oryza sativa
  unsure (1)..(805): unsure at all n locations
nnnnnnnnnnnnnnnnnnnnnnnnnnnnnnnnnnnnnnnnnnnnnnnnnnnnnnnnnncacttaggaacattcgaattggggggtctccttgcattcttagtcatcacaacttgctttgggactaaactcctgtgaataaacttgataaacacgttagtcccctttaaccacattgtcattaatcaccaaaacccactagggggtttaagtgcatcttcacccaaaatgtggtggctctggtatagatgatacatatattgattttgatctggaggatatgttgtggcacgttgaaccagaggttctagctagtacaagatgagggtttgacaattgggaagcgttggaaagaagggatacgagtgtacgacgagtactgtagggagcattttactctacgtgccattatattcattaccatcaacgacctgccggttaacttttggctcccaggatagcttaagaggaagttcggatgtcttatatgtatcgacaacacgtcatacaggtacctcaccttctcaaggaagacagtgtacatgcgtcaccgtcggttcttaccacagaggcacaagtggcgtaagatggccaacttatttgacaagccctagagaacgatctttcttcttgagcatgaactggtgcacaagtcttcgacatggccaagaagataaggtcgtgttcgggaagggttaggagaaggcatcaagaggaagaaaggcaaggatcaaagataagtagctcaatcaaatatttcatctttgtagagaacacgactattacagaaacatggcgggttcgtaa

SEQ ID NO: 7168 - DNA, 692 bp, Oryza sativa
  unsure (1)..(692): unsure at all n locations
nnnnnnnnnnnnnnnnnnnnnnnnnnnnnnnnnnnnnnnnnnnnnnnnnnnnnnnnnnnnnnnntcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttaaaaatgaaactatttgcgaaagtccctttttcctcctttcccctgtgctatttgcaaagtgtttattcccttttcttccttcttcaaatttcaactagtactagatggtcagctttgcgaagaagaagatgtcgtcagttgtttgccgaagctccggaagactgcaggatccgctagcgaagcgaaggaagaagtgaagccagctgtgaaggagtgaagatcttgggaacccgtcgcagaacctaagccaccctgtagggtagtgttgttagtcgtgtgttccttgcttgtgtgtgtagcgcgtggtttgcatcggtgggttgtgatgtaaccatgctaggttgattgcttaatcaacttgcagaataagtgaaacaaacaacacatcagcaagaagagtagttcctttaagggcctgtctctagntctggtctattctttcctgg

SEQ ID NO: 7169 - DNA, 529 bp, Oryza sativa
  unsure (1)..(529): unsure at all n locations
agctcggtacccattttgtcgattgggactcgagatagcaaattcggcaagtggtcgccgaattgggaaggaccgttccaaattcataaagctgtatccaaaggagcttacatattgcaaggacttgatggagaagtctatggcagagcactaaatggcaaatacttgaagaaatattacccaagcgtttgggttaatgcatgatcggctgatgttgccgatacatgatagccgatgtgttttcatcgtcttgagatggccgatattattatatcgcccttgtttttttttcatattgtaatcagttgtggtttgccgatattactatatcgcccttagttgtttttataattttatcaatgcttttgacattgtaaaattaggggggcacgtatgtataaaaaatgaaaatgaaaatttttgagcgaagttagaagttgtattaatcaacacaaaggattgttaagacagtaaagtactaaagtatgnnnnnnnnnnnnnnnnnnnnnnnnnnnnnnnnnnnnnnnnn

SEQ ID NO: 7170 - DNA, 685 bp, Oryza sativa
ggtaccctgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctggggatcctctagagtcgacctgcagg

SEQ ID NO: 7171 - DNA, 1465 bp, Oryza sativa
aggagatagatttagcaaatagcagtggaccgttattgaaaacaaattgcaccataattgtaggaagttcctaaagatggatctacaggttacagcatagctaaatatatcctaactaagagactatttattcaaggaagacacatataacccttttacatatgtgatgctgttttggtgccactcataaggtgtgacaacatgatattatcaactactttctagaggcttctttcactaaacaaattacaagaactggacaaaagcaccgatatcttaaattgtaataactgagagactacttgattaatcatgatatcttaaatcccaaatgaatgcaagttatgaagagaagaaaaggttaacactgacctctgaacagagctcctcaatctcatgacggagcttcaggacatactctgagctaacatccatgttgttcagcgcagttgcaatctcctcaccagtcttctgaacaccaacaccaccaagaaagagctttgcacccaagtttggttccctcatcctccattgcagtgcttcctggtactcattgctcagtaggctcgccgccccaccaagcactgcaaaaattgagtttatacttgcagtggatgctgctcttcggcagcaactctgcagtacgaagaacacatcatccaccattgatgttgtgagaccatcaggcactggttcatcaatccggatggctttccttacattctcaaccatgaagaattcttccaggatcacataaaacccagttaaatcctgcaccattttattgaagctaccattccggaaggacttcatcgcttgtggtcccagctcaggtttgacatctcgcaatccacgaatcttattcaccataaattcagtatagtcttcaccaagctgtgtcagtgacagaatctcctcaagatagagctcgacctccctggggtcaggcccttcattgccccctgcagcattggccacagaactcaccacagagaggaggttcttggtatatgagtttatatccgaggcaagacgtgcaagtttcctgtaatcagcatatcggcgcagtatctgtgtgccccgggaatcacactcctcctgcagctcaatgatggcataggcaacaccatcctcacctctgagttcacgaagcacagcatcattctcctcaacggccaggacaatgtccttgaagagacgggtaaggcagccaacaaaatcaggccgctctgaagtaggctgtgttgcagaggttaactcagctaggtgctcgaagtcggcacgagcgcgcagggcgacgaccttcttgaggtaggcgacatagacctgcaatccctcatcagcgagagcgaggagagggaagaggcggacgaggcggagaacggcgggatggttcagcgcgtccacagcatccgccagccttcggcgcgcgagcccctccagcctgcgcttgatgtccagaagg

SEQ ID NO: 7172 - DNA, 35027 bp, Oryza sativa
  unsure (1)..(35027): unsure at all n locations
aggtcggggcggcgggcgaggagcgcgtctaggcgggcgtcgagggcgcgctggtaggcgacgcactcgtggaggaggcgggtggcggccccggcgtcggtgagggcgcgaagggcgacgacggaggccgggtcgccgaagtcgagggacggggcggtgtcggtggaggcgtcggggggcagcgcggcatcggggcgtggggagcgcgggatgggcaaggggtaggacgccacagccatgccggccagccgcggcgccggggatcgccgagatctcggtgggtaattcgcgggatctgggtgctctcctctcggtgctctctactgtggcctgcctgtgggaggcctaggggggtagtttgccgggctgcgggtgaagggcatttctgcggggaaaattaatttgctttcgaatgtttcattgttaagcaaactgtttttatttaaatctaggttgcgagctattatattccacattgtgagagcatctctagcaggggtactaaacacagcccctaaagaaattttgagaggtaagacaaaaaaatttagatccaacaaagcccctactaaaggccctaaaataggaaggcctccaaattatcccctcaagcccccaggcctacgggccttctccctggcccctattccacgcgcgggagagaaatcccacagccgccgagccgcgcgctctttttttttcgcgcgaaaacttctgctagcgccgccgctaaatcctctcttccgcatgcgcaccgcctggatcagcgccgtcctctccaactggccaactccttcctcgccgcactcctccctggcggatcatctccctggccggcaacctcctccctggcggcctcctgccctaccggccacctccctgcccggcggcctcctccctggcgccctccctctcggctgccagcccgcccgacgccctcctccccggcagaccacctccacgtcctgcgcccttctccccgtccgacaatagtcgaaggtattttttttctttttccaattgatttatggatgcaattagataagacttgttctttggtgagatttagcttgccagggcgataaaatggatgtgtgtatttagaaatctatggttggagcaagtattttaatctgttcacttgttcagagataagcatgcaaaaatttatgttcttttcagatattagtaggggaaattaattggtgagaaagaatctggtggtgatcactttgttgtattttagtgatctaaaaaaaatcgataataccacaactcagtaggcagggggaatgataaattgggtcgagctaatatggttttgggcaaagctccttccctttctattactgaaaaaatgaatagttcttaatgcactctgtaaataaatagttcttccgtgcactgaaatatctagactacttacattgcacctgttctgcaacagtgcatatgcatgactttaagacactgtgccacctgaaatcttgtgatcgtattctagttatatgcaggttcttcgagcaggctgttacaaaaagagaaaaaaaaaagctgctctgggtgctatatggttttctttttaattcaattttgtagagctctaccataatctgttctaaattctaatgattggaaaaatttgctaccattatgcattctaccaacatatattagctagtatctgccatttttcctgagattgattagagaagttgttaatttatctacttattgcagtgactagattgtgatggcaagtgaatgtgattcctttgtgcgcacgatgtccgaagagacccatgttgaggcatattccttgccaatgcaaaatgaagaccttcatacttcaacaaatggtgcaaaaggaagagccaaaagatcaagcaactttaatcgtaaggaggacattcaactatgcatttcatggcaaagcattagctcggatcctattattggcaatgagcaaccagggaaggcatattggcaaaggattgcagagcactaccatgctaaccgtgattttgagtctgataggaatacattctctcttgagcaccgttggggtaacattcagaaggaagtaagcaagtttcagggctgctacgaacaaattgagcgtcgacatccaagtggcataccacatcaagagcttgtaagttaaattttttattcattattattaataacaatcttgtatgtatgtgaactagcacttgaattttgctataggttcttgaagccgaggcattgtactcatccaatgcaccaaagaatagggcatttcagtttaatcattgttggctcaagttgaggaattctccaaagtttcaaactctaaaatcccacaagaggccaaggtctaggaagtcttcgaccccaattgagagtgctggtgaagaagatgaagaaggtgatgatgctaggaagagtacaactcctgatttatcacagccaagtgctaaaaagagaccaatgggtaggaaggaagcaaaggagaagttgaagaatggaggagaagatggaccatacaaggaggcgatgaaagatttgcttgacgccaaagagaaagaagctaaagtgaaagaagagagatggaaggaaactaaggagattcaagagcacaagctcttatttgctgagcgtaagttagtgtgggatcaagaacagaagatcatgttttgtgatgtttccaccttggaaccagatgtgagaacatatgtgttggctatgagggcacaaattgcagcttcaaaggtggctgccctcaatggtggatttgatggtagtagtggctttggaggtgagtttggtggtggtaattgagaagtttgagcacttcgatggaataagttggatcatattggatgatccacatgtcctttgctagtaggatatgtcatttccacgattggttcttggagtccttttgtgttaatttttgcaattatctaagtgtcatttgctagtaggatatatattacttttagatttgttatttttatgatcgaaccattcattctttcttgtaggatgtgttatttttaaattatataatgcatctccgcaaaataaaaataatgcatcactgggttcacatagcatattgtggtgatatggagacagacaatgacatgttggtgagcaatttttgttttcattggtgaattataaatcttggttgcgtgttgttgtatatggcattgtgcctacaccatatttacatgtttgaaaattttgattttcgatttgaattgtggtgtttgaaattgtaaatttaactatggttaaattatgcgcgttagaaatatttatgtttaattattgtggtgttaaacatagtgtaaaaagggattgcatgctaaaataaaagagaaacaatagtaggggctaagaaataggggctattgctagagttggaggtattttttgggtccttgggagatgggggcagccctcatttaacttttaggggctttaaaataaggcctattgctggagatgctctaatgttatgaatatagaactaaccatctacgactccctgttaggatgtatgagtaatttttaaggcctcctttaaattatatgaataaagaaagcaaagaaatagaaaaaacgcagtattctaactagaatagaagtgttaaactgatgattgcaaaacatataaaaacacaggaatgaccgcttgattggaccgtaggaaaaacataagaatggatgagagagatacactcaaagtaaattttccaagagctttgagctcttgctgagtttctttcaaaatctctataggattattcattccataggaatttcaaatgattagaaatgattcaatccgttaattaaaaggcatttatagaaatttttcctatagaattgaaatcatcccaaaattcctatatatttcctccaaatcaaagggaccctaagtgagtaccatttacaaccaactccctctatttcatattataagtcgtttgacctttttcttagtcaaaattctttagctttgaccaaatttataggaaacaaattagcaacatccacgacatgaaattaattttattaaatttaatattaaatatattttgataatatgtttgttttgtattggaaatattagtatgtttttctacaaacttggttaaactttaagaagtttgactaagaataaaatcaaacggcttataatacgaaacgaagggggtactcaaataaaaacagtttgcttaacacttactccctccatcccataaaaaccaacctataattgaatgggacattattgacggttattaagtactagtttcaaccgccaactagcacaactaataaagggaaccttagggcctgtttgggggagcttcttgctgctgcaacttctatcaaaatcagaagctcccccaaacagtccagcttttggtccagattctgagaagctgtagttgtagaatctagaaaatgaactagaatccagaagctggaaaatccagcttttccaaattctcagaagctgactaccaaccagctgcttctcagaatcttaagctcccccaaataggcccttagcatgtcttacacgcataccaataataaataatgtagttgtattaggattggaaaattaatgtggatgcatgaattatacgccaaagtgaaggagaaattaagccggcatgcaaagaaaaacacctccagtgaatcacgtgcaaccacacggatttaggggccctcaagtcagctcaaaccgactcaaagtgggaccaaacacccgggtaccttcataggggcccacatgtcagtccctcaccaaagttggtgagcagagtggttgaatgggttcggccgaaccaatcttggtgcacctgacacccatcttccacgtggcgactcctcagcgctccccaatgacggttatgcgcagttagcggcccctaactgccatacaaccgtcattacaaggctataaatagagcttctctccctcacatgcaacacacacctcatggagcaattcactctttcgctttatattctctatagtttttagtaggaattaagcttaggagtttcgatcctatagtcttcttggagttctggatatgtctctagtactctcttctttgtgtaagattatagtcgaattaatagtattatattctttatttatatatgctcatattttattttatataattctttattgagtatatttcctatgagtagtatatactttgtatatttgtttcatcctaggctagttgatccatgctaaagtaacggtccaatgaccttcataggttgctctagctctaacttgttcatcccctagggaagatagtgatattgtttactagcataaacgtggtgtttaggctagataaatatcgttggatgtgggtgtatcccacggaaagtgaggtaggcggcaagtggtgatagccatgtccatcctttgtattcctccatgttcgggtatgacataagagtgcataaatgccataactacgttggcaaactagcagtgagtggtttctctatagtacctgggcgcctggaactatatcctacattgtaagtatgtatatgttaagtatatgcgacacgattagttttgaagtacaattgtatcgtaatatccttaggctattcctactagacaatctttagagatgaatctcttgtgtgtgtacctatcaaaccttatcataacccctgtctagattgcagaaatataaatacaatacccttgggaatactcatgggtgaaatgctacaacgatatctgtgcacttgcggatttatctgtgataataagaaatatcaatagacatatctagtacaacggatatggacatactcctgtccagattcgctgtactaaatatgtcccatccaatactaggttggtttttttatgggatggagggagtatattaatttgtagtggtatacccacaaagtaaaatttataactctaacatgtaatatattatagtacgctacttgcacatgaattataacacaagttagataacataatctaatcttaggatgtgtttggttggaaggatataattaaataaaaatgtccatgcaacttttatatgtgtttggtaagagtgaatgggatggtcaggagagctaaagagctaaaattggattattctatgaagatgttggaattcattcgataaaattgactcgatatccacgtcctagggtctgtttggcacagctccagctctacctctcctagatcccagccaaacagtttcaactccacctaaaatgggagcggagctaggtggagcgctctcataaaatgaggctgttatacaactccaccctagacttaactcctgaaactaaatttaggagttagagttctaccaacaggcccctaattttgattattaataatggggcaattgcaaatttaccactactttgaatcattattgcaaaactgccactagaaaattgcaaaaatgccactagaactgtcattcgagtggtatccttgcaatattcaaaaaaccggtggcaaatttgcaaatgccccattaataattgattaataataagtattacatgttgttagttaataattaacttgtgaaaattaatgtcgattagacataattagtcaattttattattaactagtatagattatggcaagaataattataattaacatagaataattagtagtttatgttttcattcaatccgtcctcttctaaaaaaatgaatggccatatccaccctatcaaaagaaaaaaaagattactatatcccttataatatggatgcccatatcctatctacaatcttgatcatgaaccaaagacacccttttatactctttgcatttcaaaatatggttctctaatgtttgttgcaagaaatagatatgtaaattttgtgaacaatgttactatcactttgtcggatgaagaaatgaccaaaataaaagttgtatgtcttgatgagttctacagcttttatgttcatgactttttcagctaaaattatttactacaaaatatcatttgaagttttgaaattcaaattttagttgataaaacaaattcacaagaaaaaatgaccaaaataatagcagaaaaaacacaataaaatgatagagcatgattttagaaacatttaggaaaaagaatcatccaatttagagttcatatgagtgagataaactaatttcaaattttaaaattttattttcgcatacggctccttaatacacccgtatggaaaaattgatttttctatgtgggctcttaagtggtccgcatgcaaaaatgagcttattttggcgtcttaaggagtcgtatgcgaaaacaccgacgcagcaagttgtggtccgtttgcaaaaatcatagggtctcatacacaaaaatcttttgtgtagtagtgatgggtttttatattccgattaatattcatcaccgtattcgtttcgcttattcgcttcgtatttctattcgataatattcgatttcgttttcatatccgggttttcgattccgaaaaaaattatgaaaacgagtatggtaaagctagtttttgaccgtattcaatccattttcatccctatatattatgttatattattacttgcatgtggcagcccttagtttagttgagtttgtttcctctttttgcagcaattcaatttagaaactcctgtcttttagtcaagccacatacgcgtaaagcaaatcctaaactccctcctatcctaccaaaactttagtttcatgcttcgcactaacatgatatcattttttgaacttatctgacatgacaacaatatttccatcactcttactgtaggctaacaaaaaatgcactttacaaagtttaaaaagggatatctatgtattggacaacccaccaaccacataaaaccaaattaaagatgctccacatgtactttattgcatcatcttgctaaaagaaatagatatacctcatgactctaattaaacacgtcattctgcatagatagataaggtaatattttccttttttatatattctcctttgttttgggtatataaaccctcctcctcctacatagctagtcatcagtagagagaagctagcaggtgactaccatggcatccatgtctaccattgtaccactatgtctaagcctcctcctcttctttcaagtatcgatcgcacaattttcatttggtggaggcccactatatagctcacgtgggtttaggggtgactcagtgagccaacaccaatgtcgttttgagcatctcgccgctctaaaggtgactcaccgagacagatctgaagccgactttattgagtactacaacaccgaggtacgcaacgagttccgttgtgctggagtgagtgtgaggcgcttggtcattgagagtaggggcttggctctgcctgtgtatgccaatgctcacaagcttctctacatcatccaaggtctgtataccatagtccaacatattatgtatgtacacacgactagttgttttcgaactacattattgttcacaacatgtgaggttttttaattgtgtgagtacatgttgtaggtcatggagtgtttgggatggcactaccaggctgcccggagacatttcaatcggtgcagtatgcatttgagcagtctagcacccaaaaattgagcgatgagcaccagcagcttcacaagttccgccaaggggatgtcattgcagtgccagctggagtggcccattggttgtacaacaacggtgattctcctatggttgcttttttggtcatcgactttggaaacaatgctaaccagcttgatccaataccaagggtatgcccatatatacatctcacaagcataattaatactattccatatttctaactttagtttaatgagtggtaccactaatacatattatataatgcaactcaatatattgagtaggaatttttcttggccggaaagcctacgagctggcagcaagagcagtattcgtaccaggctgaacaacaaagcgacaatcaaaacatctttgctggattcaatccagatttacttggtgaggccctaggcgtgagtaggcaaaccgccatgaggctccaagaactgaatgaccaaagaggggtgattatcagagttgcgcaaggtctccaagcactacatccttctttccaaactgagcaggtccaagaggaacagtcccaagaacagcaacagcaaccaacctggtcaggcagaggttgtgcgcaaaacaatggtctagacgagattatgtgtgcttttaagctgagcaagaacatcaataatgcacaatccaccgacatcttcaacccccgcggtggaaggatcacaagggccaatagctagaattttccagttctcaacatcatccagatgagtgccacaagaactgtgctccagagtgtgagtataaaccatgacaaagttaataagatttttatgcacaaaataatgtaggcatagtacttattgcactgatctattttcctcttctttgtagaatgctttgctcactccacattggacagtgaacgcgcatatagtgatgtatgtgactgctggtcaagggcgcatccaggtggttgatcaccgtggtaggactgtctttgatggtgagcttcgccaacaacaaatcctgctaatcccacagaactttgcagttgcagtgaaggcacgccaggaaggattttcctgggtgtccttcaagactagccacaatgccatagacagtcagatcgctggaaagagatccattcttcgtgctttgccagttgatgtggtcgctaaagcctacctactttcaagggaggagtctaggagcttgaagttcaatcgtggtgatgagatggctgtcttttcaccaaggcttcaccaacaattgtacgctgagtggcagaacagcaaataattaaccaaatatgtattctatcctatgttagtgatttgaataaagtaaaggagggatcaacacctctttttcaataaaaaaatatcaaccaagaatcggaaagaattttatagtgtaattgcgtttttaatctaggacctcttgagaactcaacagcaactagcaatcttaacccttagattatccgggagtcgccaccaccactatgaaatttgtagactcgccaccaccactatgaaatttgtaagtagtagagaaatggaaatgggatcagatgctgaattgaggaaaccccacgaacgccacgaaatcagtaatcaacgctccaactcagttcttgctccaattccctcttttgtgcaaaagctccaacttatccggactagtcaacagttttacctgaggctgagggagataaacgttcaaatgttatacagaggctgactgcattactcgagagatgcatttaaagaatcacttagcaccaccaaaatttatatttagtcttatctgtgagggactaaacagagttcaaaacaagtgagtccagcaggttatatacactcatcttcagaaagaactaaccaaaattcgtataaaatggtaatgaattagtcttgaaatattatgttagcatcagttgcaatggcagatcgacggagtttgacatccacaaacattttagcacggctataaaaatatgttatccagcttggccactacgcccaatggatggttaacacttctcaaagctgggattgcaagaacatggctccataacaaagctcattaaccccacagaaagaaagctcaccaaggaaccttctatttgtcctgaaaagacaaacgtcgcagtgtaaatacaagataatgaaaaaacggcagacactacattttagccatatgtacttacagaccaccaagagcaccttgaatctgttgtgttaaaattagaccacctagagaaccttgaatctgttgtgttcaaatttgtgattttcattgtaagctatactcagtgcacagctctaaaagtgtatttgcaatctagaattgggttgtacaggtaccactggtgcaatcttcttatgatgattgaactccaaattacaacccacaacagaactcagcaaaatgttttcatttactcacctcaagctctggaaggtctaaacattaaatgttgagctcccagcaggtggaacagcaacaacttttcctacagcaactgtcttacctgcaacaatttaagataaaacgtgcttcatggagtcggaatatattgaacttactaagacggagagaaacaacaacatactttatggtcggattacttggacttggtgaaaaaacatgcatagaaaacctaagtacaactttcaatagggtgaaaagcagccaaagagaaggaaacagagtatttgatgactgcttggtgcttgcccattttgcctgactagctatggttaaattttgcagccaactgcacttgcattaccttaaagtaatatattattgaatttgcgagaaataaactaacagagattctgattatatagaattagtgaatgatattaaataggttcatttaaatgagcattagataccttaggaaaaataataacagcagaaagagtatatcatcacaatccttcttataataatttcgataggcaaacacactcaaaatcatgacttatctgtgtccgattagacgtaattcctatgttatataattttaatgtcacatttagaaaagaagacttggtgctacaggtaaaaataaaaacatctttggtacatcagtgttgcatgatttaaacagagccaaacattgatttcagaaaaggatgtatatccttgccttcagtccggagcgtaaatcttccaagctgaggaaactcagagaagttctcgatacaaatcaaattattgacctaatataaaacagaggtgattagaaaatgtagccctcagactttaatgccagagcgatggatccatatggtatctgagcagttcactgaggaagtttcaaggataacctgaacacggcaaacgacgacagctccattcttcacaaaaagaggtttcctctttgacttctttttttttatgtcaccttctttcctcctcttcaaatcaatttcttctatgagttcaacaatctcacattcctcaactacagagtggatatgcagcactgccttgtaaccagcagtaaaaattgcctagtacatcaaacatcacattcataagaaattcgaatacacaagaagtcagtccagagttaagacaccctggatttggaatttaaaaagaacaagaaggctcataagacccttgcaatattttttgtagtaattatattaatgctatctagatgttcaaatatcaaagaaacttcatctggtataaaccgttccgaacgggagtgattattgaattactaatatccatgtgacaataatttcaatctaaataattttggtttctgagctcccaaaacaaaattaaccaaataggagacataaactggagtttatttaccaaataatatcagtcagttaacctgatgcattgaccaaataattgtggcttactccaatgtatattgatcaatatactaaaatttgtaaacttgaatccactgtggaatatacagtatagaacatacacataatgcaggaaaatttgtaaaactattggtttcggaaaaaggaaatcatgtataatcatattgagccctatcagttgataaaataggatgaactaacagtctaaaaagatgtcttaacttataacagggctatgaagtaagaaatattttaaattctcatgttttatttttcacttaaaactataagccaaaaaatgccattccataaaagtacagtttttattttatttttttacaaattgtcaacatccaaaacaaaaatatctatatccatgtccaacacattcccaaattcatgctcgaaagaccagatcaccagttctagtattttatactttccttttccaaacatatgttttcgtaaataaactatgcaggacaaagaaaatcagctgtgattctatctaagagaagattgcaaactaagcaaggcactcctggcaaatcatagtaggccttgcaggaaccagcattcaaaccaaggtattgaacacagagaactaacaaatgtcaagtgagaatagtcaagcatgaaatatcctatgctatcgtctgtaagtgttacttacattgtcaagcaactccaatatctgtagttgagcacgaaattcagatatagcactaacaggattttctgcaagaacaacgttgccaagaatcagtatactgaaaaacaacttccagtgcttgaaaaatgtccaaggtaaacaaacacctagaccatagtcaccagttcatgaatagctaattatttcagaaagctcaacagtaaacatgtgcagaaaataatccacccagggactgtttgcaaaccagctcttttttttttctgagctaggctcaaaaaaggcacttcggtgggatagtaaaccactaaatttagccaggtttgagcagatccaaccagaaaaaaaaatctggtccagacacaagtttaaaattctccagaggcacatctcgtctgcacattggttaattaaacccttctacgtacatttgggtgaataaaaactgctatatcaccatgtaagaaaatgcaattttttataaataatgtaatcttccatggtaaaaacttagtaagaataaaataaatggtaaaatgaatgaagaatttcctctacttttctgcttcaggaaacaaacaaaaaggcatcatcaaagtatcaaacaaacaaaagaattcaaagacaaatggagcacggatagacaggatccctttcaacttgcaaaaatagtgatatatcctagaacctaaatgcatcacttttaactagagcaatatataatcaagtgttcagaatgcacaaagttcagccagaatcagtaccacttatcaaggagagtactaaagaaagcagcaccaacaaagtaattatcttgctgctcccgactacttggaaaagacacttactaatgcttgatagcacaaaaccagcagtgatgtcatcctcttcaattcctgacagtttgactcggacattctcaccaggtgcagcacttctcactctatcttcatcacagtgtacactaatgactttcacgttggcctgtgagcaaaatagaatgtgcaccaagatcagatttataattccagcaaaagctgatgcacttgctacttgaaaacatcaacaataaaagatgttaccttgtttggcataaccaacatgttatcaccctccgagatagttcctgattcaatttttcccatgaccactgtgcccatgtctttgtatttatcaatgattggcatcctgcatatatatgtgccttactgttattagttaaactatccatcataattattcaagtaagaaaatgcaatctgaacagaaaggaaataaaagtttttctcctaaagaaatgccatttcatcttatgaaaccaaggttcggtaagtaccacctgacatgaacaggggttttcttagtccatttaaattgtacttgacaagctaagaaacctggtcgtctaaccttactggaccttttggatctcgtaaagggacttgaatgcaatctagaacttcgaaaagacatggaccactccaccagctacaattgcttttatccattcttgtcttcatattagtccccaaaagaccagagattggcaagaagtggacatctgaaaagaatgccagaaaaagcaaggtaaaagtaatgtattgtggataattccatcattatcataaccacagatcatcacatcattgttattaccacactcagttgagcaagggctccattcaacaagtgctggatataatatatgacgctatgtcaacacccaaaagccaatctctaactagtaaccacacgaataccaaaaagcttattttgtttggacaaagaaaacatatgagtttcttttgattattatatgtaacatttgcaggacacaggaaacatcataaaaagcatatcatatactccaaatgtatccaaaaatagtgcttcgtgaataaactcccagcatttttagtataattagggctaaattaggaacaatcacaaagctaaacaatctaaaccaggaagtcaccaaataatgggaaggaaaactatggaatgttacttactaaactttttgcagatggcataataggcaacaataaagaataatattcctgtcttagaaggaaataaccatgtagatgaaagatgtcttaccatgcttagaaaaagaagatgtgaagcttcaactttgtgataagctaaggcatcaaagatttaacaagcaatgaagcaaaccacaacagaactgtctaataccccatcctatttgatcttttgatttctacaaaactagccaaatacccatgcgcttcaatgtctacaatgtgttccatagattctaaacttggaaaatgtatatatttttcatttgaacatcaatcactaaataattctattacaaatgacatgcgcaaagacataacttttcagagaagattcttggattaataaagcataggtgcagcgcggaccgtggatggtagactcatgaccaccactaacttctttcataatagaatagaaatttcaaattaaattgagaaaaatgaacagattttgtgaagagatatctccaacctaaaattaacgcatagagaaaagagtgaaagatgatcccattcataattatatacctttcttaacattgtaccctgatgatttaagaaaaggaaccatttttccttctatttcatcatatctgaaaccacataagtgaaataatgatttttctttacccaacatgcttatttaagaggaacaaattcttctcagtggatttgttatcaatgtatataccgttctttcgaccagccaacagtagattcatccatcttatttatgaccacaaccaacttagaaacacccaaagtttttgccagaagcacatgttcgcgagtctgcccgcctctttcatacccagtttcaaattcacctttccgagcagatatcacctgagggaaacaatgatacattcatattatatcccagcagaaaagacggtaaatatgatttcgaaagattgcgccactgcttacaagaacaccaatgtctgcttgagatgcaccgcttatcatgtttggaacataacttttgtggccctgtatgtcagaaatatattgaatacaacattatataaaagaaccccgaaaccattataaaatggatcaaataatcatcagaaagtagcatgtcttgtaataaggtgtaatgacttggttagcaaaaacaccctgaattgttgctactttgctacacaaaggtgacactcaaaaatgagctgtacaagcatgaatgaagacatagtttcagtcaaacaaacagagcaacaaacacatacaatccctataaatcaatcctaagaccagtttgagacggacgtaaggtaccaaggcagttgttgcttccacatgaacgattccaattatttcaaaagggggaaaggaaatacatcaccattttatgtttaagtcttctgcttatctaagttttacgttcaagttatttaaatgtatgaaactatcttaaaatatgatagaatcacaacagttgctccataaagcaacacaaaatctgtttcaaaatattgaaatataaaactatgaccttgcattactatggtatatgtaaataagtacagtatatgaggcaaaaaaaaaatttaccggtgcatctaaaatggtaaatcttgtagtttctgtctcaaagtgtgctctcccaacttcaactgtcttcccctgaatagattcaaaataacacattgtaagtacaataagtgatatttgacagaattattcaagccacgacaaaaatcaaatttcatgaattagaagtatgatgacctagaagcaggattggagctggagtatccatagacaccatttaaactttgttggattcggaaatgtttggattttagttatgtaacaggcaggccatgaccattgatttgcatggttcatattactggtctatccaatgatccaagaaaaacaggtgcaatgatgttacccaataatccaaacccaaccatcagaatataagcaagcagatggcagcaaactcttgaaggcagtagagagatgaccacacaagtaatctcaagatatcacatgctcatcactgtcgaaacaggatgtgggagtggccatcaaggatcatcagtactggaactagaacaaaccttaggttccattttgatggataagtctttgtggtccttggtcatggttctttattttgcttttgggtagtttcacctttttcaggacagcatcactccttaagcatattttcagttgctaggacagctgcagttagtaggacagcagcagttagcatctcctttatatctcctttatgctttattaagtttggatgccctctaggacagcatcccattcaaattttgaattttagactaggagggtgcagcaataggcttgcagccagctatggctatatatatgtatccaacctccctcgggttggtatggctttgagtttgcgaatggaagaaaactagaaaaattgccccatcttgagtgccatcctcttatcaatgagagtaaccattgaaattctaacatctggtatcagagccacactttcctgtaggctaaacatctactgttccaccccttcccaagctcggttgagctctcagccagcagcagcagcagcaccggctgctcttccttcccctttcccttccccctctccacgcagcagccccccggaggcgcgccatgtccgatgttcggtctcggcgttcggtcgcctcgagcactcggcgtaagcaggacgccaagctcgccgcagcagaagagcacaggcgagcaacggctcagaccgctgcagcagcagcgagggcggccagactggcggcagtggagttggcagcagccagggcagaggcggaagcagaggcggcggaagatgcggcacgtgcggcggaggtagaggttgagaccttgcgcagcaacatcaacggctccatcggcgacatcaccgccgacagggagcttgaggagctagcaagagggagggcgcgggagcgggcaaagcgtgctgcccacccccacggcggcggcggcccaagggaccgcgcgcccgccgatgggaacccagacgggcacgggtgtgccggcggcagcccggagcgcgcgcgcggcggcggcgctccgagtggaggtggctggttcgacagagagcgtggccctcgcaggcagcgcggctctccctcccctgaccggcgccatggccaccacggcgtccagacggtggtcagggactttggtcccggcggttggtggcctaccctcaccaaaaccaactatatcgagtgggccgcggtgatgagggtgaggctccaggtgcggcacatgtgggaggcagtccggtacggcgacgtcgactacgacgagaatcgacgggcgctggatgcccccatcgctgcagtcccgcccgagatgcagttctcgctttcccaaaagcggactgccaaggaggcctggcaagtccacactgcaggcactccgcaaggagtgggagaacctggctttcaagccaggtgaggatgttgatgactttgccctccgtcgcaacactcttttgcagaagatggtgcagtacggcgacaacctatgatgaggagagagccgtcgagaagctgttccgctgcgtcccagagaagtatgggcagatcgctcgctcgatcgagtctctgctggatctctccacgatgtcgatcaaggaggcgataggtcgcctcaaggtcatcgacggccatgagccacagcctctctcggggcctatcaccattggcgggaagctccatctcactcgggannnnnnnnnnnnnnnnnnnnnnnnnnnnnnnnnnnnnnnnnnnnngcatgaacatgcctgtgggccgtgtaaaggtactaatccctgggttggcacctagtgagatgctcaaggcagagttttcttgactcccaaccgatcacatggtgtctttctccacctcaattaagaggttggtggggagtttgagagcaacggagaaaaatctccacgagagtccacgatggccttttggcctctaccgttgctcagctgcgcactgagaacaggaggctaaaggacaccttgcccaaggacaaggtcgagctcgatgagcttagagttgaccttgcgtccctccgtcgtggcttttgtgccaagcattttcacttgtacaaggccgtaggaaaggaagacctctactgtgctcctatcctgataaggacacaaatagctggaatataaccatgactaccttatgtattaatcaaccaaaggttgctacacaatgagttttgtgtgtttttgtttgcagaggtacttgcttgggcaaaagaaaagagactgagtgtaaggaatgcatggatgattgaagaagttgattggggaccaagccaagaccttctccaagtcttgtttcatctcaccatgtcacttttggtccatagaagacaagagataaagttctacacgttttggattcgggttcgggcctcctaacagcatcaacttcaaacagatctagccactgatctagaaggaatttcggggcctattattacttgttcgaaagcttatggagtctactttcagatggttttggtcccatgtcaaaattcacaccgagctgccgggaaactgcaaaacaagccacgtatctcatccagtccgaatctgatttgggttttgggcattgtaattgtgtcgtgggcttagcccaatggggtgtgcgccctagggcaaccctaggatgtccctaatcatatttattcagtagccgtcaacgtttagagtcggtttttccttacattattctgttgagaacagttttgccgctagatcggtttgtaagaccccaacttgtgagcttaatcattcatccgcaattttggttgtattctatcttgttcttgtttgtgtccttcgattgacaaacagggattagccttctcgtcgaggtcatctgcgtttcgacacgggtgataaccagaggagacgtggtgctgcgattgcggggctcaagagcgtgcgcgttcaagaagctggatcgatttgtgtcgtgactccgcccaaatcgttgtttatcagaacctttcagaagatcaggaaccctagtgcatatcatatcccatagacattccctagttgttgttgatatttcttaacagcattactaaggagcttaattcatagcaatgatgctagaaatatgggcggtaattctttacgtttacaaagatgaatccacaagcgcacggatttactgatgtagtatttcacccgggagtatacccaaggcatcgtatttttaatcccaagggaagagattataagagagaactttattatttcatttcatgcctacgacagatcaaagactttgtaggggttaatgatatacatgcaaaaagggtaggttgacacatgaatcatcaagaaaaactattctgatactaaaagaaatagcttagtatagtggaaagaaactagcaaagaatcctatctgtacttcattaaaaagttgtctagtatacatttaatatgcactaatcgtacaaccaatacccttaactacgccctcctgttatgtcgagagaccacccttggttgctgagttccttatgacaactcgtcatggccatccaactggtaatgaatacagaggagtacctacaccaggaaattgtcttagtactatatacgcatgtggaggaatacccataccgagctatcaccatcagcggcctacctctactgtcccatggcatataatagcatttaatggtatccaataatctaagcatcacgcttacattactaaatactactccatccatgcatacgacatagagcaaccgaatggtcggacattaaactaataccaatgcgtatctctggtaagctacccatatgattaatacatattaaatttataccaaagcaagtaattaagctatataaatatagcataatactataactataaaaagaagaatatattattatataataaggtcttatgaaggaagagtaaactatttcaactccactctaactaaagctagaatataaactaagagagagcttcttggatttgatgcttcaaggtgtgtgttggagagagtgaggcctgctccttttatagccttccaatgacggcgattcctccgaaaagacttggagaacttcggaaccctactatttcaactccactctaactaaagctagaatataaactaagagagagcttcttggacttgatgcttcaaggtgtgtgttggagagagtgaggcctgctccttttatagccttccaatgatggtttcggcaattggaaatgtcataaacatcctccaaccgtcattgggaaatcatctgaagcgtccacgtggaaagggagcatcaacggccacgctgggggttcgacagaaccctggcctggcccaaacggcctacattttctctggtgcatctcttaatggatccttagtccagtgatatggtggttgggcctatttgaagttattttaatagatttgtaagcccatccatccataagtctgccactcgacggatttcgattgattgttcggttattctccttcatttatgagtgcttctcctacatatatgttattagtagcatagcatataatggaagtagatattttatttggaaattatgcattgcaagcataggtagtattcattaattgggtaatattgacggtcaaaattggtcgatgaccactgtcaacagttatccttagtattatgatagataagttaggtttaatttattctttcatttatttatttcgattctttcatgtaattgtggccattaataaagttgaaatagaataaatttgctgggcttcaccggatgagtacctttgctttcattttttgttgtcttttctgtctatgaagcaccccacgtacaacaacaagtgtggggttgaccttgtgctcacataatgcattcacgtaccaagatcatccacgtccgtgctaatccacgactcatgcacgttcgcgagatgagacgtagcaaccttgcatacatggctgcttatcatcacactcacatttgagcgatggtttgcacgtcatccctttatctccctaattcagttggattaattttgccatatttggaattaactcaagaatgaaaatgagtattgacataatcaactggaatatatgacttgctgcaaaatgacctacctactttttaatctttgatcatcccttgttacttgtgaaccacattcatgggaccacatgtcacctaagtgattgatgaatgagagattgcctgataataagaacctcactcttactgttggaaacttgggagttttataacaagaacaaaaataactttacatacttattgatgttttccttcctaccaacatcatatgtcagatcacattgataaaccttatacatataccacttgccatcattttgagttttgttagattcctttcatattttcacgaccaaagtcctgtgtacttatccaccaaaatatattgctctccctctatactggaggacttgcaacatatgccatccacctaccagatgctaaacttctacaccggaagtcggcatccaccatatctatccaccaaataaagacttcacatgactatgtttctccatcctcctatccatgctaaatgagacatgagctaaaaaaatgatcagtttttagaaaatcaaaatgctcaaaagagaattggccaatattctcgagcatgatgaaaaaaagaggatatagaaaatagccatgttctccaaataaagtatacacaggagaatcatataaaatgagtcataattccatttcacatcatccatctccctattccattccatccacatataagtgcataactttggtcatgttcatatgattggttatcttcttggatcctcaatttgactttataatatatctaatgcaagtctgtcatttcttactccctacccttagctccacagaagcctttagaaggtaggataagaaaaggcaatgtgaattccttggttaggaataaaaactttgagtgatttgagagaatcaattggggagtatagtacaagttatgtttttatgaacttcaaagaaaactacaatgtaatttatcggaaggagtaaaggccattccattcttcaatcagccaagatgacatagtagacacatcatgttcacaagtacagcttggaataacctatatgttgtgtcattaagcagaagtcattaccacattgatccatgagctttactcagggacgattaaagcataagcgtgggggtgttgttgacagtcgttaagtataaactttaaccgtcaactcatacataaaagatatcaaatataacatcaaaatttagtggtagggtttcactactaaccttttcaactagtcttggtaaaaatatttatgcaggtaattttgagagaaaataaacctgccatgcgacaaaatgaacctctggccaatcacacgcgagtaaaaggattggagggcccacgtgacaatggaaacaaacctaaagtggggccaaacgaacctctaccaccataggggcccacatgttagtccgaaagacggtcgagagaggcagtgccaagggttcggtcgaacctcaaacggtgcccctcatctccaccctccacgtgtggctttctagttggctcccaatgacggttgcgggagttaccgacctccccaaccatcataactccctataaaaggagcggttcactcacttccaaagcacaccaacatcaacagagtacaactcactttcgtaatttagacttcactttagtacgtgggattagtgacattgaggggaagctctgaatggagtgcccaaaagtattggagttctctccgagaatttctggaggagtgcccactactgcacaatacaccataggtaccagctagagacccattataggtgacggtttcccaactgataccaacttgagagtacctgtgcccgttggcataggtgccggttctagaaccagtacttatgaagattataggtaccagttctacatacacaactgacacttataatatttaaaaaaatcaatggctgccacgatggatacatcgcaggaacacatcatcgatggcaacggaggagtgcgacaccatgcagtgcaatgcgaaggagctagcggcacaacggagacaactaccctgttcaacaggaacacatgcagttcagaaaaaaaaatcaatctccaacagaaaaatgccgttgatctgttcatccaaaaattttagaagaagagcaaaatctccaacacatgcagttaaaaaaaatcaatatccagcgggtcaaaaaattaagcatgagcccatagcagcattggtcaaagtgtctagaggacatatgtcagtcaagaatgtgatctcataattgaaaaggttaattctaggtaaatggaaatgggaggtagaagattatggtgataactcttttcgcactattttttcttctactgctgaattaaaacgcatggtagaattgggtatagtgcatactaaggtgggagagactaaaatgtagattgtggaaagaggggttgagaatgaggttaagtatgttattccaaaagtgcctctacttcacgggcctcatctccaccgttaactacttgtgcatcgcttgcactgatttgttcgccgccgccgactggtgatctcacctctatacggaccacatcattcttctccaacgagcaactatgactgcaacagaaggacaagcaaaatgctctaagcttaccagctcaagcacgtggatcataccttcaatctggacttgttttggataaacgcaagtaatcaatcgagaagccttcgcatcgaagattgaagcactcagtagtcagtataggttatgaatcacggagaagactgcaactcgattatcaaggtctcaggggctactgtggaggagaagactgcaactcgattatcaaggtctcaggggctactgtggagaatatggatactaggtactcatacaacctccatattcgattagagataggtgataggccagatccatgtattatatagagtaggactcggttgcaatgttaccatgtgttctatggcaggacctagagtaccgagtgaggattatcatataatagattagcaaactaataccaaatccgattaggtttttcgattctctttgtaaccctatcccctacctatataaggtggatagggagccctccaagaacatatagcgagataagcactatcaaatcgttagatcaatatacaaccgatggatactatcggacttcctcaatcatgagtaaggtattacctctcatcgaaagtgtttggatctgattaaattattgtctttacatccatttaattttaggtctgccgatttccaaaatctataataataattgtgactgctgcactatacggaggctactgagatgggaaagtgttagtcacattgcctgcctatgtcgaataggatagtcatatttatacatttttttgccattcaagaatcatttgatttttcttactaatccattgtcatcagatgttgaacgggggcatagcctcaacttgcaattttttgaaaagaaaaaagaaacagcaagctttactggaagtgaagtgcaaacctttggaaaaaaaaaagctgcaactttcctgttttaaattgtgatatattttgctatcgccgcctactgtatgaatctaagggagtggcgttctgtcgaccgtctgcgagcgaatggccacggctgtgatggacagcgagttcggcagcctcgtcaaggtgtctgcggcggtgtgggcggcaatgttctacgcccgcctcgccgccgcaagccttcgccccggcgctccccgcctcgccgcgctccttcccgtagtcgcgctcttctgcgtggtccccttctccttctccaccaccactttccgcggctgctctgccttcttcctcagctggctcggcgtcttcaagctgctcctactcgccgcgggccgagggcccctcaaccccacgcatcccctccaccacttcgtcttctcggcctccctccccgtcaagctccggcacctcgcatccgccaagccggccaaaggtgtagatccagctccggccaacgagagcgcggcgggcaagatcctcgtctccggcgccgtcatccccctcatcatctacacgtaccagttcaagaacgccatgagccggtaccagctcctcatcctctacaccgggcacatctacttctccctgcagctcctcctggccgtcgtccacgggctgatccatggcgtgctcgggatggagatggagccgcaggtggaccggccgtacctggcgtcgtcgctgcgggacttctggggcaggcggtggaacctcatggtgccggccatcctccggccttcggtgtaccgcccggtgagggcgcgtctcggcgacgcggctggcgtcctcgcggcgttcctcgtctccgggctcatgcacgaggcgatgttcttctacatcatgtggcgtcccccgagcggcgaggtgaccgtgttcttcctcctgcacggcgtgtgcacggccgcggaagcgtggtgggcgcggcacgcggggtggtggcgcccgccgcgcgcggccgccgtgccgctgactctggcgttcgtggccgggacggggttctggctcttcttcccggccatgatcaaggctggcctggacgagatggtgctgcacgagtgccagggcatggtggccgtcatggagcagtccggccggtggctcgccggcgccaccaatctcaccttcgcgacacgctgaccagaggaaatgaaagaatgggacgtgagccacaccattactacgatctgacgaaacctgttgcatcgcgacgattctgacaggatgctgccgtttgtgattttttccgatttgggaaattaaatactcgagccgttcacatggccagcttggacagcactgggtgtttgcatcgtctgggggtctgggctgtgatgccagctagaattatgctagatcgatcgtgttaacaggggttaaagaagcattgattcggttggaaaatatctttaccattttttattgtacgttttcagctttgctatttatcaatccatttgattttttttcttattatcagccacctacactattagccctagttttgaacaacaaaaacctactatgttttcttgtatcaatccctgaattaaaagttggtatacacatttatagctagtagaaaatttcaaaatgaatttaggctaaaatagtttaatatctttacaaggaccaatagggtcttatcctatcagataagtagtagcggaaaccaaaatagtaataggcccaagcgacatgcccacaggcagttcattaggggcaggacctatttctcgatgagccctctgatcatctgctgagtatggcatattgttggcagagtctccctcttctactactgttatgtttaaaaagggagaaaatagctatgtgagtacatagagtacttgcaagctaccactgcaacatgattaatgcacattggatttaagaaagggcttgattcttttgctcaaaaccagctttcataaatattttaacaaacatttgacctagccattctaacaagaaaacaacggtaagttttcttgtttaaccattcactgagggttgcgtccacattcctaagtcttacttgattcggtttatccccaggcacatttatctatatttctgccattggaccctacactaaccctggctagtcccaccattcatccattcccattcacgccctaagtcaataaaaagtatataagtctagttaagaacagtacaaatgacggcgcaaatggctaaggtaccgcaatcttatggtggccataatcctctaggtctatgcccatatgcccatataggaagatacgctcgtacttagatcgtttccttcctatttttctaactcagtccttaactaaccagggtcagcactagcctttgctggaatccaaacaaatcttcttgttgtgattaagttttgtttttccataaacaacttcacatgtgtctcacaagatagtcgctaccatagcgatcttcccaaatcacattatcacatggctaggcatgtgtcaataatttgactacgggctttaatatatccatggttatcaaggtaaaggtaagcaataccaagatagggttaatcaataattaggtacgcaatttaaatatacttcctccgttttacaatgtaagactttctagcattgttcacatacatatagatgttaatgaatctaaacacatacatatgtctagattcattaacatctaaataaatgtgggcaatgctagaaagtcttacattgtaaaacggaggaagtagcatgcagtttatttgaaaacaaaatatttcgcaacataggtacaacatgtatcaatcctgattattttctatagatgttcacttttctgtagattaaccatcaaagtttgtgttctaagtgaatgtactttattttccttagcttatatctagtggccaaatctcaggttgattgtttgttgctttcataattaacaattcaatgttttatccttttgaatgatattttccatgcttatggaaggcttaatgaactgaagtttgtgttggcagtgatctccatcagatgtcctgtctcttcagcaggtcgtccacgatgcaatcagcacatgaggcaacagttccctccaacccacctgctgaaggcttggtttgcctaatttgattgctacatgcgaatgaggattacgccgtgtagattgaggtgcaggtaagctccatttcttgctgtcaattttttcatgccatttttgtgaatgctggcgatgggggatttttgttcatggagcaacaatgtttttattttccttttgtcaggccatatggagatgcagtcgttttcatttacagcaatcctcaaatccaggttaatattatgtggattttatctcttttgtatacattaaatatggcatctacagaaccaggattttacctctttttttcttgcttctgttaatgaagataagaaatatatcccatgtaatcaattggggatcaatgaggtttagtttgttgtactgctaatgaatgccatgtttaatttttgaaacgttacttgttttgttagtacacatgcatggggatgtgaaaagatgactataattgaaatgtatgtgctacgaacaactctccatcatcaccatacgtgatcactgcgaataatatcttttgataaattgatctatgaagtttggtcggttccaaacatatatattatcacaccattgatttaagttgatctatgaagaacatttctttcttgatttatttatgcttcctttcacaaatttttgaccaacatgatatgattagggaggtgataaatgctgaccaactgaaaaaatgtcactgtattctgcattttggctcagcttcatcggtgtcactgcagctcatttttcagtagatagaacatattgtcactacaaactaatgatgccgttagcgatcatccagttttgcaattcaatggtgttgttagtagtaatccattcaaagcataatgaaagaaaaaaaaatgaccatttgcataaacactaacaaacagttgcgtgaccatgacaatctgtaacttgtattttataaacaaattcactcttccgtagcttgtttcatgagtatttttgctttaagccatttttcttagagctttatccctatcactactatctaatgcttctaatcatccaatcgtaaactggaccaacaaagcaatgatctgtttgcaccaccgctaacaaatagtagcatcattttggataaatgaaaacatacctgaattccctctgcttataaaaaagagatagcgtggcttggtgccaacgtgcaagagcacacatttagcacgcaaggatggcaacgggatcgtaaacaatcctcggcgatatatatatgtttcttttttttgttactggaaagtatttgttgtatttgtcacactcacaccctttaatttgattttccaaccgaatctatttatgaactgtacagatgaagaatgtagcaaaacaattggaaggattgtgttggtatgcatttcccgtgatccactgcaccggcaccagcgacacgtgagatcctcactgctaccccaacttggaagatttgtgttttgcttcccagggttatgcctcaccagcactggcacctgcactagcatcaggtgagatgctcacagccattgcgcctgcaccagcgctggtgtccatgcatggattttccttgtttgctgtacttgtgtctccattgcttgatgtggcgcttgcagacgagtaatccctccatccctaactatttgacaccgttaatttttttaaatatatttgaccgttcgtcttattcagaaacttttgtgaaatatgtagaattatatgtatgcataaaagtatatttaacaatgaatcaaatgataggaaaataattaataattacattatttttttaataagatgaacagtcaaacatgttttaaaaagtcaatagcgtcaaatatttagggatggagggagtacaatccatgcccaccatgtgtttgtagaaatgccaatcaaataaaatgcattttattctccaaattcctaagctctcttttctcacacactcactccatgacaggtttcttaagacatactaattctcttggtatgcatttcatgtgttggatcagacttggtggcatgaaaccacaattcgaaggcatcattaaaaaaactgagtttatgatttgcggtaccgccacccgttgaacttggactgatcttatctctgtcacatatgtgcaccaaacgaattcagtttatgatcatcctaatgacagtagttggagaaaagagtatggacatgtaaaatttgcccctttgcattgagctatatattttcgcacaaaattttttacacttctgcttcaccttgctatgacctgtaggttgtcagccaactatgcaagttggcggtgccacactactgcaatggacacgcgccatctacaccattaacttattttcctgtcgttctccatttgccctgcggcaaggtactttatttatcggttatagttgtcaattgtaaatttacttgcatatgttgtatatgaagaggtatgcttgccgacattactaacttaagtttctggaggaagttagaagacaacgtgatagggagaggtatgcttccctcactgtatttattcatatcgtgcctagagttcagttcacaggaggtataaataatggaaaaagaaggttgaccgatctgattgaagttgatgcttgattctaaatgggatatgtttactgtgctctccagttcctcacaatttttaagcagcaatatgatagtatgctgtcatttctatttaagtaaaaaaaattgattactacctcgaaccacttgctttctagccttaatatggaccattatatctgcagtatatattagtgttagtttgacacctcaatcatattatggcctatggaacctgatttttggacttattgtgaatgtctcttgtggagatgacatatttcacaatctgtaataggtacagatatgtactgcaaaacttccataaaagcatcttcccaaatcccaacatatctttttctctgcagaacaatttagggcctgttttgatcccctagcaaaatttttcaccctgtaacatcaaatgtttggaaacatgcatggagtattaaatataggcaaagaaaataattacacaaatcacgtgtaaattgcgagacaaatcgtttagaccatggaactttaattttagttgttacctgaaaacttaattggtagtgtttacatcattacagaaatttgggttcaaaaatcttttgtgaattattgtttctttccaatgttacagtaagaataattattccatttgatatatgtcgacgtggcttgcacctacacactaaatagtttatgtacttattttaattattttcctcaaggaaaagtagtaagccactgacagctgtggtcggggtcaactattgacagccacggtggccagcgggcccacacatcagcgacacaaatcctaaacatggtttatttgctattcttaattacttaggacccacatgtcagtgtaatagtcttaatgaattgattaacttaattaccttcattagtcgctaatcaaggaggaccacatgccatacaaaggagagggatagggatttatgtcacgacacctgacatgcctggagatacataacaggaggtcgagccgaacatgcatatgaatgctaatccatcgatgctgcgcaagtctactcgggagagtaggcctaatagtaggtattattcaagtgaatggacccagtcgaaatgggttgggccatgtgtgagggagtgaggtccatggcgcgatgctataagagaccgatagggagttgagacagaatcgaacattgtagaaacatattctgaatactgaattcaaatctctccctgttctatgttgttcttccccaaatcccaaattccttgctacttctaccctcaattctgttcaattcttccttgttgcgacattgcaaatccagtgtcgtgacaaattggtatcagagcagtcaatcctggagaagccgcgctacacttcacggttgcaattgcaagtagtagcaatggagaaacagaatattgacttcggcaaaattctcggagaaattcaggaatcgctggtgtctctcaatagtcaataccaagcaatcggagactcaagcggctgtatcgaagttggatgtagggtgaatgggtggcgacctcaagtggaatccacaatctaggatttgcatgaagaggttggagatcttcgtcagcaactcgacctcatcggcaaatccaagcaggctgcttcgagcgcgtcttccccttgtgtctcattggcgggtgaggaaaggaaggaggctgctccgagcacgtctttccctcgggtcccgttgacgggcgaggaaaggaaggcgccattgctgccgatgccgccactgacaactcatttggccgcggcggagggtgggagcaaatgggcaatcggccaccacgttcaacctaatttccggggaaagacaccgggggccttagcgaccctgggtcaaaccccgggcaagggtacgtatgactcgaatcactttcagttccagaagtttgagcattcggggtttgatggtggggaatttgattctgattttggggagcgacaatacaattatagagtgccgaaattggattttcctaagtttgatggttctaaccctcaggattggcgaatgaaatgcgagcactattttgatgtgaataatacctttccggggctatgggtgaggatttcgatcatttatttcatgggtagagcagcatcatggctaagatcttctagggcgcatttgagatttccaatgtgggaagatttttgcactgcagtttctgaaaaattcgatagagaccagcatgaggctttgattaggcaaatggatagtataaaacaaactggaatggtgtgggagttttatgagcaattcgatgaattgatgaatcagcttttagtctatgacccctctgctagctcaaagtactgacacactgttttactgaagggttacgtcgagagattcgtaatgctgttcttttacaacgtccaaagaatctcgagactgctttggctgttgctttgttacaggaagaggtgctggagaatcctcaaaactctagcatcaaggacataaagaagtctgaaggaaattcagcttataagtctgctgtgaagggggcatggccattaccactaccaccaggaaaaggaggagttccaattgttggccgttctgaagacaagaggagcactaacagtgttcgtaatccgagaacaatgtctgataaggtggcagcattgaaaacttacaggcgggctcaagggttatgctatgtttgtgctgagaagtggtctccaagtcgtaagtgtgctccatcagtgcaattgaatgttgtgcaacaattgttcagtctaatcttggaagagaacttgcaggaaggaccggaaaattcagatcaattgaattctgaaactggggaactaatggcaatttctctgcaagcagtgtagggatctgaacctgatgggactatgagaattttggggcatgttcaaggtaaagaattgctgattttagtggactcagggagttcggtcagttttgtcagtacgcagttagcttctggattgacaggattgcaaccattggcacaccagttaattgtcagggttgctaatgggagcaagctgaaatgtgaagcagtaattcctaactgtgagtggcatgtacaaggacatgtattccacacaaccttgagagtgttgcctcttcctaattatgacatgatactaggtatggactggttgaaggaacatagtccaatgtcaattgattggtttaagaagattattgctctcagcttacaaggaactcaagtgacaatacaagggtgtagtccgaactggctaagtgtaatatgatttctgcaaatgaaatgaagcaattccattagaggagagcaatggctcatattgttcagttgtgttccataaatgatcaaaatgtatctgacgaa

SEQ ID NO: 7173 - DNA, 1423 bp, Oryza sativa
ggaattttctgacatctttgtggagccaaaaggtttgccacctcaacgacaatttgatcacaccataccattgctgccaagagcacaaccagtgaatgtgcgacctatatgtatacaccagcacagaaggatgaaattgaagctcaagtaactgaaatgttgcaaaatggcatcatccagcatagcaccagtccgtttgcttctccggtgttgttggttaagaaaaaggacaggtcatggtgcttttgcgtggattatcgacacctgaatgcgataacggtgaagaacaaataccctttgccaatcatcgatgaattgttggacgaattggcgggtgctcagtggtttacaaagttggacttgcgtgctgggtatcaccaaatccgtatgaaggttgaggacgagcataagacaactttccgcactcataatggtcactatgaatttcgtgttcttccttttggattaactagcgcactagctacctttcaaggagtgatgaacaacatactgtgctctctcctacgccgttgtgtgctagtgcattggggcccaaacatttgggtttgtccacatacaagaaagagagcttggcaataatgttggcagtggacaattggcgaccctatttacaacatgctgaattttctattcggactgatcgccatagtctggcatttctagatgatcaacgccttaccacaccttggcagcataaggctcttactaaacttcttggcttccagtacaagattgtttataagaagggaatcgacaatggcgcagcggatgctttatctagatatcctgaatctgaggtcttatcaactctgtcagtttgtgttcttatcgcggttacttgaattgttatctgctaactctaaaggttcttctccccgtcaagttttgaactggcgatgggtgcgcaaaggggcgaagtaggtggaacaggtgcaagtctgctggtccagccacgattcgtcggttgttacatgggagaatcttcatgaactccagcaacgttttcccaatgctgaagcttggggacatgcttcatttcaagggggagggaatgtcacgacacctgacatgcctggaggtacagaacaggaagtcgagccaaagatgcatatgaatgctaatccaccgatgctgcgcaagtctactcaggagagtaggcctaatagtaggtattattcaagtgaatggacccagtacaaatgggctgggccatgtgtgagggagtgaggtccatggcacgatgctataagagaccgacagggagttgagacagaatcgaacactgtagaaacatattctgaataccgaattcaaatctctccctgttctatgctgttcttccccaaatcccaaattccttgctacttctaccctcaattctgttcaattcttccttgttgaa

SEQ ID NO: 7174 - DNA, 9298 bp, Oryza sativa
taccctcaattctgttcaattcttccttgttgaaacattttaaatctagcgccgtgacaatttatccccgttcttccttgtcacagttctctgcttgggcaaggcagagacgcaaagtgcgtgggcggcacgcacgccgggtgtggcggcgtggtcggcctacggtgccctgcgaggggtcgctggaccactccgctcgtcaagtgtctccatggtggcgttcatgcgggtggagacggcctgacgcaacggttcgaggtggctcgggcggtggtggtggcgcaatgaattcgagagcaagagcgcgcgattgaaaggggagacctgagttcgagataaggggcgaaagaatggattagccagtgaacactcaccttgcggcgaccaggatacagcgtgccatggattggggtcggggccatcatcggggcggggatgggcgtcgttgtgggcatggacgtcgtctccttctcactgtggcatgaggttcatcaagtcatgactgcaacgacgacgtctcctcgtagtcctgaacggcgaggcctcctctttgttccgactgcatggcgatggctcggttgcgggagctagttgcactcccgtagccgaaccgatgggcggggagttggagagggatgggggaggcctcgaggtggccggtgaaaggtggggaggatgaaaggcttgaggtgaagaagggaaagaatgggggaggtgggtgtgtagatggcagcaatggcatcctctaattttttggcgcgcgatgagctcggccattgccccttttccagggatgtaggtcccctgcagtactacatgtgcaacactgctcactaacatgtggacctgcagttctgcaggggatctcaattgcttttgcagagcgaggatggcatgggcaggagtcactggggtgaggccggcatcagaggcgtcagggagaggatgtcatggcaccggctaggcggcagggatagggttcatggcgacatgcagcaaggacgggaaagacgaccacgggtgattgggaaggcggctgactctctggcggtccgttaccgtgctcgtgtgcggcatgcccatgcggtttttcgggtatggcggtggcgttcgatcttgctgtcaaaaggcagcatcggtgtgtgccaaagaattatgggaaaaaaatatcattcctattatttccataggttatattttcgttattttctacgtatacaatttggcaccaacttctcatgaaaaaaagatgagtaaattgcattggcagtacaagaacttggaaggtgggtgcgattaggtgcaaaaatttgaaaaccaagcatagcggtacaagaacttgacaggtgaatgcgattaagtgcaaaaacttaaaaaccgagtatagcggtacaataacttggctaggtgggtgcgctcatggtgcaaaagttgccacgccattgttccacctcagcgaaagtgccacatgagcatgcattgaccatctcattttacagaaaagtccctaataacttttatattccaattacttcttcagatatgtccgttttcctcctgtatcacaatgatcaaaccagtccatcttctcatccaaataaattctgccaactccaaaaaaaaaaatccaccacgatacagttcgactctagagaatccccttcttcctcatgacctgcaatacaaaataattggttgatgtgttataccgcataaggaaaataatacactaagattatttgcagattattcaactaattatatctgctgacaagggtacaacacatctagcaagaatttctcattgccaatgtttctcttatatcatatacagttacaggaaacaccaataattacagtaaaaccaatctagtggctagtaccattagatcacttcattgaattgtaataacaaataacaggatattcaagtgaaaacccaaaaaaatgcagccattgtacagatcaatgaaaccttaacttcgaaatcatccatcaaatgaacgaaaaatagaaatctacaaccatcagcaagtgatttaccataacaagctaggagcagatgctccgaaaactcgtcgattcagaaccatcccaaagcttgcggtgaccacgtcgacagtagcaaattgttggcttgaattggtttggttactggtttagggcttgaactaatctagcacacgaagccctcgccgccgccgcgatgtaacggtttccctcgttgtcgtcgtcactgccgccgccaccgtcgctgcgccgctatcgccagcaccgcagccgcctctcaattaggaacatgtcaagaaagatggaaggagatatgcatacgtttgttctgtttgtcgagttaaaaaggaaatgtgattggaacaaaaaaaaaaagctatttggggttttctataaaatgagataggtctttcatatcaaagctgatgtggcaattttgctaaggtggaatagcaacgttacaattttttttacatggctacttttgcaccatgagcgcacccacctagccaagttattgtaccgctatgcttgattttcaagtttttacacctaatcgcacccacctgccaagttcttgtaccgccaacgcaatttactcaaaaaagattataggccgatagaaattaatagatagcaagtggtgtatacataatttctgttgcacgaaagacgattaaagtgtatggtccgatccaccaaccgtagatcatacatatctttttcacattggacatgctccacgacaggcccaactagagcaacaactctaggttctaggcttacataaacaaaatactagttgatgaatgtccctcccttttaaattgtgctcgcccaacatcaattatcgatgtgtcacacatcagacctagcaatctccctgtcacatcaacccatgtgacctcgaagactggttaaccaggtcttcttctccatcaaaaccttggctttcatacaacttgtgaaaatgttcaacccggctaaccaaccatgggctactcatatcacattgggtctattccaacacaggctcaaccggagtcaccactttaggtcctattcttaaacaacccaaaggactagtcttatgggtgagaattgccttcaccttttaagctaagctcttctatcatcaattatggatgtgagtctaaacccaacaaaaacaatctgctgctattggttgcttaaaaggcatataactattcacatatggatgccatactgccatcccagtcctagacaacgatttcttaacatcataattaaaatagagttttctgtcacaatactattaggacgactatgtcaatttcagtcactaattgacaacattgatggaatgaacatttattcagcaaattgtcgcctgagttacagaggcgaggtggtccagttgtcgtcttacactcccgcgcatgatcaacttatttagcccgtcgtctgagcttcgctcgtagtcactcgcttctcagttctctcacgctggccatcatgcaccacgccgtcgtcaatgttccggtggcggtcgccgctgccatgctctacgccctcctcgttgcctcccacctagctccaggaattggccgcctcctcgccctcaccccggtgcttgcccttctcctcaatatcacgttcgctatcccctgctttacggcgcccgcggcaccgcggccttcttcctcgtctggctgggtgagttcaagctcctcctcctcgcttcgggccgtggcccgctggatccctccatccctcctcttgcgtttgtcttcagcgccgctctcccagttaagctcatccgagtgccctctgatgatgccgtggtcacgaagcttgcgtctatgcctatcatgtctctggccatcaagcttgccgtcatggcggtggccatcttctacctcctccacaaaaagaacgagatccatggttatacggccttcaccatctacgtcgtcctcacgtactgcttcctcgacttcctcatgccgtgtgttgccgcggtgggcgccgcgcttggcatggagctggagccgcagttcgacaggccgtacctctctgcctcgctgctggacttctcgggaaggcggtggaaccttatggcgtcggcgatgctccgcccggcggtgtacgaccgtgttagggcccgcctcggtgcaccgggcggcgtgctctccacgttcctcgtgtctgggctgatgcacgaggtgatcgcgtactacatctccttccgcgcgcccaccgggcaggtcacggcgttcttcgcgcttcacggcgtgtgcatgtgcgccgagaggtggtgcgcgcgcaggtgcaggcggagcccgccacgggtcgtggcaacgctagctgctcatcgtggcactggtggagaaaccatctttggtcggtcggccgaaattcacaatagtcccggatccatttaaaaccgggactaaagatgatctttagtcccggttggtggctacaacgggcatatgtgatctttagtcccggttggtcacaccaaccgggactaaagatgatctttagtcctggttgtagagatgtcagacgttgtcagggccctcgggatctttagtcccggttggtgtttccaaccgggactaaagatcacggcgatctttagccccggttggtaacatgccttcttcctcctccagcccgagagcaagcttcaaaatttctcaaagaaagaggggaggtcatgccaaaatttcttgtgaaattttttttaatgattatatacaaatcggaagtgtctaaaaggttagtaacttcatcctccaatgttttttgttgttatattacttttggagctatgtttcacacatttttttttgtctccaaaactttgttgtaagttgatgagagagaaaatttgtgtggggaagaagaatatatagaaattttattctcatagtttaaaatatgatggaaattaatcttaaaaaatagacaacaaactaaattgaaaattaagagaagtacaacattaatattagtttagaacttcaaaaattgttaataagaattgcttgtcgaaagagtttttaattattttatcattactgtttgactgtcattattgtacgaaaatttatttatgtacgattttttttcatttgatgtagatggatcggcaatggatgtacgctgaccggcggtccaaagagtttatcgagggcgtgcattatcttttgagagtggccgaagctaacaagcgtaacggttttatttgttgtccatgcaataagtgtaagaaccagaaggagtattctgcatccaggattattcatttccacttgtttgagtcggggttcatgccaagctataattgttggacatcccacggtgaggaaggggttgaaatggaagaagatgaagcggaggacgagaacattcccgactgggctcagtacgctggatttgaaggaaatcaaacgggcgaggtggacagggatgctggcgataacgacactgcagatgatcttggtcagatgttgcaggacgcaaaggaggactgtgaaagtgaaaaggaggcccataaattagagcggatgttagaggaccacagaacatcattgtccccaggttgcgagcgggggcacaaaaagttggataccactctggagttcttgcaatggaaggcaaaaaatggtgttagtgacaaggcatttcgcgatttattgaaactcatcaagaacattcttccggagggaaacaaattgcccgagacaacgtacgaggctaagaagatagtctgccctctaggattggaagttcagaagattcacgcatgtccgaatgattgtatcctatatcacggtgaggagtacgagaacctagaagcatgccctgtttgtaaagcactacgatacaagattagacgagaggatccaggtgaagttgacgggcagccaacaaagaagagaattcctgctaaggtgatgtggtatttccctataataccacggctaaggcgtttgttcaggaacaaggggaatgcttgaatgatgcgttggcacactgaagaacgtcaacaggacgggaagctgagacaccccgccgatggttcgcagtggtgaaacatcgatagaaaatttaaatactttggaaagacgcacgaaacatacggtttggtttaagtacggatggcatgaatccttttggagagatgagcagcagccatagcacttggcccgttacgatgtgtatctacaacctccccccttggctatgcatgaagaggaagtacataatgatgccgattattattcaaggccccaagcaacctggtaacgacatcgatgtgtacctaagaccattggtcgaagctcttaaactgttgtgaaaaaaggaaggtgtccccgagtgggacgaagataagcaggaggagtttaacctacgagcgctgctgttcgtaaccatcaacgattggcctgcatttagcaacctttccgggcagtccaacaaggggtacaaggcttgcactcactgtatggatgaaacagaaagtacgtatcttaagcactacaggaaggttgtgtacatttgtcatcgtcgattccttgttgcaaaccacccggcactttgaacataaggcagaccaccgtacgaagcctaaacatcgcagcgggaaaacagtgtttgctatggttaaagatcttaaagtagtgtttggaaaggggcctggaagccagcctatagagagcgaagatggtcacgcggcgatgtggaaaaagaacactatattttgggagttacccttttaggaattcttggacgtctgccatgcaatcgacgtgatgcacctcactaagaacctttgcgtaaaccttcttggtttcctaggtgtatatggaaagtcgaaagatacactagaagcacgtaatgatctgaagcatatggaacaacgcagcgaccttcacccggaaccaaaggagaaaggaagccattacttgagtccagccagctatactcttagcaaggcagagaaggaaagtatgtttgaatgcttggagagcatagaggtaccgtctggatactccacgaatataaagcgaataataagcacgaaggagaagaagttcacaaacctaaagtctcctgactgtcacgtgttgatgacacaactgctaccagttgtaataaggggtatccttccagacaatgtccgggcaacaataacaaagctatgtgctttcatgaaagcaaatttgcagaaggtcatcgatccggatagattagaagcccttcagaatgatgtggtgcaatgtcttgtcagttttgagttgatatttccaccttcatttttcaatataatgacgcatctgctttgtcaccttgtcaaagagatcggtattctcgggcctgtgtacctacataacatgtttcctttcgagaggtacataggcgttctgaagaaatatgttcgtaaccgtgctcgtccagaggcaagcatcgccaaggggtatggaacagaggaggtcatcgaactctgcgtagaatttattgaagaccttcgcccaatcggggtacctgaatcatgccatgaagggagactacggggaaaggtggttctcggaaggaaagcaagaatgacggtagacaacaatttattccgtaaagcccatttcacggttctgcaacaatcttcattggtggctccttacatcgaggagcacttggctctagttcgcgccagaaacatcggtaagtccgatgcatggattacacggcatcacattgatactttccccgcgtggctacgacaacatctcatgggtaacgagacgattaaccaacaactggccttcctggcgagaggaccatctggctcgatcgcgacattctagggatatgagatcaatgggtacacattctacacgagagccaaagacatgaagagcacgaaccaaaacagcgttgttcgtatcgatgccatgggacacgatggaacaactggcacgtattacggtgccatcgaggacatatgggaagttgactatggtccactcaaggtccctctattcaggtgccaatagattaggttgactggtggaggcgtaacgattgatgacagtgggatgacaacggttgaccttaacaaggttggatactcggacgaaccttttgtccttgccaatcatgtaacgcaagtcttttacgtgaaggacatgtctagcaaaggaaagaagggcaaagggcctgacgagccgaagcgccacatggttttcccaggtgttaacaaccaaaattggtaatgtcagcatcggaaaggaggattagatcgaagtggagtcgaaggcggagatcgattcgagaacagagcaagaatcggctggagtccagatcggctatgatcaggatcggctgggtccgagtcagactaggtgagctgatacagccgattctgacaacacgacttggtgtacaacatcgggttgagtcgatatgtttcaagatgattgccgcacatggatagagtcctgagaagtcaattgtatctattaattaggatgttttatgtaattttcttagagatatatttagggcaaaagtctgccgcaaagacttatggtatcttagagtttgttagagataagagtcgtgtccgatatggacatagtttgtaattttcgggtataaatagacctcgaaactcatgtaaacaattaacacatatgttcaatacaatttggcgcatcgccaccttttaccttttccactttattttatcatccggcgggacttggcacctgacgcggggctgcatctgtgttcgatctccgactaaggggtaagtccaatgttccgccggcccgggcaattgtatcgtctacgtcggtgtcgttcaaggctgcatcagtacattcgacctcttggattgctctggtttagatgatatatttgtctacctatttatcatatgtctctattaatctagtcttagcatatcaatttagctctatcggctgcttctcgctttagggtttctgccggtatcggctaaatcgcgttgctagattagattagcctaggcatctaccaccctgaaaactcagtcaacggcttgattgtctagatattgtgtttcttttcatacttagtgctgcatcagttaagtttgatctactaagtcgtgcttagaaccatattctctagcctgcttcttgattgccaataagggtttcatcggggtttcagccggtgagttatctggacgttgcatcggctcataaggattgcatatacatataagttggatttagccgatgacaacaaa

SEQ ID NO: 7175 - DNA, 2540 bp, Oryza sativa
cgacatcgactattatcggctatcggctggaactactccatcggcttgtcagccgatcgactgttttgatctactatttgcatatcttgtcagttgcaggaacaaactgactggcacactcgcatctcatcaagatttggacctgcacaggagctaagcagatctcccaggccagtgtgtgttttttgcatcaacacaaattggcatgcccgatgggacacattagaagtcagcaagcggtttcttcatggtcgagaaaccaccatcatcaccgtcctcggctagcccaggttctattaaagagaagatccagaagttaggtttgtcagaggttaatgaagggaacattgtgaccatcgatccagagaagttcacacctgatcaaaagaatgattttgaagcgatgatgtagcaagcacgagaacagttcttgaactcgttcatgcagacccgcaagggagcacttgttcagaagtataaaataaaggtggttcctgatgaccccgggactagttcttccaaggatgacgaagggaaacaagctccagatggctcggctcaaccgagtgacaaaggttctacagatggttttccagcaaatcaaggtgacaacttgcaaggagtgcacggggttcaaggcgatggttctcaaggtgttcaaggtgatggtgttcaaggtggaggtgttaatcaagacggcaatgcagcacagttgcagttcaacaactttcaagattaggttgactatgctgtacaccatgctttaatcaatcaatttgggatattaactaatactttggcaaacatggtgaagtcaatggttgatggttcaatggccgagtatcaagctacaggactagtgtacttaccaggaggggtattccctaattatcggccattaatcaccgataatcaaccagtcatccagtcgattcctcttaatgcaccatcggctcagccggcagcactggtgtcgcttcctgcacctgctccaccaccttcggctccaggccaaagaataaatccctggttgttggtaagggaacagccacagcatgctggacagaatgtgaatcggctaacgcaagaccaggttgcatctatgttcttacctcctcagcacaccattgatcaaacccagcagcagccgattcaataaacaccgccaaggcagcaggttgttcaaccagttcagtcaacactcccaatccaacaggttgtgcaaccagttcaacagacaccacccagacgacaggtcttgcagccaattcagcaaacgccattaaggcagcaggttgttcagccgattcagcagcaaggctctatgaatgcattggctgggtttgcaacactgggtggtcagcctgggcagcatgctgcaaatcaagttattccagagcacttggttcatcacgtacaaccagatggcacagtgattcctcaagttattcctgagcatttggtgcacaatattcagccggatcttcaaaattactagggggcaatttgaattatcagtatcagccgccatcaccccaagttcagtatcagcaggcatgatcagctcaaccccaatttgttcctcaatacaaccaattcgagcctatgacacagcaatctcaaggaacacctcaacaacaacaatgggccgatttgattgcagatgtcatgaaggagctgtttgggcttaggccgaaagatgctggaaatttgttccgaccaaccctatcctgagtgggttgagagggttcctttgccccaaatcggtttaaggtaccggacttttcgaaatttccagggcaagatagtacatcgacttgtgagcacattagccgatttttagcccagtgtggtgaagcatcggctgtggatgccttgaaggttaggttgttccagttatctttgtctggatcggcctttacttggttttcttctttaccatatggatcaattaacagttgggccgatttagaaaaacagtttcacaactatttttatagtttggttcatgagatgaaagtgtccgatctgacatcgatcaagcaaagacataatgagcctgtgcatgagtacattcagagattcagagagatgaggaataagtgctacagcttaagtttgactgatgcccagttagccgatttggcttttcagggtatgattgctccaatcagggagaaattctcatctgaggattttgacagcttgtcccatctcgcacaaaaggtgaccttgcatgaacaaaggtctgtccttatatgtatgggtcggatgatgaggatgatgattctgagatagctgtggccgaatgggtaaggagcaaaaaggttataccgtgccaatgggtaaagaacacaggaaaagaggagaggtatgactttgatatcaccaaggctgacaagatttttgacttactactccgggagaagcaaattcaacttcctactggtcacacaattccatcggctgaggaattggcaagaaaaggtattgcaagtggcataattctgggtctcatacgactaatgattacaaggtct
